US009890389B2

(12) United States Patent
Shoresh et al.

(10) Patent No.: US 9,890,389 B2
(45) Date of Patent: Feb. 13, 2018

(54) ISOLATED POLYNUCLEOTIDES AND POLYPEPTIDES, AND METHODS OF USING SAME FOR INCREASING NITROGEN USE EFFICIENCY OF PLANTS

(71) Applicant: Evogene Ltd., Rechovot (IL)

(72) Inventors: Michal Shoresh, Holon (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 50 days.

(21) Appl. No.: 14/655,360

(22) PCT Filed: Dec. 19, 2013

(86) PCT No.: PCT/IL2013/051042
§ 371 (c)(1),
(2) Date: Jun. 25, 2015

(87) PCT Pub. No.: WO2014/102773
PCT Pub. Date: Jul. 3, 2014

(65) Prior Publication Data
US 2015/0376640 A1    Dec. 31, 2015

Related U.S. Application Data

(60) Provisional application No. 61/811,757, filed on Apr. 14, 2013, provisional application No. 61/745,784, filed on Dec. 25, 2012.

(51) Int. Cl.
*C12N 15/82* (2006.01)
*C07K 14/415* (2006.01)

(52) U.S. Cl.
CPC ........ *C12N 15/8271* (2013.01); *C07K 14/415* (2013.01); *C12N 15/8247* (2013.01); *C12N 15/8261* (2013.01); *C12N 15/8273* (2013.01)

(58) Field of Classification Search
None
See application file for complete search history.

(56) References Cited

U.S. PATENT DOCUMENTS

| | | | |
|---|---|---|---|
| 6,084,153 A | 7/2000 | Good et al. | |
| 2002/0046419 A1 | 4/2002 | Choo et al. | |
| 2005/0108791 A1 | 5/2005 | Edgerton | |
| 2006/0179511 A1 | 8/2006 | Chomet et al. | |
| 2009/0094717 A1* | 4/2009 | Troukhan | C07K 14/415 800/290 |

FOREIGN PATENT DOCUMENTS

| | | |
|---|---|---|
| WO | WO 2004/081173 | 9/2004 |
| WO | WO 2004/104162 | 12/2004 |
| WO | WO 2004/111183 | 12/2004 |
| WO | WO 2005/121364 | 12/2005 |
| WO | WO 2007/020638 | 2/2007 |
| WO | WO 2007/049275 | 5/2007 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/141824 | 11/2009 |
| WO | WO 2010/020941 | 2/2010 |
| WO | WO 2010/049897 | 5/2010 |
| WO | WO 2010/075143 | 7/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/078153 | 5/2013 |
| WO | WO 2013/080203 | 6/2013 |
| WO | WO 2013/098819 | 7/2013 |
| WO | WO 2013/128448 | 9/2013 |
| WO | WO 2013/179211 | 12/2013 |
| WO | WO 2014/033714 | 3/2014 |
| WO | WO 2014/102773 | 7/2014 |
| WO | WO 2014/102774 | 7/2014 |
| WO | WO 2014/188428 | 11/2014 |
| WO | WO 2015/029031 | 3/2015 |
| WO | WO 2015/181823 | 12/2015 |
| WO | WO 2016/030885 | 3/2016 |

OTHER PUBLICATIONS

International Preliminary Report on Patentability dated Jul. 9, 2015 From the International Bureau of WIPO Re. Application No. PCT/IL2013/051042.
International Search Report and the Written Opinion dated Feb. 20, 2014 From the International Searching Authority Re. Application No. PCT/IL2013/051042.
Invitation to Pay Additional Fees dated Jan. 21, 2014 From the International Searching Authority Re. Application No. PCT/IL2013/051042.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Examination Report dated Jun. 27, 2017 From the Instituto Mexicana de la Propiedad Industrial, Direccion Divisional de Patentes, IMPI Re. Application No. MX/a/2015/008307 and Its Translation Into English. (9 Pages).

* cited by examiner

*Primary Examiner* — Brent T Page

(57) ABSTRACT

Provided are isolated polypeptides which are at least 80% homologous to SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, 6792-6892 or 6893, isolated polynucleotides which are at least 80% identical to SEQ ID NOs: 1-91, 94-201, 328-2317, 2320-2321, 2323, 2326-3835, 3838-3840, 3842-3843, 3848, 3850-3852, 3854, 3856-3953, 3955-4061 or 4062, nucleic acid constructs comprising same, transgenic cells expressing same, transgenic plants expressing same and method of using same for increasing yield, abiotic stress tolerance, growth rate, biomass, vigor, oil content, photosynthetic capacity, seed yield, fiber yield, fiber quality, fiber length, and/or nitrogen use efficiency of a plant.

8 Claims, 10 Drawing Sheets pQFN, pQFNc

Normal conditions

Osmotic stress (15 % PEG)

Nitrogen limiting conditions pQNa_RP

ISOLATED POLYNUCLEOTIDES AND POLYPEPTIDES, AND METHODS OF USING SAME FOR INCREASING NITROGEN USE EFFICIENCY OF PLANTS

RELATED APPLICATIONS

This application is a National Phase of PCT Patent Application No. PCT/IL2013/051042 having International filing date of Dec. 19, 2013, which claims the benefit of priority under 35 USC § 119(e) of U.S. Provisional Patent Application Nos. 61/811,757 filed on Apr. 14, 2013 and 61/745,784 filed on Dec. 25, 2012. The contents of the above applications are all incorporated by reference as if fully set forth herein in their entirety.

SEQUENCE LISTING STATEMENT

The ASCII file, entitled 62549SequenceListing.txt, created on Jun. 24, 2015, comprising 16,550,521 bytes, submitted concurrently with the filing of this application is incorporated herein by reference.

FIELD AND BACKGROUND OF THE INVENTION

The present invention, in some embodiments thereof, relates to novel polynucleotides and polypeptides which can increase nitrogen use efficiency, fertilizer use efficiency, yield (e.g., seed/grain yield, oil yield), growth rate, vigor, biomass, oil content, fiber yield, fiber quality and/or length, abiotic stress tolerance and/or water use efficiency of a plant.

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. For example, inorganic nitrogenous fertilizers such as ammonium nitrate, potassium nitrate, or urea, typically accounts for 40% of the costs associated with crops such as corn and wheat.

Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen is responsible for biosynthesis of amino and nucleic acids, prosthetic groups, plant hormones, plant chemical defenses, etc. and usually needs to be replenished every year, particularly for cereals, which comprise more than half of the cultivated areas worldwide. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. Publication No. 20020046419 (U.S. Pat. No. 7,262,055 to Choo, et al.); U.S. Pat. Appl. No. 20050108791 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Vegetable or seed oils are the major source of energy and nutrition in human and animal diet. They are also used for the production of industrial products, such as paints, inks and lubricants. In addition, plant oils represent renewable sources of long-chain hydrocarbons which can be used as fuel. Since the currently used fossil fuels are finite resources and are gradually being depleted, fast growing biomass crops may be used as alternative fuels or for energy feedstocks and may reduce the dependence on fossil energy supplies. However, the major bottleneck for increasing consumption of plant oils as bio-fuel is the oil price, which is still higher than fossil fuel. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants. Genes known to be involved in increasing plant oil yields include those participating in fatty acid synthesis or sequestering such as desaturase [e.g., DELTA6, DELTA12 or acyl-ACP (Ssi2; Arabidopsis Information Resource (TAIR; arabidopsis (dot) org/), TAIR No. AT2G43710)], OleosinA (TAIR No. AT3G01570) or FAD3 (TAIR No. AT2G29980), and various transcription factors and activators such as Led 1 [TAIR No. AT1G21970, Lotan et al. 1998. Cell. 26; 93(7):1195-205], Lec2 [TAIR No. AT1G28300, Santos Mendoza et al. 2005, FEBS Lett. 579 (21):4666-701, Fus3 [TAIR No. AT3G26790], ABI3 [TAIR No. AT3G24650, Lara et al. 2003. J Biol Chem. 278(23): 21003-11] and Wri 1 [TAIR No. AT3G54320, Cernac and Benning, 2004. Plant J. 40(4): 575-85].

Genetic engineering efforts aiming at increasing oil content in plants (e.g., in seeds) include upregulating endoplasmic reticulum (FADS) and plastidal (FAD7) fatty acid desaturases in potato (Zabrouskov V., et al., 2002; Physiol Plant. 116:172-185); over-expressing the GmDof4 and GmDof11 transcription factors (Wang H W et al., 2007; Plant J. 52:716-29); over-expressing a yeast glycerol-3-phosphate dehydrogenase under the control of a seed-specific promoter (Vigeolas H, et al. 2007, Plant Biotechnol J. 5:431-41; U.S. Pat. Appl. No. 20060168684); using Arabidopsis FAE1 and yeast SLC1-1 genes for improvements in erucic acid and oil content in rapeseed (Katavic V, et al., 2000, Biochem Soc Trans. 28:935-7).

Various patent applications disclose genes and proteins which can increase oil content in plants. These include for example, U.S. Pat. Appl. No. 20080076179 (lipid metabolism protein); U.S. Pat. Appl. No. 20060206961 (the Ypr140w polypeptide); U.S. Pat. Appl. No. 20060174373 [triacylglycerols synthesis enhancing protein (TEP)]; U.S. Pat. Appl. Nos. 20070169219, 20070006345, 20070006346 and 20060195943 (disclose transgenic plants with improved nitrogen use efficiency which can be used for the conversion into fuel or chemical feedstocks); WO2008/122980 (polynucleotides for increasing oil content, growth rate, biomass, yield and/or vigor of a plant).

Abiotic stress (ABS; also referred to as "environmental stress") conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress and thus necessitate optimal growth conditions for commercial crop yields. Continuous exposure to stress causes major alterations in the plant metabolism which ultimately leads to cell death and consequently yield losses.

Drought is a gradual phenomenon, which involves periods of abnormally dry weather that persists long enough to produce serious hydrologic imbalances such as crop damage, water supply shortage and increased susceptibility to various diseases. In severe cases, drought can last many years and results in devastating effects on agriculture and water supplies. Furthermore, drought is associated with increase susceptibility to various diseases.

For most crop plants, the land regions of the world are too arid. In addition, overuse of available water results in increased loss of agriculturally-usable land (desertification), and increase of salt accumulation in soils adds to the loss of available water in soils.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Soil salinity is thus one of the more important variables that determine whether a plant may thrive. In many parts of the world, sizable land areas are uncultivable due to naturally high soil salinity. Thus, salination of soils that are used for agricultural production is a significant and increasing problem in regions that rely heavily on agriculture, and is worsen by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. On the other hand, germination normally takes place at a salt concentration which is higher than the mean salt level in the whole soil profile.

Salt and drought stress signal transduction consist of ionic and osmotic homeostasis signaling pathways. The ionic aspect of salt stress is signaled via the SOS pathway where a calcium-responsive SOS3-SOS2 protein kinase complex controls the expression and activity of ion transporters such as SOS1. The osmotic component of salt stress involves complex plant reactions that overlap with drought and/or cold stress responses.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Common aspects of drought, cold and salt stress response [Reviewed in Xiong and Zhu (2002) Plant Cell Environ. 25: 131-139] include: (a) transient changes in the cytoplasmic calcium levels early in the signaling event; (b) signal transduction via mitogen-activated and/or calcium dependent protein kinases (CDPKs) and protein phosphatases; (c) increases in abscisic acid levels in response to stress triggering a subset of responses; (d) inositol phosphates as signal molecules (at least for a subset of the stress responsive transcriptional changes; (e) activation of phospholipases which in turn generates a diverse array of second messenger molecules, some of which might regulate the activity of stress responsive kinases; (f) induction of late embryogenesis abundant (LEA) type genes including the CRT/DRE responsive COR/RD genes; (g) increased levels of antioxidants and compatible osmolytes such as proline and soluble sugars; and (h) accumulation of reactive oxygen species such as superoxide, hydrogen peroxide, and hydroxyl radicals. Abscisic acid biosynthesis is regulated by osmotic stress at multiple steps. Both ABA-dependent and -independent osmotic stress signaling first modify constitutively expressed transcription factors, leading to the expression of early response transcriptional activators, which then activate downstream stress tolerance effector genes.

Several genes which increase tolerance to cold or salt stress can also improve drought stress protection, these include for example, the transcription factor AtCBF/DREB1, OsCDPK7 (Saijo et al. 2000, Plant J. 23: 319-327) or AVP1 (a vacuolar pyrophosphatase-proton pump, Gaxiola et al. 2001, Proc. Natl. Acad. Sci. USA 98: 11444-11449).

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

Genetic engineering efforts, aimed at conferring abiotic stress tolerance to transgenic crops, have been described in various publications [Apse and Blumwald (Curr Opin Biotechnol. 13:146-150, 2002), Quesada et al. (Plant Physiol. 130:951-963, 2002), Holmström et al. (Nature 379: 683-684, 1996), Xu et al. (Plant Physiol 110: 249-257, 1996), Pilon-Smits and Ebskamp (Plant Physiol 107: 125-130, 1995) and Tarczynski et al. (Science 259: 508-510, 1993)].

Various patents and patent applications disclose genes and proteins which can be used for increasing tolerance of plants to abiotic stresses. These include for example, U.S. Pat. Nos. 5,296,462 and 5,356,816 (for increasing tolerance to cold stress); U.S. Pat. No. 6,670,528 (for increasing ABST); U.S. Pat. No. 6,720,477 (for increasing ABST); U.S. application Ser. Nos. 09/938,842 and 10/342,224 (for increasing ABST); U.S. application Ser. No. 10/231,035 (for increasing ABST); WO2004/104162 (for increasing ABST and biomass); WO2007/020638 (for increasing ABST, biomass, vigor and/or yield); WO2007/049275 (for increasing ABST, biomass, vigor and/or yield); WO2010/076756 (for increasing ABST, biomass and/or yield); WO2009/083958 (for increasing water use efficiency, fertilizer use efficiency, biotic/abiotic stress tolerance, yield and/or biomass); WO2010/020941 (for increasing nitrogen use efficiency, abiotic stress tolerance, yield and/or biomass); WO2009/141824 (for increasing plant utility); WO2010/049897 (for increasing plant yield).

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Cotton and cotton by-products provide raw materials that are used to produce a wealth of consumer-based products in addition to textiles including cotton foodstuffs, livestock feed, fertilizer and paper. The production, marketing, consumption and trade of cotton-based products generate an excess of $100 billion annually in the U.S. alone, making cotton the number one value-added crop.

Even though 90% of cotton's value as a crop resides in the fiber (lint), yield and fiber quality has declined due to general erosion in genetic diversity of cotton varieties, and an increased vulnerability of the crop to environmental conditions.

There are many varieties of cotton plant, from which cotton fibers with a range of characteristics can be obtained and used for various applications. Cotton fibers may be characterized according to a variety of properties, some of which are considered highly desirable within the textile industry for the production of increasingly high quality products and optimal exploitation of modern spinning technologies. Commercially desirable properties include length, length uniformity, fineness, maturity ratio, decreased fuzz fiber production, micronaire, bundle strength, and single fiber strength. Much effort has been put into the improvement of the characteristics of cotton fibers mainly focusing on fiber length and fiber fineness. In particular, there is a great demand for cotton fibers of specific lengths.

A cotton fiber is composed of a single cell that has differentiated from an epidermal cell of the seed coat, developing through four stages, i.e., initiation, elongation, secondary cell wall thickening and maturation stages. More specifically, the elongation of a cotton fiber commences in the epidermal cell of the ovule immediately following flowering, after which the cotton fiber rapidly elongates for approximately 21 days. Fiber elongation is then terminated, and a secondary cell wall is formed and grown through maturation to become a mature cotton fiber.

Several candidate genes which are associated with the elongation, formation, quality and yield of cotton fibers were disclosed in various patent applications such as U.S. Pat. No. 5,880,100 and U.S. patent application Ser. Nos. 08/580,545, 08/867,484 and 09/262,653 (describing genes involved in cotton fiber elongation stage); WO0245485 (improving fiber quality by modulating sucrose synthase); U.S. Pat. No. 6,472,588 and WO0117333 (increasing fiber quality by transformation with a DNA encoding sucrose phosphate synthase); WO9508914 (using a fiber-specific promoter and a coding sequence encoding cotton peroxidase); WO9626639 (using an ovary specific promoter sequence to express plant growth modifying hormones in cotton ovule tissue, for altering fiber quality characteristics such as fiber dimension and strength); U.S. Pat. No. 5,981,834, U.S. Pat. No. 5,597,718, U.S. Pat. No. 5,620,882, U.S. Pat. No. 5,521,708 and U.S. Pat. No. 5,495,070 (coding sequences to alter the fiber characteristics of transgenic fiber producing plants); U.S. patent applications U.S. 2002049999 and U.S. 2003074697 (expressing a gene coding for endoxyloglucan transferase, catalase or peroxidase for improving cotton fiber characteristics); WO 01/40250 (improving cotton fiber quality by modulating transcription factor gene expression); WO 96/40924 (a cotton fiber transcriptional initiation regulatory region associated which is expressed in cotton fiber); EP0834566 (a gene which controls the fiber formation mechanism in cotton plant); WO2005/121364 (improving cotton fiber quality by modulating gene expression); WO2008/075364 (improving fiber quality, yield/biomass/vigor and/or abiotic stress tolerance of plants).

WO publication No. 2004/104162 discloses methods of increasing abiotic stress tolerance and/or biomass in plants and plants generated thereby.

WO publication No. 2004/111183 discloses nucleotide sequences for regulating gene expression in plant trichomes and constructs and methods utilizing same.

WO publication No. 2004/081173 discloses novel plant derived regulatory sequences and constructs and methods of using such sequences for directing expression of exogenous polynucleotide sequences in plants.

WO publication No. 2005/121364 discloses polynucleotides and polypeptides involved in plant fiber development and methods of using same for improving fiber quality, yield and/or biomass of a fiber producing plant.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2007/020638 discloses methods of increasing abiotic stress tolerance and/or biomass in plants and plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2009/083958 discloses methods of increasing water use efficiency, fertilizer use efficiency, biotic/abiotic stress tolerance, yield and biomass in plant and plants generated thereby.

WO publication No. 2009/141824 discloses isolated polynucleotides and methods using same for increasing plant utility.

WO publication No. 2009/013750 discloses genes, constructs and methods of increasing abiotic stress tolerance, biomass and/or yield in plants generated thereby.

WO publication No. 2010/020941 discloses methods of increasing nitrogen use efficiency, abiotic stress tolerance, yield and biomass in plants and plants generated thereby.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO2010/100595 publication discloses isolated polynucleotides and polypeptides, and methods of using same for increasing plant yield and/or agricultural characteristics.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency.

WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2011/015985 publication discloses polynucleotides and polypeptides for increasing desirable plant qualities.

WO2011/135527 publication discloses isolated polynucleotides and polypeptides for increasing plant yield and/or agricultural characteristics.

WO2012/028993 publication discloses isolated polynucleotides and polypeptides, and methods of using same for increasing nitrogen use efficiency, yield, growth rate, vigor, biomass, oil content, and/or abiotic stress tolerance.

WO2012/085862 publication discloses isolated polynucleotides and polypeptides, and methods of using same for improving plant properties.

WO2012/150598 publication discloses isolated polynucleotides and polypeptides and methods of using same for increasing plant yield, biomass, growth rate, vigor, oil content, abiotic stress tolerance of plants and nitrogen use efficiency.

WO2013/027223 publication discloses isolated polynucleotides and polypeptides, and methods of using same for increasing plant yield and/or agricultural characteristics.

WO2013/080203 publication discloses isolated polynucleotides and polypeptides, and methods of using same for increasing nitrogen use efficiency, yield, growth rate, vigor, biomass, oil content, and/or abiotic stress tolerance.

WO2013/098819 publication discloses isolated polynucleotides and polypeptides, and methods of using same for increasing yield of plants.

WO2013/128448 publication discloses isolated polynucleotides and polypeptides and methods of using same for increasing plant yield, biomass, growth rate, vigor, oil content, abiotic stress tolerance of plants and nitrogen use efficiency.

SUMMARY OF THE INVENTION

According to an aspect of some embodiments of the present invention there is provided a method of increasing nitrogen use efficiency, yield, growth rate, biomass, vigor, oil content, seed yield, fiber yield, fiber quality, fiber length, photosynthetic capacity, and/or abiotic stress tolerance of a plant, comprising expressing within the plant an exogenous polynucleotide comprising a nucleic acid sequence encoding a polypeptide at least 80% identical to SEQ ID NO: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, 6792-6892 or 6893, thereby increasing the nitrogen use efficiency, yield, growth rate, biomass, vigor, oil content, seed yield, fiber yield, fiber quality, fiber length, photosynthetic capacity, and/or abiotic stress tolerance of the plant.

According to an aspect of some embodiments of the present invention there is provided a method of increasing nitrogen use efficiency, yield, growth rate, biomass, vigor, oil content, seed yield, fiber yield, fiber quality, fiber length, photosynthetic capacity, and/or abiotic stress tolerance of a plant, comprising expressing within the plant an exogenous polynucleotide comprising a nucleic acid sequence encoding a polypeptide selected from the group consisting of SEQ ID NOs: 202-327 and 4064-6893, thereby increasing the nitrogen use efficiency, yield, growth rate, biomass, vigor, oil content, seed yield, fiber yield, fiber quality, fiber length, photosynthetic capacity, and/or abiotic stress tolerance of the plant.

According to an aspect of some embodiments of the present invention there is provided a method of producing a crop comprising growing a crop plant transformed with an exogenous polynucleotide comprising a nucleic acid sequence encoding a polypeptide at least 80% homologous (e.g., identical) to the amino acid sequence selected from the group consisting of SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, and 6792-6893, wherein the crop plant is derived from plants selected for increased nitrogen use efficiency, increased yield, increased growth rate, increased biomass, increased vigor, increased oil content, increased seed yield, increased fiber yield, increased fiber quality, increased fiber length, increased photosynthetic capacity, and/or increased abiotic stress tolerance as compared to a wild type plant of the same species which is grown under the same growth conditions, and the crop plant having the increased nitrogen use efficiency, increased yield, increased growth rate, increased biomass, increased vigor, increased oil content, increased seed yield, increased fiber yield, increased fiber quality, increased fiber length, increased photosynthetic capacity, and/or increased abiotic stress tolerance, thereby producing the crop.

According to an aspect of some embodiments of the present invention there is provided a method of increasing nitrogen use efficiency, yield, growth rate, biomass, vigor, oil content, seed yield, fiber yield, fiber quality, fiber length, photosynthetic capacity, and/or abiotic stress tolerance of a plant, comprising expressing within the plant an exogenous polynucleotide comprising a nucleic acid sequence at least 80% identical to SEQ ID NO: 1-91, 94-201, 328-2317, 2320-2321, 2323, 2326-3835, 3838-3840, 3842-3843, 3848, 3850-3852, 3854, 3856-3953, 3955-4061 or 4062, thereby increasing the nitrogen use efficiency, yield, growth rate, biomass, vigor, oil content, seed yield, fiber yield, fiber quality, fiber length, photosynthetic capacity, and/or abiotic stress tolerance of the plant.

According to an aspect of some embodiments of the present invention there is provided a method of increasing nitrogen use efficiency, yield, growth rate, biomass, vigor, oil content, seed yield, fiber yield, fiber quality, fiber length, photosynthetic capacity, and/or abiotic stress tolerance of a plant, comprising expressing within the plant an exogenous polynucleotide comprising the nucleic acid sequence selected from the group consisting of SEQ ID NOs: 1-201 and 328-4062, thereby increasing the nitrogen use efficiency, yield, growth rate, biomass, vigor, oil content, seed yield, fiber yield, fiber quality, fiber length, photosynthetic capacity, and/or abiotic stress tolerance of the plant.

According to an aspect of some embodiments of the present invention there is provided a method of producing a crop comprising growing a crop plant transformed with an exogenous polynucleotide which comprises a nucleic acid sequence which is at least 80% identical to the nucleic acid sequence selected from the group consisting of SEQ ID NOs: 1-91, 94-201, 328-2317, 2320-2321, 2323, 2326-3835, 3838-3840, 3842-3843, 3848, 3850-3852, 3854, 3856-3953, and 3955-4062, wherein the crop plant is derived from plants selected for increased nitrogen use efficiency, increased yield, increased growth rate, increased biomass, increased vigor, increased oil content, increased seed yield, increased fiber yield, increased fiber quality, increased fiber length, increased photosynthetic capacity, and/or increased abiotic stress tolerance as compared to a wild type plant of the same species which is grown under the same growth conditions, and the crop plant having the increased nitrogen use efficiency, increased yield, increased growth rate, increased biomass, increased vigor, increased oil content, increased seed yield, increased fiber yield, increased fiber quality, increased fiber length, increased photosynthetic capacity, and/or increased abiotic stress tolerance, thereby producing the crop.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO:202-219, 221-292, 295-327 and 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, 6792-6892, or 6893, wherein the amino acid sequence is capable of increasing nitrogen use efficiency, yield, growth rate, biomass, vigor, oil content, seed yield, fiber yield, fiber quality, fiber length, photosynthetic capacity, and/or abiotic stress tolerance of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 202-327 and 4064-6893.

According to an aspect of some embodiments of the present invention there is provided an isolated polynucleotide comprising a nucleic acid sequence at least 80% identical to SEQ ID NO: 1-91, 94-201, 328-2317, 2320-2321, 2323, 2326-3835, 3838-3840, 3842-3843, 3848, 3850-3852, 3854, 3856-3953, 3955-4061 or 4062, wherein the nucleic acid sequence is capable of increasing nitrogen use efficiency, yield, growth rate, biomass, vigor, oil content, seed yield, fiber yield, fiber quality, fiber length, photosynthetic capacity, and/or abiotic stress tolerance of a plant.

According to an aspect of some embodiments of the present invention there is provided an isolated polynucleotide comprising the nucleic acid sequence selected from the group consisting of SEQ ID NOs: 1-201 and 328-4062.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 202-219, 221-292, 295-327 and 4064-4175, 4177-4210, 4212-4580, 4582-4603, 4605-4749, 4751-4778, 4780-5223, 5225-5493, 5522-5807, 5812, 5815-

5816, 5828-6679, 6689-6690, 6708-6785, 6792-6892, or 6893, wherein the amino acid sequence is capable of increasing nitrogen use efficiency, yield, growth rate, biomass, vigor, oil content, seed yield, fiber yield, fiber quality, fiber length, photosynthetic capacity, and/or abiotic stress tolerance of a plant.

According to an aspect of some embodiments of the present invention there is provided an isolated polypeptide comprising the amino acid sequence selected from the group consisting of SEQ ID NOs: 202-327 and 4064-6893.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to an aspect of some embodiments of the present invention there is provided a transgenic plant comprising the nucleic acid construct of some embodiments of the invention or the plant cell of some embodiments of the invention.

According to an aspect of some embodiments of the present invention there is provided a method of growing a crop, the method comprising seeding seeds and/or planting plantlets of a plant transformed with the isolated polynucleotide of some embodiments of the invention, or with the nucleic acid construct of some embodiments of the invention, wherein the plant is derived from plants selected for at least one trait selected from the group consisting of: increased nitrogen use efficiency, increased abiotic stress tolerance, increased biomass, increased growth rate, increased vigor, increased yield and increased fiber yield, increased fiber quality, increased fiber length, increased photosynthetic capacity, and increased oil content as compared to a non-transformed plant, thereby growing the crop.

According to an aspect of some embodiments of the present invention there is provided a method of selecting a transformed plant having increased nitrogen use efficiency, yield, growth rate, biomass, vigor, oil content, seed yield, fiber yield, fiber quality, fiber length, photosynthetic capacity, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least 80% homologous to the amino acid sequence selected from the group consisting of SEQ ID NOs: 202-219, 221-292, 295-327 and 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, and 6792-6893, (b) selecting from the plants a plant having increased nitrogen use efficiency, yield, growth rate, biomass, vigor, oil content, seed yield, fiber yield, fiber quality, fiber length, photosynthetic capacity, and/or abiotic stress tolerance, thereby selecting the plant having increased nitrogen use efficiency, yield, growth rate, biomass, vigor, oil content, seed yield, fiber yield, fiber quality, fiber length, photosynthetic capacity, and/or abiotic stress tolerance as compared to the wild type plant of the same species which is grown under the same growth conditions.

According to an aspect of some embodiments of the present invention there is provided a method of selecting a transformed plant having increased nitrogen use efficiency, yield, growth rate, biomass, vigor, oil content, seed yield, fiber yield, fiber quality, fiber length, photosynthetic capacity, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least 80% identical to the nucleic acid sequence selected from the group consisting of SEQ ID NOs: 1-91, 94-201, 328-2317, 2320-2321, 2323, 2326-3835, 3838-3840, 3842-3843, 3848, 3850-3852, 3854, 3856-3953, and 3955-4062, (b) selecting from the plants a plant having increased nitrogen use efficiency, yield, growth rate, biomass, vigor, oil content, seed yield, fiber yield, fiber quality, fiber length, photosynthetic capacity, and/or abiotic stress tolerance, thereby selecting the plant having increased nitrogen use efficiency, yield, growth rate, biomass, vigor, oil content, seed yield, fiber yield, fiber quality, fiber length, photosynthetic capacity, and/or abiotic stress tolerance as compared to the wild type plant of the same species which is grown under the same growth conditions.

According to some embodiments of the invention, the nucleic acid sequence encodes an amino acid sequence selected from the group consisting of SEQ ID NOs: 202-327 and 4064-6893.

According to some embodiments of the invention, the nucleic acid sequence is selected from the group consisting of SEQ ID NOs:1-201 and 328-4062.

According to some embodiments of the invention, the polynucleotide consists of the nucleic acid sequence selected from the group consisting of SEQ ID NOs: 1-201 and 328-4062.

According to some embodiments of the invention, the nucleic acid sequence encodes the amino acid sequence selected from the group consisting of SEQ ID NOs: 202-327 and 4064-6893.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, osmotic stress, water deprivation, flood, etiolation, low temperature, high temperature, heavy metal toxicity, anaerobiosis, nutrient deficiency, nitrogen deficiency, nutrient excess, atmospheric pollution and UV irradiation.

According to some embodiments of the invention, the yield comprises seed yield or oil yield.

According to some embodiments of the invention, the method further comprising growing the plant expressing the exogenous polynucleotide under nitrogen-limiting conditions.

According to some embodiments of the invention, the promoter is heterologous to the isolated polynucleotide and/or to the host cell.

According to some embodiments of the invention, the isolated polynucleotide is heterologous to the plant cell.

According to some embodiments of the invention, the non-transformed plant is a wild type plant of identical genetic background.

According to some embodiments of the invention, the non-transformed plant is a wild type plant of the same species.

According to some embodiments of the invention, the non-transformed plant is grown under identical growth conditions.

According to some embodiments of the invention, the method further comprising selecting a plant having an increased nitrogen use efficiency, yield, growth rate, biomass, vigor, oil content, seed yield, fiber yield, fiber quality, fiber length, photosynthetic capacity, and/or abiotic stress tolerance as compared to the wild type plant of the same species which is grown under the same growth conditions.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
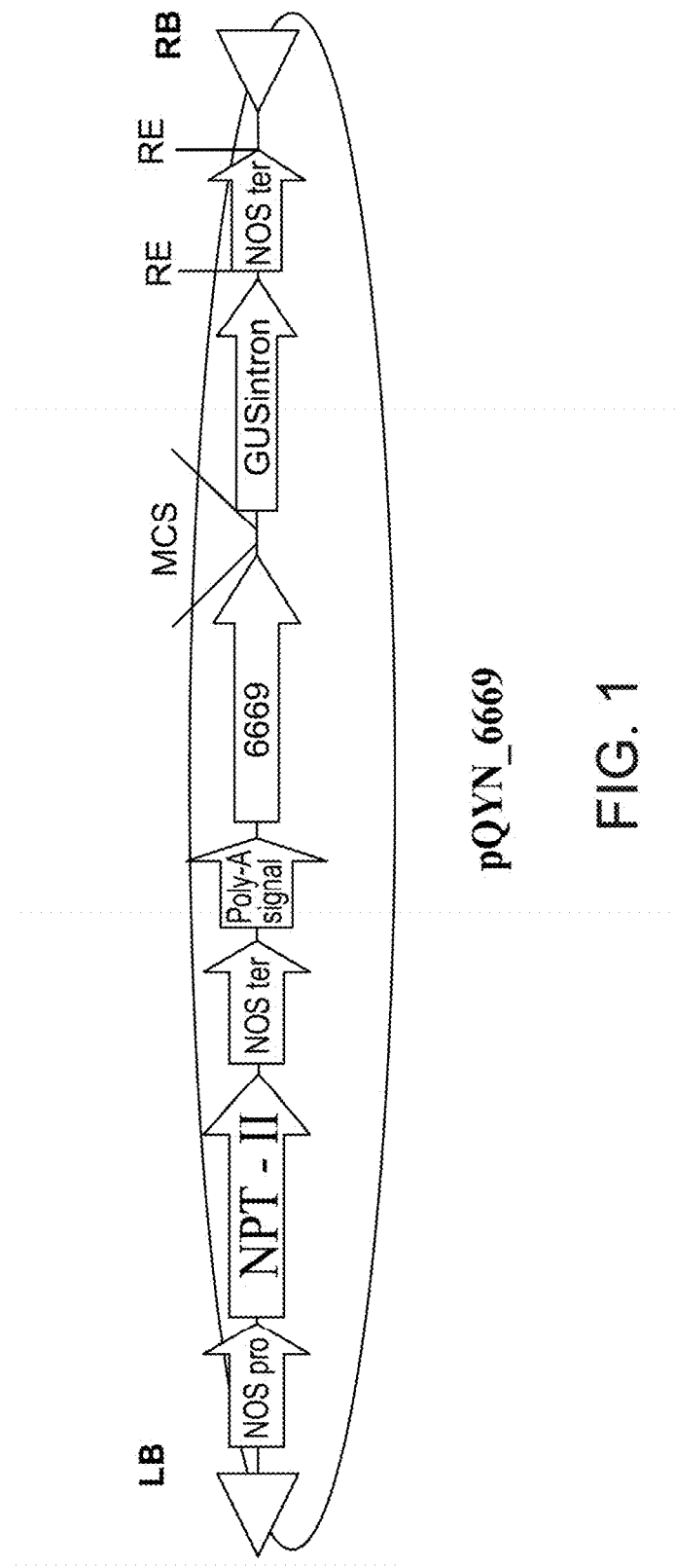
FIG. 1 is a schematic illustration of the modified pGI binary plasmid containing the new At6669 promoter (SEQ ID NO: 6918) and the GUSintron (pQYN_6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUS-intron reporter gene.
Figure 2:
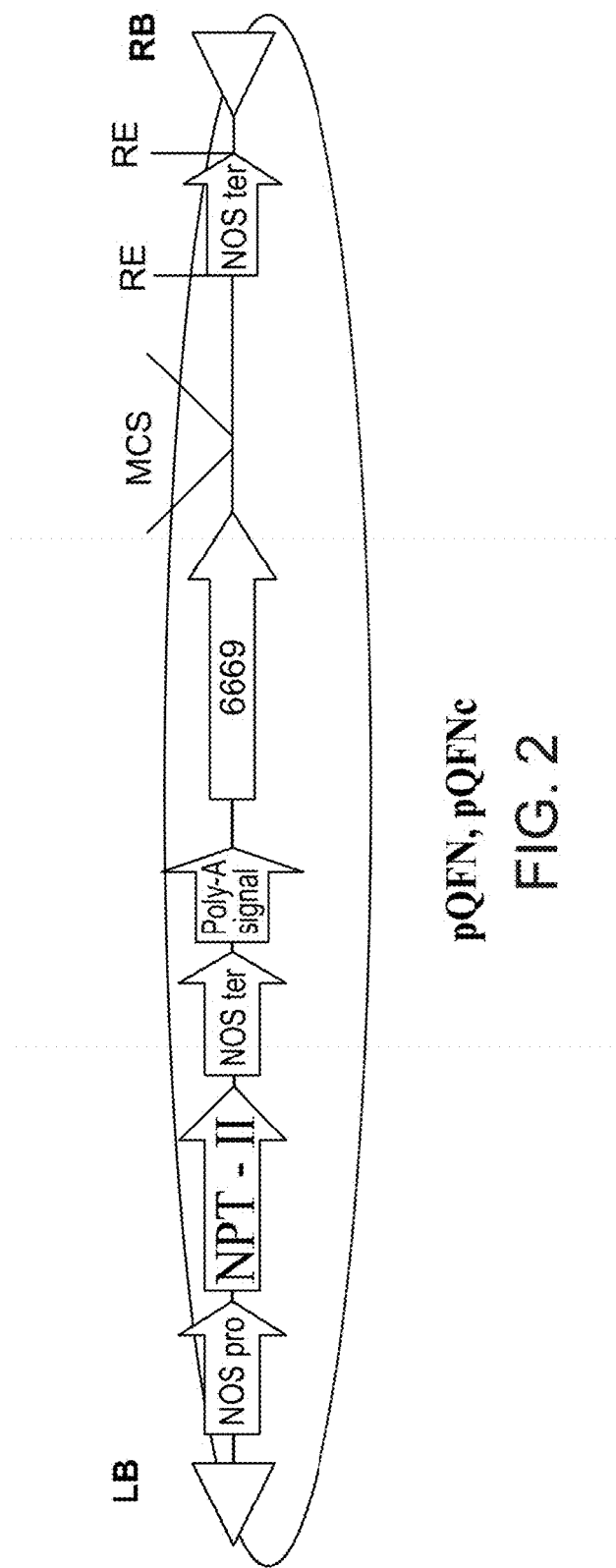
FIG. 2 is a schematic illustration of the modified pGI binary plasmid containing the new At6669 promoter (SEQ ID NO: 6918) (pQFN or pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); The isolated polynucleotide sequences of the invention were cloned into the MCS of the vector.

The present invention, in some embodiments thereof, relates to novel polynucleotides and polypeptides, nucleic acid constructs comprising same, host cells (e.g., plant cells) expressing same, transgenic plants exogenously expressing same and, more particularly, but not exclusively, to methods of using same for increasing nitrogen use efficiency, fertilizer use efficiency, yield, growth rate, vigor, biomass, oil content, fiber yield, fiber quality, fiber length, photosynthetic capacity, abiotic stress tolerance and/or water use efficiency of a plant such as a wheat plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to generate nucleic acid constructs, transgenic plants and to increase nitrogen use efficiency, fertilizer use efficiency, yield, growth rate, vigor, biomass, oil content, fiber yield, fiber quality, fiber length, abiotic stress tolerance and/or water use efficiency of a plant, such as a wheat plant.

Thus, as shown in the Examples section which follows, the present inventors have utilized bioinformatics tools to identify polynucleotides which enhance yield (e.g., seed yield, oil yield, oil content), growth rate, biomass, vigor, fiber yield, fiber quality, fiber length, photosynthetic capacity, nitrogen use efficiency, fertilizer use efficiency and/or abiotic stress tolerance of a plant. Genes which affect the trait-of-interest were identified (SEQ ID NOs: 202-327 for polypeptides; and SEQ ID NOs: 1-201 for polynucleotides) based on expression profiles of genes of several *Arabidopsis*, Barley, *Sorghum*, Maize, *Brachypodium*, Foxtail Millet and Wheat ecotypes and accessions in various tissues and growth conditions, homology with genes known to affect the trait-of-interest and using digital expression profile in specific tissues and conditions (Tables 1 and 3-74, Examples 1 and 3-13 of the Examples section which follows). Homologous (e.g., orthologous) polypeptides and polynucleotides having the same function were also identified (SEQ ID NOs: 4064-6893 for polypeptides, and SEQ ID NOs: 328-4062 for polynucleotides; Table 2, Example 2 of the Examples section which follows). The polynucleotides of some embodiments of the invention were cloned into binary vectors (Example 14, Table 75), and were further transformed into *Arabidopsis* and *Brachypodium* plants (Examples 15-17). Transgenic plants over-expressing the identified polynucleotides were found to exhibit increased biomass, growth rate, yield under normal conditions and under nitrogen limiting conditions, thus demonstrating increased nitrogen use efficiency of a plant (Tables 76-105; Examples 18-22 of the Examples section which follows), and increased tolerance to abiotic stress conditions (e.g., nutrient deficiency) as compared to control plants grown under the same growth conditions. Altogether, these results suggest the use of the novel polynucleotides and polypeptides of the invention [e.g., SEQ ID NOs: 202-327 and 4064-6893 (polypeptides) and SEQ ID NOs: 1-201 and 328-4062 (polynucleotides)] for increasing nitrogen use efficiency, fertilizer use efficiency, water use efficiency, abiotic stress tolerance, yield (e.g., oil yield, seed yield and oil content), growth rate, biomass, vigor, fiber yield, fiber quality, fiber length, and/or photosynthetic capacity of a plant.

Thus, according to an aspect of some embodiments of the invention, there is provided method of increasing fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, and 6792-6893, thereby increasing the fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in cm² per day or cm/day).

As used herein the phrase "photosynthetic capacity" (also known as "$A_{max}$") is a measure of the maximum rate at which leaves are able to fix carbon during photosynthesis. It is typically measured as the amount of carbon dioxide that is fixed per square meter per second, for example as $\mu mol\ m^{-2}\ sec^{-1}$. Plants are able to increase their photosynthetic capacity by several modes of action, such as by increasing the total leaves area (e.g., by increase of leaves area, increase in the number of leaves, and increase in plant's vigor, e.g., the ability of the plant to grow new leaves along time course) as well as by increasing the ability of the plant to efficiently execute carbon fixation in the leaves. Hence, the increase in total leaves area can be used as a reliable measurement parameter for photosynthetic capacity increment.

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (*Zea mays* L.) hybrids based on Corn Belt germplasm in the European Atlantic.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, osmotic stress, water deprivation, drought, flooding, freezing, low or high temperature, heavy metal toxicity, anaerobiosis, nutrient deficiency (e.g., nitrogen deficiency or limited nitrogen), atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, *Ceiba pentandra*), desert willow, creosote bush, winterfat, balsa, kenaf, rosette, jute, *sisal abaca*, flax, corn, sugar cane, hemp, ramie, kapok, coir, bamboo, spanish moss and *Agave* spp. (e.g. *sisal*).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow).

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance of a plant as compared to a native plant or a wild type plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant (e.g., a nucleic acid sequence from a different species) or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, and 6792-6893.

Homologous sequences include both orthologous and paralogous sequences. The term "paralogous" relates to gene-duplications within the genome of a species leading to paralogous genes. The term "orthologous" relates to homologous genes in different organisms due to ancestral relationship. Thus, orthologs are evolutionary counterparts derived from a single ancestral gene in the last common ancestor of given two species (Koonin E V and Gaiperin M Y (Sequence—Evolution—Function: Computational Approaches in Comparative Genomics. Boston: Kluwer Academic; 2003. Chapter 2, Evolutionary Concept in Genetics and Genomics. Available from: ncbi (dot) nlm (dot) nih (dot) gov/books/NBK20255) and therefore have great likelihood of having the same function.

One option to identify orthologues in monocot plant species is by performing a reciprocal blast search. This may be done by a first blast involving blasting the sequence-of-interest against any sequence database, such as the publicly available NCBI database which may be found at: ncbi (dot) nlm (dot) nih (dot) gov. If orthologues in rice were sought, the sequence-of-interest would be blasted against, for example, the 28,469 full-length cDNA clones from *Oryza sativa* Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [ebi (dot) ac (dot) uk/Tools/clustalw2/index (dot) html], followed by a neighbor-joining tree (wikipedia (dot) org/wiki/Neighbor-joining) which helps visualizing the clustering.

Homology (e.g., percent homology, sequence identity+ sequence similarity) can be determined using any homology comparison software computing a pairwise sequence alignment.

As used herein, "sequence identity" or "identity" in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are said to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff J G. [Amino acid substitution matrices from protein blocks. Proc. Natl. Acad. Sci. U.S.A. 1992, 89(22): 10915-9].

Identity (e.g., percent homology) can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., an homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from biocceleration (dot)com/Products(dot)html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from emboss (dot)sourceforge(dot)net/apps/cvs/emboss/apps/needle(dot) html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cut-off—60% Identity on a span of 60% of the sequences lengths because it is used only as a filter for the global alignment stage. In this specific embodiment (when the local identity is used), the default filtering of the Blast package is not utilized (by setting the parameter "-F F").

In the second stage, homologs are defined based on a global identity of at least 80% to the core gene polypeptide sequence.

According to some embodiments of the invention, two distinct forms for finding the optimal global alignment for protein or nucleotide sequences are used:

I. Between Two Proteins (Following the Blastp Filter):
EMBOSS-6.0.1 Needleman-Wunsch algorithm with the following modified parameters: gapopen=8 gapextend=2. The rest of the parameters are unchanged from the default options listed here:

Standard (Mandatory) Qualifiers:
[-asequence] sequence Sequence filename and optional format, or reference (input USA)
[-bsequence] seqall Sequence(s) filename and optional format, or reference (input USA)
-gapopen float [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0)
-gapextend float [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0)
[-outfile] align [*.needle] Output alignment file name
Additional (Optional) Qualifiers:
-datafile matrixf [EBLOSUM62 for protein, EDNAFULL for DNA]. This is the scoring matrix file used when comparing sequences. By default it is the file 'EBLOSUM62' (for proteins) or the file 'EDNAFULL' (for nucleic sequences). These files are found in the 'data' directory of the EMBOSS installation.
Advanced (Unprompted) Qualifiers:
-[no] brief boolean [Y] Brief identity and similarity
Associated Qualifiers:
"-asequence" Associated Qualifiers
-sbegin1 integer Start of the sequence to be used
-send1 integer End of the sequence to be used
-sreverse1 boolean Reverse (if DNA)
-sask1 boolean Ask for begin/end/reverse
-snucleotide1 boolean Sequence is nucleotide
-sprotein1 boolean Sequence is protein
-slower1 boolean Make lower case
-supper1 boolean Make upper case
-sformat1 string Input sequence format
-sdbname1 string Database name
-sid1 string Entryname
-ufo1 string UFO features
-fformat1 string Features format
-fopenfile1 string Features file name
"-bsequence" Associated Qualifiers
-sbegin2 integer Start of each sequence to be used
-send2 integer End of each sequence to be used
-sreverse2 boolean Reverse (if DNA)
-sask2 boolean Ask for begin/end/reverse
-snucleotide2 boolean Sequence is nucleotide
-sprotein2 boolean Sequence is protein
-slower2 boolean Make lower case
-supper2 boolean Make upper case
-sformat2 string Input sequence format
-sdbname2 string Database name
-sid2 string Entryname
-ufo2 string UFO features
-fformat2 string Features format
-fopenfile2 string Features file name
"-outfile" Associated Qualifiers
-aformat3 string Alignment format
-aextension3 string File name extension
-adirectory3 string Output directory
-aname3 string Base file name
-awidth3 integer Alignment width
-aaccshow3 boolean Show accession number in the header
-adesshow3 boolean Show description in the header
-ausashow3 boolean Show the full USA in the alignment
-aglobal3 boolean Show the full sequence in alignment
General Qualifiers:
-auto boolean Turn off prompts
-stdout boolean Write first file to standard output
-filter boolean Read first file from standard input, write first file to standard output
-options boolean Prompt for standard and additional values
-debug boolean Write debug output to program.dbg
-verbose boolean Report some/full command line options -help boolean Report command line options. More information on associated and general qualifiers can be found with -help -verbose
-warning boolean Report warnings
-error boolean Report errors
-fatal boolean Report fatal errors
-die boolean Report dying program messages 2. Between a Protein Sequence and a Nucleotide Sequence (Following the tblastn Filter):

GenCore 6.0 OneModel application utilizing the Frame+ algorithm with the following parameters: model=frame+_p2n.model mode=qglobal-q=protein.sequence -db=nucleotide.sequence. The rest of the parameters are unchanged from the default options:

Usage:
om -model=<model_fname>[-q=]query [-db=]database [options]-model=<model_fname> Specifies the model that you want to run. All models supplied by Compugen are located in the directory $CGNROOT/models/.

Valid command line parameters:
-dev=<dev_name> Selects the device to be used by the application.
Valid devices are:
  bic—Bioccelerator (valid for SW, XSW, FRAME_N2P, and FRAME_P2N models).
  xlg—BioXL/G (valid for all models except XSW).
  xlp—BioXL/P (valid for SW, FRAME+_N2P, and FRAME_P2N models).
  xlh—BioXL/H (valid for SW, FRAME+_N2P, and FRAME_P2N models).
  soft—Software device (for all models).
-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.
-db=<database name> Chooses the database set. The database set can be a sequence file or a database reference. The database format is detected automatically. However, you may specify a format using -dfmt parameter.
-qacc Add this parameter to the command line if you specify query using accession numbers.
-dacc Add this parameter to the command line if you specify a database using accession numbers.
-dfmt/-qfmt=<format_type> Chooses the database/query format type. Possible formats are:
  fasta—fasta with seq type auto-detected.
  fastap—fasta protein seq.
  fastan—fasta nucleic seq.
  gcg—gcg format, type is auto-detected.
  gcg9seq—gcg9 format, type is auto-detected.
  gcg9seqp—gcg9 format protein seq.
  gcg9seqn—gcg9 format nucleic seq.
  nbrf—nbrf seq, type is auto-detected.
  nbrfp—nbrf protein seq.
  nbrfn—nbrf nucleic seq.
  embl—embl and swissprot format.
  genbank—genbank format (nucleic).
  blast—blast format.
  nbrf_gcg—nbrf-gcg seq, type is auto-detected.
  nbrf_gcgp—nbrf-gcg protein seq.
  nbrf_gcgn—nbrf-gcg nucleic seq.
  raw—raw ascii sequence, type is auto-detected.
  rawp—raw ascii protein sequence.
  rawn—raw ascii nucleic sequence.
  pir—pir codata format, type is auto-detected.
  profile—gcg profile (valid only for -qfmt in SW, XSW, FRAME_P2N, and FRAME+_P2N).
-out=<out_fname> The name of the output file.
-suffix=<name> The output file name suffix.
-gapop=<n> Gap open penalty. This parameter is not valid for FRAME+. For FrameSearch the default is 12.0. For other searches the default is 10.0.
-gapext=<n> Gap extend penalty. This parameter is not valid for FRAME+. For FrameSearch the default is 4.0. For other models: the default for protein searches is 0.05, and the default for nucleic searches is 1.0.
-qgapop=<n> The penalty for opening a gap in the query sequence. The default is 10.0. Valid for XSW.
-qgapext=<n> The penalty for extending a gap in the query sequence. The default is 0.05. Valid for XSW.
-start=<n> The position in the query sequence to begin the search.
-end=<n> The position in the query sequence to stop the search.
-qtrans Performs a translated search, relevant for a nucleic query against a protein database. The nucleic query is translated to six reading frames and a result is given for each frame.
  Valid for SW and XSW.
-dtrans Performs a translated search, relevant for a protein query against a DNA database. Each database entry is translated to six reading frames and a result is given for each frame.
  Valid for SW and XSW.
Note: "-qtrans" and "-dtrans" options are mutually exclusive.
-matrix=<matrix_file> Specifies the comparison matrix to be used in the search. The matrix must be in the BLAST format. If the matrix file is not located in $CGNROOT/tables/matrix, specify the full path as the value of the -matrix parameter.
-trans=<transtab_name> Translation table. The default location for the table is $CGNROOT/tables/trans.
-onestrand Restricts the search to just the top strand of the query/database nucleic sequence.
-list=<n> The maximum size of the output hit list. The default is 50.
-docalign=<n> The number of documentation lines preceding each alignment. The default is 10.
-thr_score=<score_name> The score that places limits on the display of results. Scores that are smaller than -thr_min value or larger than -thr_max value are not shown. Valid options are: quality.
  zscore.
  escore.
-thr_max=<n> The score upper threshold. Results that are larger than -thr_max value are not shown.
-thr_min=<n> The score lower threshold. Results that are lower than -thr_min value are not shown.
-align=<n> The number of alignments reported in the output file.
-noalign Do not display alignment.
Note: "-align" and "-noalign" parameters are mutually exclusive.
-outfmt=<format_name> Specifies the output format type. The default format is PFS.
Possible values are:
  PFS—PFS text format
  FASTA—FASTA text format
  BLAST—BLAST text format
-nonorm Do not perform score normalization.
-norm=<norm_name> Specifies the normalization method.

Valid options are:
- log—logarithm normalization.
- std—standard normalization.
- stat—Pearson statistical method.

Note: "-nonorm" and "-norm" parameters cannot be used together.

Note: Parameters -xgapop, -xgapext, -fgapop, -fgapext, -ygapop, -ygapext, -delop, and -delext apply only to FRAME+.

-xgapop=<n> The penalty for opening a gap when inserting a codon (triplet). The default is 12.0.

-xgapext=<n> The penalty for extending a gap when inserting a codon (triplet). The default is 4.0.

-ygapop=<n> The penalty for opening a gap when deleting an amino acid. The default is 12.0.

-ygapext=<n> The penalty for extending a gap when deleting an amino acid. The default is 4.0.

-fgapop=<n> The penalty for opening a gap when inserting a DNA base. The default is 6.0.

-fgapext=<n> The penalty for extending a gap when inserting a DNA base. The default is 7.0.

-delop=<n> The penalty for opening a gap when deleting a DNA base. The default is 6.0.

-delext=<n> The penalty for extending a gap when deleting a DNA base. The default is 7.0.

-silent No screen output is produced.

-host=<host_name> The name of the host on which the server runs. By default, the application uses the host specified in the file $CGNROOT/cgnhosts.

-wait Do not go to the background when the device is busy. This option is not relevant for the Parseq or Soft pseudo device.

-batch Run the job in the background. When this option is specified, the file "$CGNROOT/defaults/batch.defaults" is used for choosing the batch command. If this file does not exist, the command "at now" is used to run the job.

Note:"-batch" and "-wait" parameters are mutually exclusive.

-version Prints the software version number.

-help Displays this help message. To get more specific help type:

"om -model=<model_fname>-help".

According to some embodiments the homology is a local homology or a local identity.

Local alignments tools include, but are not limited to the BlastP, BlastN, BlastX or TBLASTN software of the National Center of Biotechnology Information (NCBI), FASTA, and the Smith-Waterman algorithm.

A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.

Default parameters for blastp include: Max target sequences: 100; Expected threshold: $e^{-5}$; Word size: 3; Max matches in a query range: 0; Scoring parameters: Matrix—BLOSUM62; filters and masking: Filter—low complexity regions.

Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, and 6792-6893.

According to some embodiments of the invention, the exogenous polynucleotide of the invention encodes a polypeptide having the amino acid sequence selected from the group consisting of SEQ ID NOs: 202-327 and 4064-6893.

According to some embodiments of the invention, the method of increasing fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, and 6792-6893, thereby increasing the fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance of the plant.

According to some embodiments of the invention, the exogenous polynucleotide encodes a polypeptide consisting of the amino acid sequence set forth by SEQ ID NO: 202-327, 4064-6892 or 6893.

According to an aspect of some embodiments of the invention, the method of increasing fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance of a plant, is effected by expressing within the plant an exogenous polynucleotide comprising a nucleic acid sequence encoding a polypeptide comprising an amino acid sequence selected from the group consisting of SEQ ID NOs: 202-327 and 4064-6893, thereby increasing the fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance of the plant.

According to an aspect of some embodiments of the invention, there is provided a method of increasing fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance of a plant, comprising expressing within the plant an exogenous polynucleotide comprising a nucleic acid sequence encoding a polypeptide selected from the group consisting of SEQ ID NOs: 202-327 and 4064-6893, thereby increasing the fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance of the plant.

According to some embodiments of the invention, the exogenous polynucleotide encodes a polypeptide consisting of the amino acid sequence set forth by SEQ ID NO: 202-327, 4064-6892 or 6893.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-91, 94-201, 328-2317, 2320-2321, 2323, 2326-3835, 3838-3840, 3842-3843, 3848, 3850-3852, 3854, 3856-3953, and 3955-4062.

According to an aspect of some embodiments of the invention, there is provided a method of increasing fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-91, 94-201, 328-2317, 2320-2321, 2323, 2326-3835, 3838-3840, 3842-3843, 3848, 3850-3852, 3854, 3856-3953, and 3955-4062, thereby increasing the fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-91, 94-201, 328-2317, 2320-2321, 2323, 2326-3835, 3838-3840, 3842-3843, 3848, 3850-3852, 3854, 3856-3953, and 3955-4062.

According to some embodiments of the invention the exogenous polynucleotide is set forth by SEQ ID NO: 1-201, 328-4061 or 4062.

According to some embodiments of the invention the exogenous polynucleotide is set forth by the nucleic acid sequence selected from the group consisting of SEQ ID NOs: 1-201 and 328-4062.

According to some embodiments of the invention the method of increasing fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance of a plant further comprising selecting a plant having an increased nitrogen use efficiency, yield, growth rate, biomass, vigor, oil content, seed yield, fiber yield, fiber quality, fiber length, photosynthetic capacity, and/or abiotic stress tolerance as compared to the wild type plant of the same species which is grown under the same growth conditions.

It should be noted that selecting a transformed plant having an increased trait as compared to a native (or non-transformed) plant grown under the same growth conditions is performed by selecting for the trait, e.g., validating the ability of the transformed plant to exhibit the increased trait using well known assays (e.g., seedling analyses, greenhouse assays) as is further described herein below.

According to an aspect of some embodiments of the invention, there is provided a method of selecting a transformed plant having increased nitrogen use efficiency, yield, growth rate, biomass, vigor, oil content, seed yield, fiber yield, fiber quality, fiber length, photosynthetic capacity, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (e.g., having sequence similarity or sequence identity) to the amino acid sequence selected from the group consisting of SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, and 6792-6893, (b) selecting from the plants a plant having increased fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance, thereby selecting the plant having increased fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance as compared to the wild type plant of the same species which is grown under the same growth conditions.

According to some embodiments of the invention the amino acid sequence is selected from the group consisting of SEQ ID NOs: 202-327 and 4064-6893.

According to an aspect of some embodiments of the invention, there is provided a method of selecting a transformed plant having increased fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-91, 94-201, 328-2317, 2320-2321, 2323, 2326-3835, 3838-3840, 3842-3843, 3848, 3850-3852, 3854, 3856-3953, and 3955-4062, (b) selecting from the plants a plant having increased fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance (e.g., by selecting the plants for the increased trait), thereby selecting the plant having increased fertilizer use efficiency (e.g., nitrogen use efficiency), yield, growth rate, biomass, vigor, oil content, seed yield, fiber yield, fiber quality, fiber length, photosynthetic capacity, and/or abiotic stress tolerance as compared to the wild type plant of the same species which is grown under the same growth conditions.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 1929, 2601, 2900, 3004, 3937, and 4002.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

According to some embodiments of the invention, the exogenous polynucleotide encodes a polypeptide comprising an amino acid sequence at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NOs: 202-327 and 4064-6893.

According to some embodiments of the invention, the polypeptide comprising an amino acid sequence at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NOs: 202-327 and 4064-6893.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-91, 94-201, 328-2317, 2320-2321, 2323, 2326-3835, 3838-3840, 3842-3843, 3848, 3850-3852, 3854, 3856-3953, and 3955-4062.

According to some embodiments of the invention the nucleic acid sequence is capable of increasing fertilizer use efficiency (e.g., nitrogen use efficiency), yield, growth rate, biomass, vigor, oil content, seed yield, fiber yield, fiber quality, fiber length, photosynthetic capacity, abiotic stress tolerance and/or water use efficiency of a plant.

According to some embodiments of the invention the isolated polynucleotide comprising the nucleic acid sequence selected from the group consisting of SEQ ID NOs: 1-201 and 328-4062.

According to some embodiments of the invention the isolated polynucleotide is set forth by SEQ ID NO: 1-201, 328-4061 or 4062.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, and 6792-6893.

According to some embodiments of the invention the amino acid sequence is capable of increasing nitrogen use efficiency, fertilizer use efficiency, yield, growth rate, biomass, vigor, oil content, seed yield, fiber yield, fiber quality, fiber length, photosynthetic capacity, and/or abiotic stress tolerance of a plant.

The invention provides an isolated polynucleotide comprising a nucleic acid sequence encoding a polypeptide which comprises the amino acid sequence selected from the group consisting of SEQ ID NOs: 202-327 and 4064-6893.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, and 6792-6893.

According to some embodiments of the invention, the polypeptide comprising an amino acid sequence selected from the group consisting of SEQ ID NOs: 202-327 and 4064-6893.

According to some embodiments of the invention, the polypeptide is set forth by SEQ ID NO: 202-327, 4064-6892 or 6893.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses a whole plant, a grafted plant, ancestor(s) and progeny of the plants and plant parts, including seeds, shoots, stems, roots (including tubers), rootstock, scion, and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Dibeteropogon amplectens, Dioclea* spp, *Dolichos* spp., *Dorycnium rectum, Echinochloa pyramidalis, Ehraffia* spp., *Eleusine coracana, Eragrestis* spp., *Erythrina* spp., *Eucalypfus* spp., *Euclea schimperi, Eulalia vi/losa, Pagopyrum* spp., *Feijoa sellowlana, Fragaria* spp., *Flemingia* spp, *Freycinetia banksli, Geranium thunbergii, GinAgo biloba, Glycine javanica, Gliricidia* spp, *Gossypium hirsutum, Grevillea* spp., *Guibourtia coleosperma, Hedysarum* spp., *Hemaffhia altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria, Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of some embodiments of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable promoters for expression in wheat include, but are not limited to, Wheat SPA promoter (SEQ ID NO: 6894; Albanietal, Plant Cell, 9: 171-184, 1997, which is fully incorporated herein by reference), wheat LMW (SEQ ID NO: 6895 (longer LMW promoter), and SEQ ID NO: 6896 (LMW promoter) and HMW glutenin-1 (SEQ ID NO: 6897 (Wheat HMW glutenin-1 longer promoter); and SEQ ID NO: 6898 (Wheat HMW glutenin-1 Promoter); Thomas and Flavell, The Plant Cell 2:1171-1180; Furtado et al., 2009 Plant Biotechnology Journal 7:240-253, each of which is fully incorporated herein by reference), wheat alpha, beta and gamma gliadins [e.g., SEQ ID NO: 6899 (wheat alpha gliadin, B genome, promoter); SEQ ID NO: 6900 (wheat gamma gliadin promoter); EMBO 3:1409-15, 1984, which is fully incorporated herein by reference], wheat TdPR60 [SEQ ID NO:6901 (wheat TdPR60 longer promoter) or SEQ ID NO:6902 (wheat TdPR60 promoter); Kovalchuk et al., Plant Mol Biol 71:81-98, 2009, which is fully incorporated herein by reference], maize Ubl Promoter [cultivar Nongda 105 (SEQ ID NO:6903); GenBank: DQ141598.1; Taylor et al., Plant Cell Rep 1993 12: 491-495, which is fully incorporated herein by reference; and cultivar B73 (SEQ ID NO:6904); Christensen, A H, et al. Plant Mol. Biol. 18 (4), 675-689 (1992), which is fully incorporated herein by reference]; rice actin 1 (SEQ ID NO:6905; Mc Elroy et al. 1990, The Plant Cell, Vol. 2, 163-171, which is fully incorporated herein by reference), rice GOS2 [SEQ ID NO: 6906 (rice GOS2 longer promoter) and SEQ ID NO: 6907 (rice GOS2 Promoter); De Pater et al. Plant J. 1992; 2: 837-44, which is fully incorporated herein by reference], arabidopsis Phol [SEQ ID NO: 6908 (arabidopsis Phol Promoter); Hamburger et al., Plant Cell. 2002; 14: 889-902, which is fully incorporated herein by reference], ExpansinB promoters, e.g., rice ExpB5 [SEQ ID NO:6909 (rice ExpB5 longer promoter) and SEQ ID NO: 6910 (rice ExpB5 promoter)] and Barley ExpB1 [SEQ ID NO: 6911 (barley ExpB1 Promoter), Won et al. Mol Cells. 2010; 30:369-76, which is fully incorporated herein by reference], barley SS2 (sucrose synthase 2) [(SEQ ID NO: 6912), Guerin and Carbonero, *Plant Physiology* May 1997 vol. 114 no. 1 55-62, which is fully incorporated herein by reference], and rice PG5a [SEQ ID NO:6913, U.S. Pat. No. 7,700,835, Nakase et al., Plant Mol Biol. 32:621-30, 1996, each of which is fully incorporated herein by reference].

Suitable constitutive promoters include, for example, CaMV 35S promoter [SEQ ID NO: 6914 (CaMV 35S (QFNC) Promoter); SEQ ID NO: 6915 (PJJ 35S from *Brachypodium*); SEQ ID NO: 6916 (CaMV 35S (OLD) Promoter) (Odell et al., Nature 313:810-812, 1985); 35S (pEBbVNi Promoter; SEQ ID NO: 6930)], *Arabidopsis* At6669 promoter (SEQ ID NO: 6917 (*Arabidopsis* At6669 (OLD) Promoter); see PCT Publication No. WO04081173A2 or the new At6669 promoter (SEQ ID NO: 6918 (*Arabidopsis* At6669 (NEW) Promoter)); maize Ubl Promoter [cultivar Nongda 105 (SEQ ID NO:6903); GenBank: DQ141598.1; Taylor et al., Plant Cell Rep 1993 12: 491-495, which is fully incorporated herein by reference; and cultivar B73 (SEQ ID NO:6904); Christensen, A H, et al. Plant Mol. Biol. 18 (4), 675-689 (1992), which is fully incorporated herein by reference]; rice actin 1 (SEQ ID NO: 6905, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); rice GOS2 [SEQ ID NO: 6906 (rice GOS2 longer Promoter) and SEQ ID NO: 6907 (rice GOS2 Promoter), de Pater et al, Plant J November; 2(6):837-44, 1992]; RBCS promoter (SEQ ID NO:6919); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608, 149; 5,608,144; 5,604,121; 5,569,597: 5,466,785; 5,399, 680; 5,268,463; and 5,608,142.

Suitable tissue-specific promoters include, but not limited to, leaf-specific promoters [e.g., AT5G06690 (Thioredoxin) (high expression, SEQ ID NO: 6920), AT5G61520 (At-STP3) (low expression, SEQ ID NO: 6921) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO: 6922 (*Brassica napus* NAPIN Promoter) from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (SEQ ID NO: 6913; U.S. Pat. No. 7,700, 835), early seed development *Arabidopsis* BAN (AT1G61720) (SEQ ID NO: 6923, US 2009/0031450 A1), late seed development *Arabidopsis* ABI3 (AT3G24650) (SEQ ID NO: 6924 (*Arabidopsis* ABI3 (AT3G24650) longer Promoter) or 6925 (*Arabidopsis* ABI3 (AT3G24650) Promoter)) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143).323-32 1990), napA (Stalberg, et al, Planta 199: 515-519, 1996), Wheat SPA (SEQ ID NO:6894; Albanietal, Plant Cell, 9: 171-184, 1997), sunflower oleosin (Cummins, et al., Plant Mol. Biol. 19: 873-876, 1992)], endosperm specific promoters [e.g., wheat LMW (SEQ ID NO: 6895 (Wheat LMW Longer Promoter), and SEQ ID NO: 6896 (Wheat LMW Promoter) and HMW glutenin-1 [(SEQ ID NO: 6897 (Wheat HMW glutenin-1 longer Promoter)); and SEQ ID NO: 6898 (Wheat HMW glutenin-1 Promoter), Thomas and Flavell, The Plant Cell 2:1171-1180, 1990; Mol Gen Genet 216:81-90, 1989; NAR 17:461-2), wheat alpha, beta and gamma gliadins (SEQ ID NO: 6899 (wheat alpha gliadin (B genome) promoter); SEQ ID NO: 6900 (wheat gamma gliadin promoter); EMBO 3:1409-15, 1984), Barley ltrl promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Barley SS2 (SEQ ID NO: 6912 (Barley SS2 Promoter); Guerin and Carbonero Plant Physiology 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice -globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorghum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217: 240-245; 1989), *Arabidopsis* apetala-3 (Tilly et al., Development. 125:1647-57, 1998), *Arabidopsis* APETALA 1 (AT1G69120, AP1) (SEQ ID NO: 6926 (*Arabidopsis* (AT1G69120) APETALA 1)) (Hempel et al., Development 124:3845-3853, 1997)], and root promoters [e.g., the ROOTP promoter [SEQ ID NO: 6927]; rice ExpB5 (SEQ ID NO: 6910 (rice ExpB5 Promoter); or SEQ ID NO: 6909 (rice ExpB5 longer Promoter)) and barley ExpB1 promoters (SEQ ID NO:6911) (Won et al. Mol. Cells 30: 369-376, 2010); *arabidopsis* ATTPS-CIN (AT3G25820) promoter (SEQ ID NO: 6928; Chen et al., Plant Phys 135:1956-66, 2004); *arabidopsis* Pho1 promoter (SEQ ID NO: 6908, Hamburger et al., Plant Cell. 14: 889-902, 2002), which is also slightly induced by stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced from the seedlings to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Taylor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein. Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

According to some embodiments, there is provided a method of improving nitrogen use efficiency, yield, growth rate, biomass, vigor, oil content, seed yield, fiber yield, fiber quality, fiber length, photosynthetic capacity, and/or abiotic stress tolerance of a grafted plant, the method comprising providing a scion that does not transgenically express a polynucleotide encoding a polypeptide at least 80% homologous to the amino acid sequence selected from the group consisting of SEQ ID NOs: 202-327 and 4064-6893 and a plant rootstock that transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, 6792-6892 or 6893 (e.g., in a constitutive or an abiotic stress responsive manner), thereby improving the nitrogen use efficiency, yield, growth rate, biomass, vigor, oil content, seed yield, fiber yield, fiber quality, fiber length, photosynthetic capacity, and/or abiotic stress tolerance of the grafted plant.

In some embodiments, the plant scion is non-transgenic.

Several embodiments relate to a grafted plant exhibiting improved nitrogen use efficiency, yield, growth rate, biomass, vigor, oil content, seed yield, fiber yield, fiber quality, fiber length, photosynthetic capacity, and/or abiotic stress tolerance, comprising a scion that does not transgenically express a polynucleotide encoding a polypeptide at least about 80% homologous (or identical) to the amino acid sequence selected from the group consisting of SEQ ID NOs: 202-327 and 4064-6893 and a plant rootstock that transgenically expresses a polynucleotide encoding a polypeptide at at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, and 6792-6893.

In some embodiments, the plant root stock transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, and 6792-6893 in a stress responsive manner.

According to some embodiments of the invention, the plant root stock transgenically expresses a polynucleotide encoding a polypeptide selected from the group consisting of SEQ ID NOs: 202-327 and 4064-6893.

According to some embodiments of the invention, the plant root stock transgenically expresses a polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-91, 94-201, 328-2317, 2320-2321, 2323, 2326-3835, 3838-3840, 3842-3843, 3848, 3850-3852, 3854, 3856-3953, and 3955-4062.

According to some embodiments of the invention, the plant root stock transgenically expresses a polynucleotide selected from the group consisting of SEQ ID NOs: 1-201 and 328-4062.

Since processes which increase nitrogen use efficiency, fertilizer use efficiency, oil content, yield, seed yield, fiber yield, fiber quality, fiber length, photosynthetic capacity, growth rate, biomass, vigor and/or abiotic stress tolerance of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on oil content, yield, seed yield, fiber yield, fiber quality, fiber length, photosynthetic capacity, growth rate, biomass, vigor and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, osmotic stress, drought, water deprivation, excess of water (e.g., flood, waterlogging), etiolation, low temperature (e.g., cold stress), high temperature, heavy metal toxicity, anaerobiosis, nutrient deficiency (e.g., nitrogen deficiency or nitrogen limitation), nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct of some embodiments of the invention; and (b) evaluating a trait of a plant as compared to a wild type plant of the same type (e.g., a plant not transformed with the claimed biomolecules); thereby evaluating the trait of the plant.

According to an aspect of some embodiments of the invention there is provided a method of producing a crop comprising growing a crop of a plant expressing an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, and 6792-6893, wherein said plant is derived from a plant selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide encoding a polypeptide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, and 6792-6893, wherein the crop plant is derived from plants selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency), thereby producing the crop.

According to some embodiments of the invention the polypeptide is selected from the group consisting of SEQ ID NOs: 202-327 and 4064-6893.

According to an aspect of some embodiments of the invention there is provided a method of producing a crop comprising growing a crop of a plant expressing an exogenous polynucleotide which comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-91, 94-201, 328-2317, 2320-2321, 2323, 2326-3835, 3838-3840, 3842-3843, 3848, 3850-3852, 3854, 3856-3953, and 3955-4062, wherein said plant is derived from a plant (parent plant) that has been transformed to express the exogenous polynucleotide and that has been selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the nucleic acid sequence selected from the group consisting of SEQ ID NOs: 1-91, 94-201, 328-2317, 2320-2321, 2323, 2326-3835, 3838-3840, 3842-3843, 3848, 3850-3852, 3854, 3856-3953, and 3955-4062, wherein the crop plant is derived from plants selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency), thereby producing the crop.

According to some embodiments of the invention the exogenous polynucleotide is selected from the group consisting of SEQ ID NOs: 1-201 and 328-4062.

According to an aspect of some embodiments of the invention there is provided a method of growing a crop comprising seeding seeds and/or planting plantlets of a plant transformed with the exogenous polynucleotide of the invention, e.g., the polynucleotide which encodes the polypeptide of some embodiments of the invention, wherein the plant is derived from plants selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant.

According to some embodiments of the invention the method of growing a crop comprising seeding seeds and/or planting plantlets of a plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 202-219, 221-292, 295-327, 4064-4175, 4177-4210, 4212-4580, 4582-4603, 4605-4749, 4751-4778, 4780-5223, 5225-5493, 5522-5807, 5812, 5815-5816, 5828-6679, 6689-6690, 6708-6785, 6792-6892 or 6893, wherein the plant is derived from plants selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

According to some embodiments of the invention the polypeptide is selected from the group consisting of SEQ ID NOs: 202-327 and 4064-6893.

According to some embodiments of the invention the method of growing a crop comprising seeding seeds and/or planting plantlets of a plant transformed with an exogenous polynucleotide comprising the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 1-91, 94-201, 328-2317, 2320-2321, 2323, 2326-3835, 3838-3840, 3842-3843, 3848, 3850-3852, 3854, 3856-3953, 3955-4061 or 4062, wherein the plant is derived from plants selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

According to some embodiments of the invention the exogenous polynucleotide is selected from the group consisting of SEQ ID NOs: 1-201 and 328-4062.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control Arabidopsis plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water use efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

Formula I $$RWC=[(FW-DW)/(TW-DW)]\times 100$$

Fertilizer use efficiency—To analyze whether the transgenic plants are more responsive to fertilizers, plants are grown in agar plates or pots with a limited amount of fertilizer, as described, for example, in Examples 17-19 hereinbelow and in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in cm$^2$ per day of leaf area).

Relative growth area can be calculated using Formula II.

Formula II:

Relative growth rate area=Regression coefficient of area along time course

Thus, the relative growth area rate is in units of area units (e.g., mm$^2$/day or cm$^2$/day) and the relative length growth rate is in units of length units (e.g., cm/day or mm/day).

For example, RGR can be determined for plant height (Formula III), SPAD (Formula IV), Number of tillers (Formula V), root length (Formula VI), vegetative growth (Formula VII), leaf number (Formula VIII), rosette area (Formula IX), rosette diameter (Formula X), plot coverage (Formula XI), leaf blade area (Formula XII), and leaf area (Formula XIII).

Formula III:

Relative growth rate of Plant height=Regression coefficient of Plant height along time course (measured in cm/day).

Formula IV:

Relative growth rate of SPAD=Regression coefficient of SPAD measurements along time course.

Formula V:

Relative growth rate of Number of tillers=Regression coefficient of Number of tillers along time course (measured in units of "number of tillers/day").

Formula VI:

Relative growth rate of root length=Regression coefficient of root length along time course (measured in cm per day).

Vegetative Growth Rate Analysis—
was calculated according to Formula VII below.

Formula VII:

Relative growth rate of vegetative growth=Regression coefficient of vegetative weight along time course (measured in grams per day).

Formula VIII:

Relative growth rate of leaf number=Regression coefficient of leaf number along time course (measured in number per day).

Formula IX:

Relative growth rate of rosette area=Regression coefficient of rosette area along time course (measured in cm$^2$ per day).

Formula X:

Relative growth rate of rosette diameter=Regression coefficient of rosette diameter along time course (measured in cm per day).

Formula XI:

Relative growth rate of plot coverage=Regression coefficient of plot (measured in cm$^2$ per day).

Formula XII:

Relative growth rate of leaf blade area=Regression coefficient of leaf area along time course (measured in cm$^2$ per day).

Formula XIII:

Relative growth rate of leaf area=Regression coefficient of leaf area along time course (measured in cm$^2$ per day).

Formula XIV:

1000 Seed Weight=number of seed in sample/sample weight×1000

The Harvest Index can be calculated using Formulas XV, XVI, XVII, XVIII and XXXVII below.

Formula XV:

Harvest Index(seed)=Average seed yield per plant/ Average dry weight.

Formula XVI:

Harvest Index(*Sorghum*)=Average grain dry weight per Head/(Average vegetative dry weight per Head+Average Head dry weight)

Formula XVII:

Harvest Index (Maize)=Average grain weight per plant/to (Average vegetative dry weight per plant plus Average grain weight per plant)

Harvest Index (for barley)—The harvest index is calculated using Formula XVIII.

Formula XVIII:

Harvest Index(for barley and wheat)=Average spike dry weight per plant/(Average vegetative dry weight per plant+Average spike dry weight per plant)

Following is a non-limited list of additional parameters which can be detected in order to show the effect of the transgene on the desired plant's traits:

Formula XIX:

Grain circularity=4×3.14(grain area/perimeter$^2$)

Formula XX:

internode volume=3.14×(d/2)$^2$×1

Formula XXI:

Normalized ear weight per plant+vegetative dry weight.

Formula XXII:

Root/Shoot Ratio=total weight of the root at harvest/ total weight of the vegetative portion above ground at harvest. (=RBiH/BiH)

Formula XXIII:

Ratio of the number of pods per node on main stem at pod set=Total number of pods on main stem/ Total number of nodes on main stem.

Formula XXIV:

Ratio of total number of seeds in main stem to number of seeds on lateral branches=Total number of seeds on main stem at pod set/Total number of seeds on lateral branches at pod set.

Formula XXV:

Petiole Relative Area=(Petiole area)/Rosette area (measured in %).

Formula XXVI:

% reproductive tiller percentage=Number of Reproductive tillers/number of tillers)×100.

Formula XXVII:

Spikes Index=Average Spikes weight per plant/(Average vegetative dry weight per plant plus Average Spikes weight per plant).

Formula XXVIII:

Relative growth rate of root coverage=Regression coefficient of root coverage along time course.

Formula XXIX:

Seed Oil yield=Seed yield per plant(gr.)*Oil % in seed.

Formula XXX:

shoot/root Ratio=total weight of the vegetative portion above ground at harvest/total weight of the root at harvest.

Formula XXXI:

Spikelets Index=Average Spikelets weight per plant/(Average vegetative dry weight per plant plus Average Spikelets weight per plant).

Formula XXXII:

% Canopy coverage=(1−(PAR_DOWN/PAR_UP))×100.

Formula XXXIII:

leaf mass fraction=Leaf area/shoot $FW$.

Formula XXXIV:

Relative growth rate based on dry weight=Regression coefficient of dry weight along time course.

Formula XXXV:

Total dry matter(for Maize)=Normalized ear weight per plant+vegetative dry weight.

Formula XXXVI $$\text{Agronomical } NUE = \frac{\text{Yield per plant (Kg.)}^{X\ Nitrogen\ Fertilization} - \text{Yield per plant (Kg.)}^{0\%\ Nitrogen\ Fertilization}}{\text{Fertilizer}^{X}}$$

Formula XXXVII:

Harvest Index(*brachypodium*)=Average grain weight/average dry(vegetative+spikelet)weight per plant.

Formula XXXVIII:

Harvest Index for *Sorghum**(*when the plants were not dried)=$FW$(fresh weight)Heads/($FW$ Heads+$FW$ Plants)

Grain fill rate [mg/day]—Rate of dry matter accumulation in grain. The grain fill rate is calculated using Formula XXXIX Formula XXXIX:

Grain fill rate [mg/day]=[Grain weight*ear-1×1000]/[Grain number*ear-1]×Grain filling duration].

Grain protein concentration—Grain protein content (g grain protein m$^{-2}$) is estimated as the product of the mass of grain N (g grain N m$^{-2}$) multiplied by the N/protein conversion ratio of k-5.13 (Mosse 1990, supra). The grain protein concentration is estimated as the ratio of grain protein content per unit mass of the grain (g grain protein kg$^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (cottoninc (dot) com/ClassificationofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods. According to some embodiments of the invention, the oil comprises a seed oil.

According to some embodiments of the invention, the oil comprises a vegetative portion oil (oil of the vegetative portion of the plant).

According to some embodiments of the invention, the plant cell forms a part of a plant.

According to another embodiment of the present invention, there is provided a food or feed comprising the plants or a portion thereof of the present invention.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [invitrogen (dot) com/content (dot)cfm?pageid=469]. Approximately 30-50 mg of tissue was taken from samples. The weighed tissues were ground using pestle and mortar in liquid nitrogen and resuspended in 500 μl of TRIzol Reagent. To the homogenized lysate, 100 μl of chloroform was added followed by precipitation using isopropanol and two washes with 75% ethanol. The RNA was eluted in 30 μl of RNase-free water. RNA samples were cleaned up using Qiagen's RNeasy minikit clean-up protocol as per the manufacturer's protocol (QIAGEN Inc, CA USA). For convenience, each micro-array expression information tissue type has received an expression Set ID.

Correlation analysis—was performed for selected genes according to some embodiments of the invention, in which the characterized parameters (measured parameters according to the correlation IDs) were used as "x axis" for correlation with the tissue transcriptome which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved nitrogen use efficiency, abiotic stress tolerance, yield, growth rate and the like).

Example 1

Identifying Genes which Increase Nitrogen Use Efficiency (Nue), Fertilizer Use Efficiency (Fue), Yield, Growth Rate, Vigor, Biomass, Oil Content, Abiotic Stress Tolerance (Abst) and/or Water Use Efficiency (Wue) in Plants The present inventors have identified polynucleotides which upregulation of expression thereof in plants increases nitrogen use efficiency (NUE), fertilizer use efficiency (FUE), yield (e.g., seed yield, oil yield, grain quantity and/or quality), growth rate, vigor, biomass, oil content, fiber yield, fiber quality, fiber length, abiotic stress tolerance (ABST) and/or water use efficiency (WUE) of a plant.

All nucleotide sequence datasets used here were originated from publicly available databases or from performing sequencing using the Solexa technology (e.g. Barley and Sorghum). Sequence data from 100 different plant species was introduced into a single, comprehensive database. Other information on gene expression, protein annotation, enzymes and pathways were also incorporated. Major databases used include:

Genomes
*Arabidopsis* genome [TAIR genome version 6 (*arabidopsis* (dot) org/)]
Rice genome [IRGSP build 4.0 (rgp (dot) dna (dot) affrc (dot) go (dot) jp/IRGSP/)].
Poplar [*Populus trichocarpa* release 1.1 from JGI (assembly release v1.0) (genome (dot) jgi-psf (dot) org/)]
*Brachypodium* [JGI 4x assembly, brachpodium (dot) org)]
Soybean [DOE-JGI SCP, versions Glyma0 or Glyma1 (phytozome (dot) net/)]
Grape [French-Italian Public Consortium for Grapevine Genome Characterization grapevine genome (genoscope (dot) cns (dot) fr/)]
Castobean [TIGR/J Craig Venter Institute 4x assembly Rmsc (dot) jcvi (dot) org/r_communis]
*Sorghum* [DOE-JGI SCP, version Sbi1 [phytozome (dot) net/)].
Maize [maizesequence (dot) org/]
Cucumber [cucumber (dot) genomics (dot) org (dot) cn/page/cucumber/index (dot) jsp]
Tomato [solgenomics (dot) net/tomato/]
Cassava [phytozome (dot) net/cassava (dot) php]
Expressed EST and mRNA Sequences were Extracted from the Following Databases:
GenBank (ncbi (dot) nlm (dot) nih (dot) gov/Genbank/).
RefSeq (ncbi (dot) nlm (dot) nih (dot) gov/RefSeq/).
TAIR (*arabidopsis* (dot) org/).
Protein and Pathway Databases
Uniprot [uniprot (dot) org/].
AraCyc [*arabidopsis* (dot) org/biocyc/index (dot) jsp].
ENZYME [expasy (dot) org/enzyme/].
Microarray Datasets were Downloaded from:
GEO (ncbi (dot) nlm(dot) nih (dot) gov/geo/)
TAIR (*arabidopsis*(dot) org/).
Proprietary micro-array data (See WO2008/122980 and Examples 3-13 below).
QTL and SNPs Information
Gramene [gramene (dot) org/qtl/].
Panzea [panzea (dot) org/index (dot) html].
Soybean QTL: [soybeanbreederstoolbox(dot) com/].

Database Assembly—was performed to build a wide, rich, reliable annotated and easy to analyze database comprised of publicly available genomic mRNA, ESTs DNA sequences, data from various crops as well as gene expression, protein annotation and pathway, QTLs data, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (*arabidopsis*, rice, castorbean, grape, *brachypodium*, poplar, soybean, *sorghum*) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

Sequences blast search [blast (dot) ncbi (dot) nlm (dot) nih (dot) gov/Blast (dot) cgi] against all plant UniProt [uniprot (dot) org/] was performed. Open reading frames of each putative transcript were analyzed and longest ORF with higher number of homologues was selected as predicted protein of the transcript. The predicted proteins were analyzed by InterPro [ebi (dot) ac (dot) uk/interpro/].

Blast against proteins from AraCyc and ENZYME databases was used to map the predicted transcripts to AraCyc pathways.

Predicted proteins from different species were compared using blast algorithm [ncbi (dot) nlm (dot) nih (dot) gov/ Blast (dot) cgi] to validate the accuracy of the predicted protein sequence, and for efficient detection of orthologs.

Gene expression profiling—Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAIR and NCBI GEO sites, renormalized, and integrated into the database. Expression profiling is one of the most important resource data for identifying genes important for yield.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomeic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags (ESTs) that assembled into 67,477 unigenes (32,357 singletons and 35,120 contigs). Analysis of the data obtained against the Cucurbit Genomics Database [icugi (dot) org/] confirmed the accuracy of the sequencing and assembly. Expression patterns of selected genes fitted well their qRT-PCR data.

Overall, 95 genes were identified to have a major impact on nitrogen use efficiency, fertilizer use efficiency, yield (e.g., seed yield, oil yield, grain quantity and/or quality), growth rate, vigor, biomass, oil content, fiber yield, fiber quality, fiber length, abiotic stress tolerance and/or water use efficiency when expression thereof is increased in plants. The identified genes, their curated polynucleotide and polypeptide sequences, as well as their updated sequences according to GenBank database are summarized in Table 1, hereinbelow.

TABLE 1

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| WNU1 | foxtail_millet\|11v3\|PHY7SI037360M | foxtail_millet | 1 | 202 |
| WNU2 | sorghum\|12v1\|SB02G035890 | sorghum | 2 | 203 |
| WNU3 | sorghum\|12v1\|SB03G037360 | sorghum | 3 | 204 |
| WNU5 | arabidopsis\|10v1\|AT1G76520 | arabidopsis | 4 | 205 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| WNU6 | arabidopsis\|10v1\|AT2G41310 | arabidopsis | 5 | 206 |
| WNU7 | arabidopsis\|10v1\|AT5G64550 | arabidopsis | 6 | 207 |
| WNU8 | barley\|10v2\|AJ234434 | barley | 7 | 208 |
| WNU9 | barley\|10v2\|AJ467179 | barley | 8 | 209 |
| WNU10 | barley\|10v2\|AV835513 | barley | 9 | 210 |
| WNU11 | barley\|10v2\|BE195092 | barley | 10 | 211 |
| WNU12 | barley\|10v2\|BE216643 | barley | 11 | 212 |
| WNU13 | barley\|10v2\|BE412689 | barley | 12 | 213 |
| WNU14 | barley\|10v2\|BE412739 | barley | 13 | 214 |
| WNU15 | barley\|10v2\|BE413497 | barley | 14 | 215 |
| WNU16 | barley\|10v2\|BE413575 | barley | 15 | 216 |
| WNU17 | barley\|10v2\|BE420881 | barley | 16 | 217 |
| WNU18 | barley\|10v2\|BE421902 | barley | 17 | 218 |
| WNU19 | barley\|10v2\|BE438925 | barley | 18 | 219 |
| WNU20 | barley\|10v2\|BE455654 | barley | 19 | 220 |
| WNU21 | barley\|10v2\|BF260947 | barley | 20 | 221 |
| WNU22 | barley\|10v2\|BF263283 | barley | 21 | 222 |
| WNU23 | barley\|10v2\|BF617606 | barley | 22 | 223 |
| WNU25 | barley\|10v2\|BF623217 | barley | 23 | 224 |
| WNU26 | barley\|10v2\|BF623477 | barley | 24 | 225 |
| WNU27 | barley\|10v2\|BF626052 | barley | 25 | 226 |
| WNU28 | barley\|10v2\|BI778944 | barley | 26 | 227 |
| WNU29 | barley\|10v2\|BI947135 | barley | 27 | 228 |
| WNU30 | barley\|10v2\|BI947599 | barley | 28 | 229 |
| WNU31 | barley\|10v2\|BI950946 | barley | 29 | 230 |
| WNU32 | barley\|10v2\|BJ464604 | barley | 30 | 231 |
| WNU33 | barley\|10v2\|BQ458968 | barley | 31 | 232 |
| WNU34 | barley\|12v1\|AV835440 | barley | 32 | 233 |
| WNU35 | barley\|12v1\|BE196061 | barley | 33 | 234 |
| WNU36 | barley\|12v1\|BE412448 | barley | 34 | 235 |
| WNU37 | barley\|12v1\|BE455619 | barley | 35 | 236 |
| WNU38 | barley\|12v1\|BF257030 | barley | 36 | 237 |
| WNU39 | barley\|12v1\|BF260630 | barley | 37 | 238 |
| WNU40 | barley\|12v1\|BF622946 | barley | 38 | 239 |
| WNU41 | barley\|12v1\|BI957485 | barley | 39 | 240 |
| WNU42 | barley\|12v1\|BI958608 | barley | 40 | 241 |
| WNU43 | barley\|12v1\|BM370758 | barley | 41 | 242 |
| WNU44 | barley\|12v1\|BM376567 | barley | 42 | 243 |
| WNU45 | brachypodium\|12v1\|BRADI1G03390 | brachypodium | 43 | 244 |
| WNU46 | brachypodium\|12v1\|BRADI1G59650 | brachypodium | 44 | 245 |
| WNU47 | brachypodium\|12v1\|BRADI1G67410 | brachypodium | 45 | 246 |
| WNU49 | brachypodium\|12v1\|BRADI2G19790 | brachypodium | 46 | 247 |
| WNU50 | brachypodium\|12v1\|BRADI2G36910 | brachypodium | 47 | 248 |
| WNU51 | brachypodium\|12v1\|BRADI2G45450 | brachypodium | 48 | 249 |
| WNU52 | brachypodium\|12v1\|BRADI2G54400 | brachypodium | 49 | 250 |
| WNU53 | foxtail_millet\|11v3\|EC612057 | foxtail_millet | 50 | 251 |
| WNU54 | foxtail_millet\|11v3\|EC613339 | foxtail_millet | 51 | 252 |
| WNU55 | foxtail_millet\|11v3\|EC613521 | foxtail_millet | 52 | 253 |
| WNU56 | foxtail_millet\|11v3\|EC613638 | foxtail_millet | 53 | 254 |
| WNU57 | foxtail_millet\|11v3\|EC613764 | foxtail_millet | 54 | 255 |
| WNU58 | foxtail_millet\|11v3\|PHY7SI002694M | foxtail_millet | 55 | 256 |
| WNU60 | foxtail_millet\|11v3\|PHY7SI004807M | foxtail_millet | 56 | 257 |
| WNU61 | foxtail_millet\|11v3\|PHY7SI006776M | foxtail_millet | 57 | 258 |
| WNU63 | foxtail_millet\|11v3\|PHY7SI010781M | foxtail_millet | 58 | 259 |
| WNU65 | foxtail_millet\|11v3\|PHY7SI011960M | foxtail_millet | 59 | 260 |
| WNU66 | foxtail_millet\|11v3\|PHY7SI016756M | foxtail_millet | 60 | 261 |
| WNU67 | foxtail_millet\|11v3\|PHY7SI016983M | foxtail_millet | 61 | 262 |
| WNU68 | foxtail_millet\|11v3\|PHY7SI018426M | foxtail_millet | 62 | 263 |
| WNU69 | foxtail_millet\|11v3\|PHY7SI020976M | foxtail_millet | 63 | 264 |
| WNU70 | foxtail_millet\|11v3\|PHY7SI021004M | foxtail_millet | 64 | 265 |
| WNU71 | foxtail_millet\|11v3\|PHY7SI029993M | foxtail_millet | 65 | 266 |
| WNU72 | foxtail_millet\|11v3\|PHY7SI035252M | foxtail_millet | 66 | 267 |
| WNU73 | foxtail_millet\|11v3\|PHY7SI035778M | foxtail_millet | 67 | 268 |
| WNU74 | foxtail_millet\|11v3\|PHY7SI036478M | foxtail_millet | 68 | 269 |
| WNU75 | maize\|10v1\|AI629766 | maize | 69 | 270 |
| WNU76 | maize\|10v1\|AI947957 | maize | 70 | 271 |
| WNU77 | maize\|10v1\|AI948358 | maize | 71 | 272 |
| WNU78 | maize\|10v1\|AI966985 | maize | 72 | 273 |
| WNU80 | maize\|10v1\|AW053253 | maize | 73 | 274 |
| WNU81 | maize\|10v1\|AW225099 | maize | 74 | 275 |
| WNU82 | maize\|10v1\|BI643478 | maize | 75 | 276 |
| WNU83 | maize\|10v1\|BM379051 | maize | 76 | 277 |
| WNU85 | rice\|11v1\|BI804924 | rice | 77 | 278 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| WNU87 | rice\|11v1\|OSU77294 | rice | 78 | 279 |
| WNU90 | sorghum\|12v1\|EVOER2582 | sorghum | 79 | 280 |
| WNU91 | sorghum\|12v1\|SB01G005000 | sorghum | 80 | 281 |
| WNU92 | sorghum\|12v1\|SB01G028940 | sorghum | 81 | 282 |
| WNU93 | sorghum\|12v1\|SB03G008180 | sorghum | 82 | 283 |
| WNU94 | sorghum\|12v1\|SB03G034010 | sorghum | 83 | 284 |
| WNU96 | sorghum\|12v1\|SB04G004680 | sorghum | 84 | 285 |
| WNU97 | sorghum\|12v1\|SB04G009980 | sorghum | 85 | 286 |
| WNU98 | sorghum\|12v1\|SB04G026160 | sorghum | 86 | 287 |
| WNU99 | sorghum\|12v1\|SB09G000320 | sorghum | 87 | 288 |
| WNU100 | sorghum\|12v1\|SB09G018070P1 | sorghum | 88 | 289 |
| WNU101 | sorghum\|12v1\|SB10G007680 | sorghum | 89 | 290 |
| WNU102 | wheat\|10v2\|BE415420 | wheat | 90 | 291 |
| WNU103 | wheat\|12v1\|BM140581 | wheat | 91 | 292 |
| WNU104 | maize\|10v1\|AW308714 | maize | 92 | 293 |
| WNU105 | sorghum\|12v1\|SB02G031390 | sorghum | 93 | 294 |
| WNU103_H11 | rice\|11v1\|AA749605 | rice | 94 | 295 |
| WNU22_H1 | wheat\|12v3\|BE585479 | wheat | 95 | 296 |
| WNU1 | foxtail_millet\|11v3\|PHY7SI037360M | foxtail_millet | 96 | 297 |
| WNU10 | barley\|10v2\|AV835513 | barley | 97 | 298 |
| WNU12 | barley\|10v2\|BE216643 | barley | 98 | 299 |
| WNU22 | barley\|10v2\|BF263283 | barley | 99 | 300 |
| WNU36 | barley\|12v1\|BE412448 | barley | 100 | 301 |
| WNU41 | barley\|12v1\|BI957485 | barley | 101 | 302 |
| WNU42 | barley\|12v1\|BI958608 | barley | 102 | 241 |
| WNU45 | brachypodium\|12v1\|BRADI1G03390 | brachypodium | 103 | 244 |
| WNU51 | brachypodium\|12v1\|BRADI2G45450 | brachypodium | 104 | 249 |
| WNU60 | foxtail_millet\|11v3\|PHY7SI004807M | foxtail millet | 105 | 257 |
| WNU61 | foxtail_millet\|11v3\|PHY7SI006776M | foxtail millet | 106 | 303 |
| WNU65 | foxtail_millet\|11v3\|PHY7SI011960M | foxtail millet | 107 | 260 |
| WNU67 | foxtail_millet\|11v3\|PHY7SI016983M | foxtail millet | 108 | 262 |
| WNU90 | sorghum\|12v1\|EVOER2582 | sorghum | 109 | 304 |
| WNU103_H11 | rice\|11v1\|AA749605 | rice | 110 | 295 |
| WNU22_H1 | wheat\|12v3\|BE585479 | wheat | 111 | 296 |
| WNU1 | foxtail_millet\|11v3\|PHY7SI037360M | foxtail millet | 112 | 202 |
| WNU2 | sorghum\|12v1\|SB02G035890 | sorghum | 113 | 203 |
| WNU3 | sorghum\|12v1\|SB03G037360 | sorghum | 114 | 204 |
| WNU5 | arabidopsis\|10v1\|AT1G76520 | arabidopsis | 115 | 205 |
| WNU6 | arabidopsis\|10v1\|AT2G41310 | arabidopsis | 116 | 206 |
| WNU7 | arabidopsis\|10v1\|AT5G64550 | arabidopsis | 117 | 207 |
| WNU8 | barley\|10v2\|AJ234434 | barley | 118 | 208 |
| WNU9 | barley\|10v2\|AJ467179 | barley | 119 | 209 |
| WNU11 | barley\|10v2\|BE195092 | barley | 120 | 211 |
| WNU12 | barley\|10v2\|BE216643 | barley | 121 | 305 |
| WNU13 | barley\|10v2\|BE412689 | barley | 122 | 213 |
| WNU14 | barley\|10v2\|BE412739 | barley | 123 | 306 |
| WNU15 | barley\|10v2\|BE413497 | barley | 124 | 215 |
| WNU16 | barley\|10v2\|BE413575 | barley | 125 | 216 |
| WNU17 | barley\|10v2\|BE420881 | barley | 126 | 217 |
| WNU18 | barley\|10v2\|BE421902 | barley | 127 | 218 |
| WNU19 | barley\|10v2\|BE438925 | barley | 128 | 219 |
| WNU20 | barley\|10v2\|BE455654 | barley | 129 | 220 |
| WNU21 | barley\|10v2\|BF260947 | barley | 130 | 307 |
| WNU23 | barley\|10v2\|BF617606 | barley | 131 | 223 |
| WNU25 | barley\|10v2\|BF623217 | barley | 132 | 224 |
| WNU26 | barley\|10v2\|BF623477 | barley | 133 | 225 |
| WNU27 | barley\|10v2\|BF626052 | barley | 134 | 308 |
| WNU28 | barley\|10v2\|BI778944 | barley | 135 | 309 |
| WNU29 | barley\|10v2\|BI947135 | barley | 136 | 228 |
| WNU30 | barley\|10v2\|BI947599 | barley | 137 | 229 |
| WNU31 | barley\|10v2\|BI950946 | barley | 138 | 230 |
| WNU32 | barley\|10v2\|BJ464604 | barley | 139 | 231 |
| WNU33 | barley\|10v2\|BQ458968 | barley | 140 | 232 |
| WNU34 | barley\|12v1\|AV835440 | barley | 141 | 310 |
| WNU35 | barley\|12v1\|BE196061 | barley | 142 | 234 |
| WNU37 | barley\|12v1\|BE455619 | barley | 143 | 311 |
| WNU38 | barley\|12v1\|BF257030 | barley | 144 | 237 |
| WNU39 | barley\|12v1\|BF260630 | barley | 145 | 238 |
| WNU40 | barley\|12v1\|BF622946 | barley | 146 | 239 |
| WNU41 | barley\|12v1\|BI957485 | barley | 147 | 312 |
| WNU42 | barley\|12v1\|BI958608 | barley | 148 | 241 |
| WNU43 | barley\|12v1\|BM370758 | barley | 149 | 242 |
| WNU44 | barley\|12v1\|BM376567 | barley | 150 | 243 |

TABLE 1-continued

Identified polynucleotides for increasing nitrogen use efficiency, fertilizer use efficiency, yield, growth rate, vigor, biomass, oil content, fiber yield, fiber quality, fiber length, abiotic stress tolerance and/or water use efficiency of a plant

| Gene Name | Cluster Name | Organism | Polyn. SEQ ID NO: | Polyp. SEQ ID NO: |
|---|---|---|---|---|
| WNU45 | brachypodium\|12v1\|BRADI1G03390 | brachypodium | 151 | 244 |
| WNU46 | brachypodium\|12v1\|BRADI1G59650 | brachypodium | 152 | 245 |
| WNU47 | brachypodium\|12v1\|BRADI1G67410 | brachypodium | 153 | 246 |
| WNU49 | brachypodium\|12v1\|BRADI2G19790 | brachypodium | 154 | 247 |
| WNU50 | brachypodium\|12v1\|BRADI2G36910 | brachypodium | 155 | 313 |
| WNU51 | brachypodium\|12v1\|BRADI2G45450 | brachypodium | 156 | 314 |
| WNU52 | brachypodium\|12v1\|BRADI2G54400 | brachypodium | 157 | 250 |
| WNU54 | foxtail_millet\|11v3\|EC613339 | foxtail_millet | 158 | 252 |
| WNU55 | foxtail_millet\|11v3\|EC613521 | foxtail_millet | 159 | 253 |
| WNU56 | foxtail_millet\|11v3\|EC613638 | foxtail_millet | 160 | 254 |
| WNU57 | foxtail_millet\|11v3\|EC613764 | foxtail_millet | 161 | 255 |
| WNU58 | foxtail_millet\|11v3\|PHY7SI002694M | foxtail_millet | 162 | 256 |
| WNU60 | foxtail_millet\|11v3\|PHY7SI004807M | foxtail_millet | 163 | 257 |
| WNU61 | foxtail_millet\|11v3\|PHY7SI006776M | foxtail_millet | 164 | 315 |
| WNU63 | foxtail_millet\|11v3\|PHY7SI010781M | foxtail_millet | 165 | 316 |
| WNU65 | foxtail_millet\|11v3\|PHY7SI011960M | foxtail_millet | 166 | 260 |
| WNU66 | foxtail_millet\|11v3\|PHY7SI016756M | foxtail_millet | 167 | 261 |
| WNU67 | foxtail_millet\|11v3\|PHY7SI016983M | foxtail_millet | 168 | 262 |
| WNU68 | foxtail_millet\|11v3\|PHY7SI018426M | foxtail_millet | 169 | 263 |
| WNU69 | foxtail_millet\|11v3\|PHY7SI020976M | foxtail_millet | 170 | 264 |
| WNU70 | foxtail_millet\|11v3\|PHY7SI021004M | foxtail_millet | 171 | 265 |
| WNU71 | foxtail_millet\|11v3\|PHY7SI029993M | foxtail_millet | 172 | 266 |
| WNU72 | foxtail_millet\|11v3\|PHY7SI035252M | foxtail_millet | 173 | 267 |
| WNU73 | foxtail_millet\|11v3\|PHY7SI035778M | foxtail_millet | 174 | 268 |
| WNU74 | foxtail_millet\|11v3\|PHY7SI036478M | foxtail_millet | 175 | 317 |
| WNU75 | maize\|10v1\|AI629766 | maize | 176 | 270 |
| WNU76 | maize\|10v1\|AI947957 | maize | 177 | 318 |
| WNU77 | maize\|10v1\|AI948358 | maize | 178 | 272 |
| WNU78 | maize\|10v1\|AI966985 | maize | 179 | 319 |
| WNU80 | maize\|10v1\|AW053253 | maize | 180 | 320 |
| WNU81 | maize\|10v1\|AW225099 | maize | 181 | 321 |
| WNU82 | maize\|10v1\|BI643478 | maize | 182 | 322 |
| WNU83 | maize\|10v1\|BM379051 | maize | 183 | 323 |
| WNU85 | rice\|11v1\|BI804924 | rice | 184 | 324 |
| WNU87 | rice\|11v1\|OSU77294 | rice | 185 | 279 |
| WNU90 | sorghum\|12v1\|EVOER2582 | sorghum | 186 | 280 |
| WNU91 | sorghum\|12 v1\|SB01G005000 | sorghum | 187 | 281 |
| WNU92 | sorghum\|12v1\|SB01G028940 | sorghum | 188 | 282 |
| WNU93 | sorghum\|12v1\|SB03G008180 | sorghum | 189 | 283 |
| WNU94 | sorghum\|12v1\|SB03G034010 | sorghum | 190 | 284 |
| WNU96 | sorghum\|12v1\|SB04G004680 | sorghum | 191 | 285 |
| WNU97 | sorghum\|12v1\|SB04G009980 | sorghum | 192 | 286 |
| WNU98 | sorghum\|12v1\|SB04G026160 | sorghum | 193 | 325 |
| WNU99 | sorghum\|12v1\|SB09G000320 | sorghum | 194 | 326 |
| WNU100 | sorghum\|12v1\|SB09G018070P1 | sorghum | 195 | 289 |
| WNU101 | sorghum\|12v1\|SB10G007680 | sorghum | 196 | 290 |
| WNU102 | wheat\|10v2\|BE415420 | wheat | 197 | 291 |
| WNU104 | maize\|10v1\|AW308714 | maize | 198 | 293 |
| WNU105 | sorghum\|12v1\|SB02G031390 | sorghum | 199 | 294 |
| WNU103_H11 | rice\|11v1\|AA749605 | rice | 200 | 295 |
| WNU22_H1 | wheat\|12v3\|BE585479 | wheat | 201 | 327 |

Table 1.
"Polyp." = polypeptide;
"Polyn."—Polynucleotide.

Example 2

Identification of Homologous Sequences that Increase Nitrogen Use Efficiency, Fertilizer Use Efficiency, Yield, Growth Rate, Vigor, Biomass, Oil Content, Abiotic Stress Tolerance and/or Water Use Efficiency in Plants The concepts of orthology and paralogy have recently been applied to functional characterizations and classifications on the scale of whole-genome comparisons. Orthologs and paralogs constitute two major types of homologs: The first evolved from a common ancestor by specialization, and the latter is related by duplication events. It is assumed that paralogs arising from ancient duplication events are likely to have diverged in function while true orthologs are more likely to retain identical function over evolutionary time.

To further investigate and identify putative orthologs of the genes affecting nitrogen use efficiency, fertilizer use efficiency, yield (e.g., seed yield, oil yield, grain quantity and/or quality), growth rate, vigor, biomass, oil content, abiotic stress tolerance and/or water use efficiency, all sequences were aligned using the BLAST (/Basic Local Alignment Search Tool/). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly. Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

The search and identification of homologous genes involves the screening of sequence information available, for example, in public databases, which include but are not limited to the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbor-joining tree of the proteins homologous to the genes of some embodiments of the invention may be used to provide an overview of structural and ancestral relationships. Sequence identity may be calculated using an alignment program as described above. It is expected that other plants will carry a similar functional gene (orthologue) or a family of similar genes and those genes will provide the same preferred phenotype as the genes presented here. Advantageously, these family members may be useful in the methods of some embodiments of the invention. Example of other plants include, but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*) and Wheat (*Triticum aestivum*)

The above-mentioned analyses for sequence homology is preferably carried out on a full-length sequence, but may also be based on a comparison of certain regions such as conserved domains. The identification of such domains, would also be well within the realm of the person skilled in the art and would involve, for example, a computer readable format of the nucleic acids of some embodiments of the invention, the use of alignment software programs and the use of publicly available information on protein domains, conserved motifs and boxes. This information is available in the PRODOM (biochem (dot) ucl (dot) ac (dot) uk/bsm/dbbrowser/protocol/prodomqry (dot) html), PIR (pir (dot) Georgetown (dot) edu/) or Pfam (sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution Tables are well known in the art [see for example Creighton (1984) Proteins. W.H. Freeman and Company]. Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 1 (Example 1 above) were identified from the databases using BLAST software with the Blastp and tBlastn algorithms as filters for the first stage, and the needle (EMBOSS package) or Frame+ algorithm alignment for the second stage. Local identity (Blast alignments) was defined with a very permissive cutoff—60% Identity on a span of 60% of the sequences lengths because it is used only as a filter for the global alignment stage. The default filtering of the Blast package was not utilized (by setting the parameter "-F F").

In the second stage, homologs were defined based on a global identity of at least 80% to the core gene polypeptide sequence.

Two distinct forms for finding the optimal global alignment for protein or nucleotide sequences were used in this application:

1. Between two proteins (following the blastp filter):
EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the tblastn filter):
GenCore 6.0 OneModel application utilizing the Frame+ algorithm with the following parameters: model= frame+_p2n.model mode=qglobal -q=protein. sequence -db=nucleotide.sequence. The rest of the parameters were unchanged from the default options described hereinabove.

The query polypeptide sequences were SEQ ID NOs: 202-327 and the query polynucleotides were SEQ ID NOs: 1-201, and the identified orthologous and homologous sequences having at least 80% global sequence identity are provided in Table 2, below. These homologous (e.g., orthologues) genes are expected to increase plant's nitrogen use efficiency (NUE), yield, seed yield, oil yield, oil content, growth rate, fiber yield, fiber quality, photosynthetic capacity, biomass, vigor, and/or abiotic stress tolerance (ABST).

TABLE 2

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU2_H1 | maize\|10v1\|CD434995_T1 | 328 | 4063 | 203 | 87.9 | glotblastn |
| WNU2_H2 | brachypodium\|12v1\|BRADI1G25187_T1 | 329 | 4064 | 203 | 84.3 | glotblastn |
| WNU2_H3 | rice\|11v1\|AU066228 | 330 | 4065 | 203 | 84.3 | globlastp |
| WNU2_H4 | wheat\|12v3\|BE445814 | 331 | 4066 | 203 | 82.2 | glotblastn |
| WNU2_H5 | brachypodium\|12v1\|BRADI1G25200_P1 | 332 | 4067 | 203 | 81.9 | globlastp |
| WNU2_H6 | rye\|12v1\|DRR001012.123320 | 333 | 4068 | 203 | 80 | globlastp |
| WNU3_H1 | sugarcane\|10v1\|CA070079 | 334 | 4069 | 204 | 98.3 | globlastp |
| WNU3_H2 | maize\|10v1\|AW066630_P1 | 335 | 4070 | 204 | 96.7 | globlastp |
| WNU3_H3 | maize\|10v1\|AW360637_P1 | 336 | 4071 | 204 | 96.7 | globlastp |
| WNU3_H4 | foxtail_millet\|11v3\|PHY7SI001983M_P1 | 337 | 4072 | 204 | 96.4 | globlastp |
| WNU3_H5 | foxtail_millet\|11v3\|SICRP017558_P1 | 338 | 4072 | 204 | 96.4 | globlastp |
| WNU3_H34 | switchgrass\|12v1\|DN146112_P1 | 339 | 4073 | 204 | 95.6 | globlastp |
| WNU3_H6 | switchgrass\|gb167\|DN146112 | 340 | 4073 | 204 | 95.6 | globlastp |
| WNU3_H7 | rice\|11v1\|AB117888 | 341 | 4074 | 204 | 92.8 | glotblastn |
| WNU3_H8 | rice\|11v1\|CF954746 | 342 | 4075 | 204 | 92.3 | globlastp |
| WNU3_H9 | brachypodium\|12v1\|BRADI2G52660_P1 | 343 | 4076 | 204 | 91.7 | globlastp |
| WNU3_H35 | switchgrass\|12v1\|DN141545_P1 | 344 | 4077 | 204 | 91.1 | globlastp |
| WNU3_H10 | switchgrass\|gb167\|DN141545 | 345 | 4077 | 204 | 91.1 | globlastp |
| WNU3_H11 | foxtail_millet\|11v3\|PHY7SI022489M_P1 | 346 | 4078 | 204 | 90.9 | globlastp |
| WNU3_H12 | maize\|10v1\|AI941668_P1 | 347 | 4079 | 204 | 90.9 | globlastp |
| WNU3_H13 | barley\|12v1\|BI950534_P1 | 348 | 4080 | 204 | 90.6 | globlastp |
| WNU3_H14 | barley\|12v1\|HV12v1CRP158093_P1 | 349 | 4080 | 204 | 90.6 | globlastp |
| WNU3_H15 | sorghum\|12v1\|SB09G024250 | 350 | 4081 | 204 | 90.6 | globlastp |
| WNU3_H16 | sugarcane\|10v1\|CA071700 | 351 | 4082 | 204 | 90.6 | globlastp |
| WNU3_H17 | rye\|12v1\|DRR001012.100986 | 352 | 4083 | 204 | 90.3 | globlastp |
| WNU3_H18 | rye\|12v1\|DRR001012.135608 | 353 | 4083 | 204 | 90.3 | globlastp |
| WNU3_H19 | wheat\|12v3\|BE400917 | 354 | 4084 | 204 | 90.1 | globlastp |
| WNU3_H20 | cenchrus\|gb166\|EB652730_P1 | 355 | 4085 | 204 | 90 | globlastp |
| WNU3_H21 | maize\|10v1\|AI372366_P1 | 356 | 4086 | 204 | 90 | globlastp |
| WNU3_H22 | oat\|11v1\|GR345828_P1 | 357 | 4087 | 204 | 89.8 | globlastp |
| WNU3_H23 | rice\|11v1\|BM419281 | 358 | 4088 | 204 | 89.2 | globlastp |
| WNU3_H24 | barley\|12v1\|BG299553_P1 | 359 | 4089 | 204 | 88.6 | globlastp |
| WNU3_H25 | brachypodium\|12v1\|BRADI2G21250_P1 | 360 | 4090 | 204 | 88.6 | globlastp |
| WNU3_H26 | wheat\|12v3\|BE401506 | 361 | 4091 | 204 | 88.6 | globlastp |
| WNU3_H27 | oat\|11v1\|CN819547_P1 | 362 | 4092 | 204 | 88.1 | globlastp |
| WNU3_H28 | rye\|12v1\|DRR001012.109054 | 363 | 4093 | 204 | 87.5 | globlastp |
| WNU3_H29 | rye\|12v1\|DRR001012.134389 | 364 | 4093 | 204 | 87.5 | globlastp |
| WNU3_H30 | pseudoroegneria\|gb167\|FF340600 | 365 | 4094 | 204 | 86.46 | glotblastn |
| WNU3_H31 | banana\|12v1\|MAGEN2012002795_P1 | 366 | 4095 | 204 | 84.3 | globlastp |
| WNU3_H32 | barley\|12v1\|AV910390_P1 | 367 | 4096 | 204 | 84.1 | globlastp |
| WNU3_H33 | banana\|12v1\|FL651443_P1 | 368 | 4097 | 204 | 83 | globlastp |
| WNU5_H1 | arabidopsis_lyrata\|09v1\|TMPLAT1G76520T1_P1 | 369 | 205 | 205 | 100 | globlastp |
| WNU5_H2 | arabidopsis_lyrata\|09v1\|JGIAL007927_P1 | 370 | 4098 | 205 | 98 | globlastp |
| WNU5_H3 | b_rapa\|11v1\|BRA015736_P1 | 371 | 4099 | 205 | 89.2 | globlastp |
| WNU5_H4 | thellungiella_halophilum\|11v1\|DN779143 | 372 | 4100 | 205 | 88.7 | globlastp |
| WNU5_H5 | b_rapa\|11v1\|EV104238_P1 | 373 | 4101 | 205 | 87.4 | globlastp |
| WNU5_H6 | canola\|11v1\|EV104238_P1 | 374 | 4102 | 205 | 86.9 | globlastp |
| WNU5_H7 | radish\|gb164\|EX756195 | 375 | 4103 | 205 | 86.2 | globlastp |
| WNU5_H8 | b_rapa\|11v1\|EV223158_P1 | 376 | 4104 | 205 | 84.1 | globlastp |
| WNU5_H9 | radish\|gb164\|EX895073 | 377 | 4105 | 205 | 81.93 | glotblastn |
| WNU6_H1 | arabidopsis_lyrata\|09v1\|JGIAL015429_P1 | 378 | 4106 | 206 | 94.7 | globlastp |
| WNU6_H2 | thellungiella_parvulum\|11v1\|EPCRP016603 | 379 | 4107 | 206 | 85.5 | globlastp |
| WNU6_H3 | b_rapa\|11v1\|EE568935_P1 | 380 | 4108 | 206 | 85 | globlastp |
| WNU6_H4 | canola\|11v1\|SRR329661.151100_P1 | 381 | 4109 | 206 | 83.7 | globlastp |
| WNU6_H5 | thellungiella_halophilum\|11v1\|EHJGI11001006 | 382 | 4110 | 206 | 83.6 | globlastp |
| WNU6_H6 | canola\|11v1\|EE568935_T1 | 383 | 4111 | 206 | 83.26 | glotblastn |
| WNU6_H7 | b_rapa\|11v1\|ES912747_P1 | 384 | 4112 | 206 | 83.2 | globlastp |
| WNU6_H8 | canola\|11v1\|ES912747_P1 | 385 | 4113 | 206 | 83.2 | globlastp |
| WNU6_H9 | canola\|11v1\|EV016118_P1 | 386 | 4114 | 206 | 82.3 | globlastp |
| WNU6_H10 | radish\|gb164\|FD951571 | 387 | 4115 | 206 | 82.3 | globlastp |
| WNU7_H1 | thellungiella_parvulum\|11v1\|BY830354 | 388 | 4116 | 207 | 92.6 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU7_H2 | arabidopsis_lyrata\|09v1\|JGIAL031129_P1 | 389 | 4117 | 207 | 91.5 | globlastp |
| WNU7_H3 | thellungiella_halophilum\|11v1\|BY830354 | 390 | 4118 | 207 | 90 | globlastp |
| WNU7_H4 | b_rapa\|11v1\|CO749935_P1 | 391 | 4119 | 207 | 85.7 | globlastp |
| WNU8_H1 | rye\|12v1\|BE495472 | 392 | 208 | 208 | 100 | globlastp |
| WNU8_H2 | rye\|12v1\|BE587609 | 393 | 208 | 208 | 100 | globlastp |
| WNU8_H3 | rye\|12v1\|DRR001012.100384 | 394 | 208 | 208 | 100 | globlastp |
| WNU8_H4 | rye\|12v1\|DRR001012.101919 | 395 | 208 | 208 | 100 | globlastp |
| WNU8_H5 | rye\|12v1\|DRR001012.103485 | 396 | 208 | 208 | 100 | globlastp |
| WNU8_H6 | rye\|12v1\|DRR001012.104321 | 397 | 208 | 208 | 100 | globlastp |
| WNU8_H7 | rye\|12v1\|DRR001012.112767 | 398 | 208 | 208 | 100 | globlastp |
| WNU8_H8 | rye\|12v1\|DRR001012.11902 | 399 | 208 | 208 | 100 | globlastp |
| WNU8_H9 | rye\|12v1\|DRR001012.122152 | 400 | 208 | 208 | 100 | globlastp |
| WNU8_H10 | rye\|12v1\|DRR001012.137813 | 401 | 4120 | 208 | 100 | glotblastn |
| WNU8_H11 | rye\|12v1\|DRR001012.158922 | 402 | 208 | 208 | 100 | globlastp |
| WNU8_H12 | rye\|12v1\|DRR001012.201080 | 403 | 208 | 208 | 100 | globlastp |
| WNU8_H13 | rye\|12v1\|DRR001012.213076 | 404 | 208 | 208 | 100 | globlastp |
| WNU8_H14 | rye\|12v1\|DRR001012.848887 | 405 | 208 | 208 | 100 | globlastp |
| WNU8_H15 | wheat\|12v3\|BE398175 | 406 | 208 | 208 | 100 | globlastp |
| WNU8_H16 | wheat\|12v3\|BE398223 | 407 | 208 | 208 | 100 | globlastp |
| WNU8_H17 | wheat\|12v3\|BE398691 | 408 | 208 | 208 | 100 | globlastp |
| WNU8_H18 | wheat\|12v3\|BE399072 | 409 | 208 | 208 | 100 | globlastp |
| WNU8_H19 | wheat\|12v3\|BE399356 | 410 | 208 | 208 | 100 | globlastp |
| WNU8_H20 | wheat\|12v3\|BE399404 | 411 | 208 | 208 | 100 | globlastp |
| WNU8_H21 | wheat\|12v3\|BE406548 | 412 | 208 | 208 | 100 | globlastp |
| WNU8_H22 | wheat\|12v3\|BE413915 | 413 | 208 | 208 | 100 | globlastp |
| WNU8_H23 | wheat\|12v3\|BE415959 | 414 | 208 | 208 | 100 | globlastp |
| WNU8_H24 | wheat\|12v3\|WHTTEF1X | 415 | 208 | 208 | 100 | globlastp |
| WNU8_H25 | wheat\|12v3\|BE398307 | 416 | 4121 | 208 | 99.8 | globlastp |
| WNU8_H26 | rye\|12v1\|DRR001012.270934 | 417 | 4122 | 208 | 99.78 | glotblastn |
| WNU8_H27 | wheat\|12v3\|BE406853 | 418 | 4123 | 208 | 99.78 | glotblastn |
| WNU8_H28 | wheat\|12v3\|BE403574 | 419 | 4124 | 208 | 99.6 | globlastp |
| WNU8_H29 | rye\|12v1\|DRR001012.172851 | 420 | 4125 | 208 | 99.33 | glotblastn |
| WNU8_H30 | rye\|12v1\|EU153587 | 421 | 4126 | 208 | 99.33 | glotblastn |
| WNU8_H31 | wheat\|12v3\|BE398292 | 422 | 4127 | 208 | 99.3 | globlastp |
| WNU8_H32 | wheat\|12v3\|BE398872 | 423 | 4127 | 208 | 99.3 | globlastp |
| WNU8_H33 | wheat\|12v3\|BE400214 | 424 | 4127 | 208 | 99.3 | globlastp |
| WNU8_H34 | wheat\|12v3\|BE407014 | 425 | 4127 | 208 | 99.3 | globlastp |
| WNU8_H35 | wheat\|12v3\|BE590945 | 426 | 4128 | 208 | 99.3 | globlastp |
| WNU8_H36 | rye\|12v1\|DRR001012.118155 | 427 | 4129 | 208 | 99.1 | globlastp |
| WNU8_H37 | wheat\|12v3\|BE398530 | 428 | 4130 | 208 | 99.1 | globlastp |
| WNU8_H38 | oat\|11v1\|CN815245_P1 | 429 | 4131 | 208 | 98.9 | globlastp |
| WNU8_H39 | rye\|12v1\|DRR001012.106186 | 430 | 4132 | 208 | 98.9 | globlastp |
| WNU8_H40 | oat\|11v1\|GO583634_P1 | 431 | 4133 | 208 | 98.7 | globlastp |
| WNU8_H41 | oat\|11v1\|GO585413_P1 | 432 | 4133 | 208 | 98.7 | globlastp |
| WNU8_H42 | oat\|11v1\|GO586258_P1 | 433 | 4133 | 208 | 98.7 | globlastp |
| WNU8_H43 | *brachypodium*\|12v1\|BRADI0012S00200T2_P1 | 434 | 4134 | 208 | 98.2 | globlastp |
| WNU8_H44 | *brachypodium*\|12v1\|BRADI1G06860T2_P1 | 435 | 4134 | 208 | 98.2 | globlastp |
| WNU8_H45 | *brachypodium*\|12v1\|BRADI1G06860_P1 | 436 | 4134 | 208 | 98.2 | globlastp |
| WNU8_H46 | *brachypodium*\|12v1\|BRADI1G06870_P1 | 437 | 4134 | 208 | 98.2 | globlastp |
| WNU8_H47 | *brachypodium*\|12v1\|BRADI4G12750T2_P1 | 438 | 4134 | 208 | 98.2 | globlastp |
| WNU8_H48 | rye\|12v1\|DRR001012.341337 | 439 | 4135 | 208 | 97.8 | globlastp |
| WNU8_H49 | *brachypodium*\|12v1\|BDPRD12V1008469_T1 | 440 | 4136 | 208 | 97.32 | glotblastn |
| WNU8_H50 | *brachypodium*\|12v1\|BDCRP12V1052162_P1 | 441 | 4137 | 208 | 97.3 | globlastp |
| WNU8_H51 | pigeonpea\|11v1\|GR464509_P1 | 442 | 4138 | 208 | 97.1 | globlastp |
| WNU8_H52 | cowpea\|12v1\|FC456669_P1 | 443 | 4139 | 208 | 96.9 | globlastp |
| WNU8_H53 | peanut\|10v1\|CD038354_P1 | 444 | 4140 | 208 | 96.9 | globlastp |
| WNU8_H54 | pigeonpea\|11v1\|GW359244_P1 | 445 | 4141 | 208 | 96.9 | globlastp |
| WNU8_H55 | soybean\|11v1\|GLYMA16G07350 | 446 | 4142 | 208 | 96.9 | globlastp |
| WNU8_H55 | soybean\|12v1\|GLYMA16G07350_P1 | 447 | 4142 | 208 | 96.9 | globlastp |
| WNU8_H56 | *trigonella*\|11v1\|SRR066194X103703 | 448 | 4143 | 208 | 96.9 | globlastp |
| WNU8_H57 | wheat\|12v3\|BE352631 | 449 | 4144 | 208 | 96.9 | globlastp |
| WNU8_H58 | wheat\|12v3\|BE398718 | 450 | 4144 | 208 | 96.9 | globlastp |
| WNU8_H59 | wheat\|12v3\|BE418288 | 451 | 4144 | 208 | 96.9 | globlastp |
| WNU8_H60 | wheat\|12v3\|BE419649 | 452 | 4144 | 208 | 96.9 | globlastp |
| WNU8_H61 | wheat\|12v3\|BE424307 | 453 | 4144 | 208 | 96.9 | globlastp |
| WNU8_H62 | wheat\|12v3\|BF200050 | 454 | 4144 | 208 | 96.9 | globlastp |
| WNU8_H63 | *brachypodium*\|12v1\|DV470157_T1 | 455 | 4145 | 208 | 96.88 | glotblastn |
| WNU8_H64 | *brachypodium*\|12v1\|DV475966_P1 | 456 | 4146 | 208 | 96.7 | globlastp |
| WNU8_H1000 | bean\|12v2\|CA898053_P1 | 457 | 4147 | 208 | 96.6 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
| --- | --- | --- | --- | --- | --- | --- |
| WNU8_H65 | apple\|11v1\|CN489484_P1 | 458 | 4148 | 208 | 96.6 | globlastp |
| WNU8_H66 | bean\|12v1\|CA898053 | 459 | 4147 | 208 | 96.6 | globlastp |
| WNU8_H67 | bean\|12v1\|FG232244 | 460 | 4147 | 208 | 96.6 | globlastp |
| WNU8_H68 | cowpea\|12v1\|FF395866_P1 | 461 | 4149 | 208 | 96.6 | globlastp |
| WNU8_H69 | humulus\|11v1\|ES654484_P1 | 462 | 4150 | 208 | 96.6 | globlastp |
| WNU8_H70 | humulus\|11v1\|ES655751_P1 | 463 | 4150 | 208 | 96.6 | globlastp |
| WNU8_H71 | humulus\|11v1\|EX521150_P1 | 464 | 4150 | 208 | 96.6 | globlastp |
| WNU8_H72 | maize\|10v1\|AI586401_P1 | 465 | 4151 | 208 | 96.6 | globlastp |
| WNU8_H73 | maize\|10v1\|T14798_P1 | 466 | 4151 | 208 | 96.6 | globlastp |
| WNU8_H74 | millet\|10v1\|CD724499_P1 | 467 | 4152 | 208 | 96.6 | globlastp |
| WNU8_H75 | millet\|10v1\|CD725344_P1 | 468 | 4152 | 208 | 96.6 | globlastp |
| WNU8_H76 | millet\|10v1\|CD725865_P1 | 469 | 4152 | 208 | 96.6 | globlastp |
| WNU8_H77 | millet\|10v1\|CD726323_P1 | 470 | 4152 | 208 | 96.6 | globlastp |
| WNU8_H78 | millet\|10v1\|CD726441_P1 | 471 | 4152 | 208 | 96.6 | globlastp |
| WNU8_H79 | millet\|10v1\|EVO454PM000499_P1 | 472 | 4152 | 208 | 96.6 | globlastp |
| WNU8_H80 | millet\|10v1\|EVO454PM000661_P1 | 473 | 4152 | 208 | 96.6 | globlastp |
| WNU8_H81 | millet\|10v1\|EVO454PM001271_P1 | 474 | 4152 | 208 | 96.6 | globlastp |
| WNU8_H82 | millet\|10v1\|EVO454PM001383_P1 | 475 | 4152 | 208 | 96.6 | globlastp |
| WNU8_H83 | millet\|10v1\|EVO454PM002183_P1 | 476 | 4152 | 208 | 96.6 | globlastp |
| WNU8_H84 | millet\|10v1\|EVO454PM003597_P1 | 477 | 4152 | 208 | 96.6 | globlastp |
| WNU8_H85 | millet\|10v1\|EVO454PM005551_P1 | 478 | 4152 | 208 | 96.6 | globlastp |
| WNU8_H86 | millet\|10v1\|EVO454PM015011_P1 | 479 | 4152 | 208 | 96.6 | globlastp |
| WNU8_H87 | millet\|10v1\|EVO454PM032398_P1 | 480 | 4152 | 208 | 96.6 | globlastp |
| WNU8_H88 | pigeonpea\|11v1\|EE604711_P1 | 481 | 4153 | 208 | 96.6 | globlastp |
| WNU8_H89 | rice\|11v1\|AA749924 | 482 | 4154 | 208 | 96.6 | globlastp |
| WNU8_H90 | rice\|11v1\|AA751062 | 483 | 4154 | 208 | 96.6 | globlastp |
| WNU8_H91 | rice\|11v1\|AA751073 | 484 | 4154 | 208 | 96.6 | globlastp |
| WNU8_H92 | rice\|11v1\|AA751266 | 485 | 4154 | 208 | 96.6 | globlastp |
| WNU8_H93 | rice\|11v1\|CB635357 | 486 | 4154 | 208 | 96.6 | globlastp |
| WNU8_H94 | rye\|12v1\|BE494068 | 487 | 4155 | 208 | 96.6 | globlastp |
| WNU8_H95 | rye\|12v1\|BE495285 | 488 | 4156 | 208 | 96.6 | globlastp |
| WNU8_H96 | rye\|12v1\|BE495525 | 489 | 4155 | 208 | 96.6 | globlastp |
| WNU8_H97 | rye\|12v1\|BE704534 | 490 | 4155 | 208 | 96.6 | globlastp |
| WNU8_H98 | rye\|12v1\|DRR001012.101216 | 491 | 4157 | 208 | 96.6 | globlastp |
| WNU8_H99 | rye\|12v1\|DRR001012.102514 | 492 | 4158 | 208 | 96.6 | globlastp |
| WNU8_H100 | rye\|12v1\|DRR001012.103115 | 493 | 4158 | 208 | 96.6 | globlastp |
| WNU8_H101 | rye\|12v1\|DRR001012.143672 | 494 | 4158 | 208 | 96.6 | globlastp |
| WNU8_H102 | rye\|12v1\|DRR001012.186360 | 495 | 4158 | 208 | 96.6 | globlastp |
| WNU8_H103 | rye\|12v1\|DRR001012.311498 | 496 | 4155 | 208 | 96.6 | globlastp |
| WNU8_H104 | soybean\|11v1\|GLYMA19G07240 | 497 | 4159 | 208 | 96.6 | globlastp |
| WNU8_H105 | wheat\|12v3\|BE406571 | 498 | 4160 | 208 | 96.6 | globlastp |
| WNU8_H104, WNU8_H710 | soybean\|12v1\|GLYMA19G07240T3_P1 | 499 | 4159 | 208 | 96.6 | globlastp |
| WNU8_H106 | chickpea\|11v1\|CK148718XX2 | 500 | 4161 | 208 | 96.42 | glotblastn |
| WNU8_H107 | millet\|10v1\|CD724963_T1 | 501 | 4162 | 208 | 96.42 | glotblastn |
| WNU8_H1001 | chickpea\|13v2\|CD051300_P1 | 502 | 4163 | 208 | 96.4 | globlastp |
| WNU8_H1002 | chickpea\|13v2\|GR394715_P1 | 503 | 4163 | 208 | 96.4 | globlastp |
| WNU8_H1003 | chickpea\|13v2\|SRR133517.123761_P1 | 504 | 4163 | 208 | 96.4 | globlastp |
| WNU8_H1004 | chickpea\|13v2\|SRR133517.147659_P1 | 505 | 4163 | 208 | 96.4 | globlastp |
| WNU8_H1005 | chickpea\|13v2\|SRR133517.27793_P1 | 506 | 4163 | 208 | 96.4 | globlastp |
| WNU8_H108 | chickpea\|11v1\|AJ010225XX1 | 507 | 4163 | 208 | 96.4 | globlastp |
| WNU8_H109 | chickpea\|11v1\|GR397423 | 508 | 4163 | 208 | 96.4 | globlastp |
| WNU8_H109 | chickpea\|13v2\|AB024998_P1 | 509 | 4163 | 208 | 96.4 | globlastp |
| WNU8_H110 | cotton\|11v1\|BE055520_P1 | 510 | 4164 | 208 | 96.4 | globlastp |
| WNU8_H111 | cucumber\|09v1\|AT007014_P1 | 511 | 4165 | 208 | 96.4 | globlastp |
| WNU8_H112 | cynodon\|10v1\|ES294218_P1 | 512 | 4166 | 208 | 96.4 | globlastp |
| WNU8_H113 | foxtail_millet\|11v3\|EC612500_P1 | 513 | 4167 | 208 | 96.4 | globlastp |
| WNU8_H114 | foxtail_millet\|11v3\|EC612637_P1 | 514 | 4167 | 208 | 96.4 | globlastp |
| WNU8_H115 | gossypium_raimondii\|12v1\|AI054704_P1 | 515 | 4164 | 208 | 96.4 | globlastp |
| WNU8_H116 | maize\|10v1\|AA051887_P1 | 516 | 4168 | 208 | 96.4 | globlastp |
| WNU8_H117 | maize\|10v1\|AI586642_P1 | 517 | 4169 | 208 | 96.4 | globlastp |
| WNU8_H118 | maize\|10v1\|AI600492_P1 | 518 | 4170 | 208 | 96.4 | globlastp |
| WNU8_H119 | maize\|10v1\|T14745_P1 | 519 | 4171 | 208 | 96.4 | globlastp |
| WNU8_H120 | medicago\|12v1\|AI737510_P1 | 520 | 4172 | 208 | 96.4 | globlastp |
| WNU8_H121 | medicago\|12v1\|AI974390_P1 | 521 | 4172 | 208 | 96.4 | globlastp |
| WNU8_H122 | millet\|10v1\|EVO454PM002847_P1 | 522 | 4173 | 208 | 96.4 | globlastp |
| WNU8_H123 | rye\|12v1\|DRR001012.150591 | 523 | 4174 | 208 | 96.4 | globlastp |
| WNU8_H124 | wheat\|12v3\|BE399763 | 524 | 4175 | 208 | 96.4 | globlastp |
| WNU8_H106, | chickpea\|13v2\|AJ010225_P1 | 525 | 4163 | 208 | 96.4 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H108 | | | | | | |
| WNU8_H1006 | chickpea\|13v2\|GR407792_T1 | 526 | 4161 | 208 | 96.2 | glotblastn |
| WNU8_H1007 | chickpea\|13v2\|SRR133517.157170_T1 | 527 | 4176 | 208 | 96.2 | glotblastn |
| WNU8_H125 | aristolochia\|10v1\|FD748314_P1 | 528 | 4177 | 208 | 96.2 | globlastp |
| WNU8_H126 | aristolochia\|10v1\|FD758456_P1 | 529 | 4177 | 208 | 96.2 | globlastp |
| WNU8_H127 | banana\|12v1\|BBS1834T7_P1 | 530 | 4178 | 208 | 96.2 | globlastp |
| WNU8_H128 | cotton\|11v1\|BM359349_P1 | 531 | 4179 | 208 | 96.2 | globlastp |
| WNU8_H129 | cotton\|11v1\|CO095627_P1 | 532 | 4180 | 208 | 96.2 | globlastp |
| WNU8_H130 | cucurbita\|11v1\|FG227792_P1 | 533 | 4181 | 208 | 96.2 | globlastp |
| WNU8_H131 | cucurbita\|11v1\|SRR091276X135177_P1 | 534 | 4182 | 208 | 96.2 | globlastp |
| WNU8_H132 | foxtail_millet\|11v3\|EC613365_P1 | 535 | 4183 | 208 | 96.2 | globlastp |
| WNU8_H133 | foxtail_millet\|11v3\|EC613737_P1 | 536 | 4183 | 208 | 96.2 | globlastp |
| WNU8_H134 | foxtail_millet\|11v3\|GT228338_P1 | 537 | 4183 | 208 | 96.2 | globlastp |
| WNU8_H135 | foxtail_millet\|11v3\|PHY7SI022036M_P1 | 538 | 4183 | 208 | 96.2 | globlastp |
| WNU8_H136 | foxtail_millet\|11v3\|PHY7SI022037M_P1 | 539 | 4183 | 208 | 96.2 | globlastp |
| WNU8_H137 | gossypium_raimondii\|12v1\|AI730162_P1 | 540 | 4180 | 208 | 96.2 | globlastp |
| WNU8_H138 | lotus\|09v1\|AI967306_P1 | 541 | 4184 | 208 | 96.2 | globlastp |
| WNU8_H139 | millet\|10v1\|EVO454PM016641_P1 | 542 | 4185 | 208 | 96.2 | globlastp |
| WNU8_H140 | poppy\|11v1\|FE964382_P1 | 543 | 4186 | 208 | 96.2 | globlastp |
| WNU8_H141 | poppy\|11v1\|FE965111_P1 | 544 | 4186 | 208 | 96.2 | globlastp |
| WNU8_H142 | poppy\|11v1\|FE965256_P1 | 545 | 4186 | 208 | 96.2 | globlastp |
| WNU8_H143 | poppy\|11v1\|FE965993_P1 | 546 | 4186 | 208 | 96.2 | globlastp |
| WNU8_H144 | poppy\|11v1\|FG606650_P1 | 547 | 4186 | 208 | 96.2 | globlastp |
| WNU8_H145 | poppy\|11v1\|FG610664_P1 | 548 | 4186 | 208 | 96.2 | globlastp |
| WNU8_H146 | poppy\|11v1\|SRR030259.100126_P1 | 549 | 4186 | 208 | 96.2 | globlastp |
| WNU8_H147 | poppy\|11v1\|SRR030259.101544_P1 | 550 | 4186 | 208 | 96.2 | globlastp |
| WNU8_H148 | poppy\|11v1\|SRR030259.102267_P1 | 551 | 4186 | 208 | 96.2 | globlastp |
| WNU8_H149 | poppy\|11v1\|SRR030259.10410_P1 | 552 | 4186 | 208 | 96.2 | globlastp |
| WNU8_H150 | poppy\|11v1\|SRR030259.133939_T1 | 553 | 4187 | 208 | 96.2 | glotblastn |
| WNU8_H151 | soybean\|11v1\|GLYMA05G24110 | 554 | 4188 | 208 | 96.2 | globlastp |
| WNU8_H152 | sugarcane\|10v1\|AF331850 | 555 | 4189 | 208 | 96.2 | globlastp |
| WNU8_H153 | sugarcane\|10v1\|BQ533135 | 556 | 4190 | 208 | 96.2 | globlastp |
| WNU8_H151, WNU8_H408 | soybean\|12v1\|GLYMA05G24110_P1 | 557 | 4188 | 208 | 96.2 | globlastp |
| WNU8_H1008 | switchgrass\|12v1\|DN142583_P1 | 558 | 4191 | 208 | 96 | globlastp |
| WNU8_H154 | apple\|11v1\|CN488523_P1 | 559 | 4192 | 208 | 96 | globlastp |
| WNU8_H155 | apple\|11v1\|CN494505_P1 | 560 | 4192 | 208 | 96 | globlastp |
| WNU8_H156 | banana\|12v1\|BBS3632T3_P1 | 561 | 4193 | 208 | 96 | globlastp |
| WNU8_H157 | clementine\|11v1\|BE205689_P1 | 562 | 4194 | 208 | 96 | globlastp |
| WNU8_H158 | clementine\|11v1\|BQ624489_P1 | 563 | 4195 | 208 | 96 | globlastp |
| WNU8_H159 | cotton\|11v1\|BG445721_P1 | 564 | 4196 | 208 | 96 | globlastp |
| WNU8_H160 | cowpea\|12v1\|FC456829_P1 | 565 | 4197 | 208 | 96 | globlastp |
| WNU8_H161 | cowpea\|12v1\|FC458124_P1 | 566 | 4197 | 208 | 96 | globlastp |
| WNU8_H162 | foxtail_millet\|11v3\|EC612225_P1 | 567 | 4198 | 208 | 96 | globlastp |
| WNU8_H163 | foxtail_millet\|11v3\|GT228217_P1 | 568 | 4198 | 208 | 96 | globlastp |
| WNU8_H164 | hornbeam\|12v1\|SRR364455.103031_P1 | 569 | 4199 | 208 | 96 | globlastp |
| WNU8_H165 | kiwi\|gb166\|GFXAY940092X1_P1 | 570 | 4200 | 208 | 96 | globlastp |
| WNU8_H166 | maize\|10v1\|T18806_P1 | 571 | 4201 | 208 | 96 | globlastp |
| WNU8_H167 | melon\|10v1\|AM729307_P1 | 572 | 4202 | 208 | 96 | globlastp |
| WNU8_H168 | oak\|10v1\|CU639705_P1 | 573 | 4203 | 208 | 96 | globlastp |
| WNU8_H169 | oak\|10v1\|DB996494_P1 | 574 | 4203 | 208 | 96 | globlastp |
| WNU8_H170 | rice\|11v1\|CB620198 | 575 | 4204 | 208 | 96 | glotblastn |
| WNU8_H171 | rye\|12v1\|BE495927 | 576 | 4205 | 208 | 96 | globlastp |
| WNU8_H172 | rye\|12v1\|DRR001012.10049 | 577 | 4206 | 208 | 96 | globlastp |
| WNU8_H173 | sorghum\|12v1\|SB10G023330 | 578 | 4207 | 208 | 96 | globlastp |
| WNU8_H174 | sorghum\|12v1\|SB10G023340 | 579 | 4207 | 208 | 96 | globlastp |
| WNU8_H175 | sorghum\|12v1\|SB10G023350 | 580 | 4207 | 208 | 96 | globlastp |
| WNU8_H176 | sorghum\|12v1\|SB10G023360 | 581 | 4207 | 208 | 96 | globlastp |
| WNU8_H177 | tea\|10v1\|CV699774 | 582 | 4208 | 208 | 96 | globlastp |
| WNU8_H178 | tobacco\|gb162\|BQ842818 | 583 | 4209 | 208 | 96 | globlastp |
| WNU8_H179 | trigonella\|11v1\|SRR066194X155552 | 584 | 4210 | 208 | 96 | globlastp |
| WNU8_H180 | poppy\|11v1\|SRR030259.102988_T1 | 585 | 4211 | 208 | 95.97 | glotblastn |
| WNU8_H181 | rye\|12v1\|DRR001013.13890 | 586 | 4212 | 208 | 95.97 | glotblastn |
| WNU8_H182 | cotton\|11v1\|BE052982_P1 | 587 | 4213 | 208 | 95.8 | globlastp |
| WNU8_H183 | pigeonpea\|11v1\|SRR054580X19235_P1 | 588 | 4214 | 208 | 95.8 | globlastp |
| WNU8_H184 | apple\|11v1\|CK900552_T1 | 589 | 4215 | 208 | 95.78 | glotblastn |
| WNU8_H185 | cynodon\|10v1\|DN985422_T1 | 590 | 4216 | 208 | 95.75 | glotblastn |
| WNU8_H186 | poppy\|11v1\|FE966067_T1 | 591 | 4217 | 208 | 95.75 | glotblastn |
| WNU8_H187 | poppy\|11v1\|SRR030260.100144_T1 | 592 | 4218 | 208 | 95.75 | glotblastn |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H1009 | nicotiana_benthamiana\|12v1\|AY206004_P1 | 593 | 4219 | 208 | 95.7 | globlastp |
| WNU8_H1010 | nicotiana_benthamiana\|12v1\|CN741625_P1 | 594 | 4219 | 208 | 95.7 | globlastp |
| WNU8_H1011 | switchgrass\|12v1\|DN140822_P1 | 595 | 4220 | 208 | 95.7 | globlastp |
| WNU8_H1012 | switchgrass\|12v1\|DN141030_P1 | 596 | 4220 | 208 | 95.7 | globlastp |
| WNU8_H1013 | switchgrass\|12v1\|DN141417_P1 | 597 | 4220 | 208 | 95.7 | globlastp |
| WNU8_H1014 | switchgrass\|12v1\|DN151972_P1 | 598 | 4221 | 208 | 95.7 | globlastp |
| WNU8_H1015 | switchgrass\|12v1\|GR876245_P1 | 599 | 4220 | 208 | 95.7 | globlastp |
| WNU8_H1016 | switchgrass\|12v1\|SRR187773.415907_P1 | 600 | 4220 | 208 | 95.7 | globlastp |
| WNU8_H188 | amorphophallus\|11v2\|SRR089351X101178_P1 | 601 | 4222 | 208 | 95.7 | globlastp |
| WNU8_H189 | amorphophallus\|11v2\|SRR089351X101401_P1 | 602 | 4222 | 208 | 95.7 | globlastp |
| WNU8_H190 | aristolochia\|10v1\|SRR039082S0176545_P1 | 603 | 4223 | 208 | 95.7 | globlastp |
| WNU8_H191 | cannabis\|12v1\|GR220976_P1 | 604 | 4224 | 208 | 95.7 | globlastp |
| WNU8_H192 | cotton\|11v1\|AI054704_P1 | 605 | 4225 | 208 | 95.7 | globlastp |
| WNU8_H193 | cynodon\|10v1\|DN985513_P1 | 606 | 4226 | 208 | 95.7 | globlastp |
| WNU8_H194 | eschscholzia\|11v1\|CD476726_P1 | 607 | 4227 | 208 | 95.7 | globlastp |
| WNU8_H195 | eschscholzia\|11v1\|CD476797_P1 | 608 | 4227 | 208 | 95.7 | globlastp |
| WNU8_H196 | eschscholzia\|11v1\|CD476881_P1 | 609 | 4227 | 208 | 95.7 | globlastp |
| WNU8_H197 | eschscholzia\|11v1\|CD477282_P1 | 610 | 4227 | 208 | 95.7 | globlastp |
| WNU8_H198 | eschscholzia\|11v1\|CD477313_P1 | 611 | 4227 | 208 | 95.7 | globlastp |
| WNU8_H199 | eschscholzia\|11v1\|CD477368_P1 | 612 | 4227 | 208 | 95.7 | globlastp |
| WNU8_H200 | eschscholzia\|11v1\|CD477537_P1 | 613 | 4227 | 208 | 95.7 | globlastp |
| WNU8_H201 | eschscholzia\|11v1\|CD478703_P1 | 614 | 4227 | 208 | 95.7 | globlastp |
| WNU8_H202 | euphorbia\|11v1\|SRR098678X100288_P1 | 615 | 4228 | 208 | 95.7 | globlastp |
| WNU8_H203 | euphorbia\|11v1\|SRR098678X100301_P1 | 616 | 4228 | 208 | 95.7 | globlastp |
| WNU8_H204 | euphorbia\|11v1\|SRR098678X100373_P1 | 617 | 4228 | 208 | 95.7 | globlastp |
| WNU8_H205 | maize\|10v1\|H35894_P1 | 618 | 4229 | 208 | 95.7 | globlastp |
| WNU8_H206 | oak\|10v1\|FN640894_P1 | 619 | 4230 | 208 | 95.7 | globlastp |
| WNU8_H207 | oak\|10v1\|FP043949_P1 | 620 | 4230 | 208 | 95.7 | globlastp |
| WNU8_H208 | oak\|10v1\|SRR006307S0002473_P1 | 621 | 4231 | 208 | 95.7 | globlastp |
| WNU8_H209 | onion\|12v1\|BQ580086_P1 | 622 | 4232 | 208 | 95.7 | globlastp |
| WNU8_H210 | poppy\|11v1\|SRR030259.109187_P1 | 623 | 4233 | 208 | 95.7 | globlastp |
| WNU8_H211 | prunus\|10v1\|BU039267 | 624 | 4234 | 208 | 95.7 | globlastp |
| WNU8_H212 | rose\|12v1\|BQ104256 | 625 | 4235 | 208 | 95.7 | globlastp |
| WNU8_H213 | silene\|11v1\|SRR096785X100438 | 626 | 4236 | 208 | 95.7 | globlastp |
| WNU8_H214 | silene\|11v1\|SRR096785X100589 | 627 | 4236 | 208 | 95.7 | globlastp |
| WNU8_H215 | silene\|11v1\|SRR096785X100710 | 628 | 4236 | 208 | 95.7 | globlastp |
| WNU8_H216 | silene\|11v1\|SRR096785X101356 | 629 | 4236 | 208 | 95.7 | globlastp |
| WNU8_H217 | silene\|11v1\|SRR096785X102548 | 630 | 4237 | 208 | 95.7 | globlastp |
| WNU8_H218 | silene\|11v1\|SRR096785X103692 | 631 | 4236 | 208 | 95.7 | globlastp |
| WNU8_H219 | silene\|11v1\|SRR096785X106318 | 632 | 4237 | 208 | 95.7 | globlastp |
| WNU8_H220 | tobacco\|gb162\|NTU04632 | 633 | 4238 | 208 | 95.7 | globlastp |
| WNU8_H221 | trigonella\|11v1\|SRR066194X116263 | 634 | 4239 | 208 | 95.7 | globlastp |
| WNU8_H1017 | chickpea\|13v2\|GR392683_T1 | 635 | 4240 | 208 | 95.53 | glotblastn |
| WNU8_H1018 | chickpea\|13v2\|SRR133517.155916_T1 | 636 | 4241 | 208 | 95.53 | glotblastn |
| WNU8_H1019 | chickpea\|13v2\|SRR133517.29578_T1 | 637 | 4242 | 208 | 95.53 | glotblastn |
| WNU8_H222 | amorphophallus\|11v2\|SRR089351X143730_T1 | 638 | 4243 | 208 | 95.53 | glotblastn |
| WNU8_H223 | amsonia\|11v1\|SRR098688X1008_T1 | 639 | 4244 | 208 | 95.53 | glotblastn |
| WNU8_H224 | cotton\|11v1\|AI730606_T1 | 640 | 4245 | 208 | 95.53 | glotblastn |
| WNU8_H225 | flaveria\|11v1\|SRR149229.466247_T1 | 641 | 4246 | 208 | 95.53 | glotblastn |
| WNU8_H226 | flaveria\|11v1\|SRR149232.102431_T1 | 642 | 4247 | 208 | 95.53 | glotblastn |
| WNU8_H227 | foxtail_millet\|11v3\|EC613894_T1 | 643 | 4248 | 208 | 95.53 | glotblastn |
| WNU8_H228 | foxtail_millet\|11v3\|SICRP094614_T1 | 644 | 4249 | 208 | 95.53 | glotblastn |
| WNU8_H229 | plantago\|11v2\|SRR066373X133888_T1 | 645 | 4250 | 208 | 95.53 | glotblastn |
| WNU8_H230 | poppy\|11v1\|SRR030259.205881_T1 | 646 | 4251 | 208 | 95.53 | glotblastn |
| WNU8_H231 | poppy\|11v1\|SRR030259.227682_T1 | 647 | 4252 | 208 | 95.53 | glotblastn |
| WNU8_H232 | silene\|11v1\|SRR096785X153635 | 648 | 4253 | 208 | 95.53 | glotblastn |
| WNU8_H1020 | bean\|12v2\|CA898065_P1 | 649 | 4254 | 208 | 95.5 | globlastp |
| WNU8_H1021 | nicotiana_benthamiana\|12v1\|BP744731_P1 | 650 | 4255 | 208 | 95.5 | globlastp |
| WNU8_H1022 | nicotiana_benthamiana\|12v1\|CN655509_P1 | 651 | 4256 | 208 | 95.5 | globlastp |
| WNU8_H1023 | prunus_mume\|13v1\|BU039267_P1 | 652 | 4257 | 208 | 95.5 | globlastp |
| WNU8_H233 | aristolochia\|10v1\|FD750352_P1 | 653 | 4258 | 208 | 95.5 | globlastp |
| WNU8_H235 | chelidonium\|11v1\|SRR084752X100201_P1 | 654 | 4259 | 208 | 95.5 | globlastp |
| WNU8_H236 | cotton\|11v1\|AI725538_P1 | 655 | 4260 | 208 | 95.5 | globlastp |
| WNU8_H237 | cotton\|11v1\|AI726406_P1 | 656 | 4260 | 208 | 95.5 | globlastp |
| WNU8_H238 | cotton\|11v1\|AI726541_P1 | 657 | 4260 | 208 | 95.5 | globlastp |
| WNU8_H239 | cotton\|11v1\|AI730220_P1 | 658 | 4260 | 208 | 95.5 | globlastp |
| WNU8_H240 | cotton\|11v1\|AI730498_P1 | 659 | 4260 | 208 | 95.5 | globlastp |
| WNU8_H241 | cotton\|11v1\|BF274186_P1 | 660 | 4260 | 208 | 95.5 | globlastp |
| WNU8_H242 | cotton\|11v1\|CO117735XX2_P1 | 661 | 4260 | 208 | 95.5 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H243 | eggplant\|10v1\|FS000082_P1 | 662 | 4261 | 208 | 95.5 | globlastp |
| WNU8_H244 | eggplant\|10v1\|FS000440_P1 | 663 | 4262 | 208 | 95.5 | globlastp |
| WNU8_H245 | eschscholzia\|11v1\|CD476486_P1 | 664 | 4263 | 208 | 95.5 | globlastp |
| WNU8_H246 | eschscholzia\|11v1\|CD478453XX2_P1 | 665 | 4264 | 208 | 95.5 | globlastp |
| WNU8_H247 | eschscholzia\|11v1\|CD478458_P1 | 666 | 4264 | 208 | 95.5 | globlastp |
| WNU8_H248 | eschscholzia\|11v1\|CD478468_P1 | 667 | 4265 | 208 | 95.5 | globlastp |
| WNU8_H249 | eschscholzia\|11v1\|CD479080XX2_P1 | 668 | 4264 | 208 | 95.5 | globlastp |
| WNU8_H250 | eschscholzia\|11v1\|SRR014116.110768_P1 | 669 | 4266 | 208 | 95.5 | globlastp |
| WNU8_H251 | gossypium_raimondii\|12v1\|AI725538_P1 | 670 | 4260 | 208 | 95.5 | globlastp |
| WNU8_H252 | gossypium_raimondii\|12v1\|AI726406_P1 | 671 | 4260 | 208 | 95.5 | globlastp |
| WNU8_H253 | gossypium_raimondii\|12v1\|BE052982_P1 | 672 | 4267 | 208 | 95.5 | globlastp |
| WNU8_H254 | grape\|11v1\|GSVIVT01025142001_P1 | 673 | 4268 | 208 | 95.5 | globlastp |
| WNU8_H255 | grape\|11v1\|GSVIVT01025145001_P1 | 674 | 4268 | 208 | 95.5 | globlastp |
| WNU8_H256 | momordica\|10v1\|SRR071315S0002857_P1 | 675 | 4269 | 208 | 95.5 | globlastp |
| WNU8_H257 | nasturtium\|11v1\|GH162035_P1 | 676 | 4270 | 208 | 95.5 | globlastp |
| WNU8_H258 | papaya\|gb165\|EL784286_P1 | 677 | 4271 | 208 | 95.5 | globlastp |
| WNU8_H259 | pea\|11v1\|CD861071_P1 | 678 | 4272 | 208 | 95.5 | globlastp |
| WNU8_H260 | pepper\|12v1\|AF109666_P1 | 679 | 4273 | 208 | 95.5 | globlastp |
| WNU8_H261 | poppy\|11v1\|SRR030259.119594_P1 | 680 | 4274 | 208 | 95.5 | globlastp |
| WNU8_H262 | rose\|12v1\|BQ106130 | 681 | 4275 | 208 | 95.5 | globlastp |
| WNU8_H263 | solanum_phureja\|09v1\|SPHAA076676 | 682 | 4276 | 208 | 95.5 | globlastp |
| WNU8_H264 | sorghum\|12v1\|SB02G036420 | 683 | 4277 | 208 | 95.5 | globlastp |
| WNU8_H265 | soybean\|11v1\|GLYMA10G35700 | 684 | 4278 | 208 | 95.5 | globlastp |
| WNU8_H265 | soybean\|12v1\|GLYMA10G35700_P1 | 685 | 4278 | 208 | 95.5 | globlastp |
| WNU8_H266 | vinca\|11v1\|SRR098690X123396 | 686 | 4279 | 208 | 95.5 | globlastp |
| WNU8_H267 | watermelon\|11v1\|CO997727 | 687 | 4280 | 208 | 95.5 | globlastp |
| WNU8_H1024 | castorbean\|12v1\|EE254323_T1 | 688 | 4281 | 208 | 95.3 | glotblastn |
| WNU8_H1025 | switchgrass\|12v1\|FL815212_P1 | 689 | 4282 | 208 | 95.3 | globlastp |
| WNU8_H268 | aquilegia\|10v2\|DR930217_P1 | 690 | 4283 | 208 | 95.3 | globlastp |
| WNU8_H269 | banana\|12v1\|Z99973_P1 | 691 | 4284 | 208 | 95.3 | globlastp |
| WNU8_H270 | beech\|11v1\|SRR006293.33031_T1 | 692 | 4285 | 208 | 95.3 | glotblastn |
| WNU8_H271 | beet\|12v1\|AW777205_P1 | 693 | 4286 | 208 | 95.3 | globlastp |
| WNU8_H272 | beet\|12v1\|BF011175_P1 | 694 | 4286 | 208 | 95.3 | globlastp |
| WNU8_H273 | castorbean\|11v1\|EE254323 | 695 | 4281 | 208 | 95.3 | glotblastn |
| WNU8_H274 | centaurea\|11v1\|EH726601_P1 | 696 | 4287 | 208 | 95.3 | globlastp |
| WNU8_H275 | centaurea\|11v1\|EH761240_P1 | 697 | 4287 | 208 | 95.3 | globlastp |
| WNU8_H276 | chelidonium\|11v1\|SRR084752X100558_P1 | 698 | 4288 | 208 | 95.3 | globlastp |
| WNU8_H277 | chelidonium\|11v1\|SRR084752X100795_P1 | 699 | 4289 | 208 | 95.3 | globlastp |
| WNU8_H278 | chelidonium\|11v1\|SRR084752X101329_P1 | 700 | 4289 | 208 | 95.3 | globlastp |
| WNU8_H279 | cirsium\|11v1\|SRR346952.1002708_P1 | 701 | 4287 | 208 | 95.3 | globlastp |
| WNU8_H280 | cirsium\|11v1\|SRR349641.103962_P1 | 702 | 4287 | 208 | 95.3 | globlastp |
| WNU8_H281 | cleome_gynandra\|10v1\|SRR015532S0001474_P1 | 703 | 4290 | 208 | 95.3 | globlastp |
| WNU8_H282 | cleome_gynandra\|10v1\|SRR015532S0004204_P1 | 704 | 4290 | 208 | 95.3 | globlastp |
| WNU8_H283 | cleome_spinosa\|10v1\|GR932583_P1 | 705 | 4291 | 208 | 95.3 | globlastp |
| WNU8_H284 | cleome_spinosa\|10v1\|SRR015531S0002895_P1 | 706 | 4292 | 208 | 95.3 | globlastp |
| WNU8_H285 | cotton\|11v1\|BF274217XX1_P1 | 707 | 4293 | 208 | 95.3 | globlastp |
| WNU8_H286 | cotton\|11v1\|CO100824_P1 | 708 | 4293 | 208 | 95.3 | globlastp |
| WNU8_H287 | cotton\|11v1\|DT053387_P1 | 709 | 4294 | 208 | 95.3 | globlastp |
| WNU8_H288 | cotton\|11v1\|DT569172_P1 | 710 | 4293 | 208 | 95.3 | globlastp |
| WNU8_H289 | eucalyptus\|11v2\|AW191358_P1 | 711 | 4295 | 208 | 95.3 | globlastp |
| WNU8_H290 | euonymus\|11v1\|SRR070038X101364_P1 | 712 | 4296 | 208 | 95.3 | globlastp |
| WNU8_H291 | euonymus\|11v1\|SRR070038X115963_P1 | 713 | 4296 | 208 | 95.3 | globlastp |
| WNU8_H292 | euonymus\|11v1\|SRR070038X259150_P1 | 714 | 4297 | 208 | 95.3 | globlastp |
| WNU8_H293 | flaveria\|11v1\|SRR149229.100675_P1 | 715 | 4298 | 208 | 95.3 | globlastp |
| WNU8_H294 | flaveria\|11v1\|SRR149229.138103_P1 | 716 | 4298 | 208 | 95.3 | globlastp |
| WNU8_H295 | flaveria\|11v1\|SRR149229.426038_P1 | 717 | 4299 | 208 | 95.3 | globlastp |
| WNU8_H296 | flaveria\|11v1\|SRR149229.452538_P1 | 718 | 4299 | 208 | 95.3 | globlastp |
| WNU8_H297 | flaveria\|11v1\|SRR149229.452727_P1 | 719 | 4298 | 208 | 95.3 | globlastp |
| WNU8_H298 | flaveria\|11v1\|SRR149232.105959_P1 | 720 | 4298 | 208 | 95.3 | globlastp |
| WNU8_H299 | flaveria\|11v1\|SRR149232.119639_P1 | 721 | 4298 | 208 | 95.3 | globlastp |
| WNU8_H300 | flaveria\|11v1\|SRR149232.239369XX2_P1 | 722 | 4298 | 208 | 95.3 | globlastp |
| WNU8_H301 | flaveria\|11v1\|SRR149232.253318_P1 | 723 | 4298 | 208 | 95.3 | globlastp |
| WNU8_H302 | flaveria\|11v1\|SRR149232.316595_P1 | 724 | 4299 | 208 | 95.3 | globlastp |
| WNU8_H303 | flaveria\|11v1\|SRR149232.356601_P1 | 725 | 4298 | 208 | 95.3 | globlastp |
| WNU8_H304 | flaveria\|11v1\|SRR149232.382252_P1 | 726 | 4298 | 208 | 95.3 | globlastp |
| WNU8_H305 | flaveria\|11v1\|SRR149232.85827_P1 | 727 | 4298 | 208 | 95.3 | globlastp |
| WNU8_H306 | flaveria\|11v1\|SRR149240.222217_P1 | 728 | 4298 | 208 | 95.3 | globlastp |
| WNU8_H307 | gerbera\|09v1\|AJ750107_P1 | 729 | 4300 | 208 | 95.3 | globlastp |
| WNU8_H308 | gossypium_raimondii\|12v1\|AI055114_P1 | 730 | 4293 | 208 | 95.3 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H309 | hornbeam\|12v1\|SRR364455.101164_P1 | 731 | 4301 | 208 | 95.3 | globlastp |
| WNU8_H310 | hornbeam\|12v1\|SRR364455.101583_P1 | 732 | 4301 | 208 | 95.3 | globlastp |
| WNU8_H311 | hornbeam\|12v1\|SRR364455.101709_P1 | 733 | 4301 | 208 | 95.3 | globlastp |
| WNU8_H312 | medicago\|12v1\|AW256757_P1 | 734 | 4302 | 208 | 95.3 | globlastp |
| WNU8_H313 | medicago\|12v1\|BF650996_P1 | 735 | 4303 | 208 | 95.3 | globlastp |
| WNU8_H314 | pigeonpea\|11v1\|GR466613_T1 | 736 | 4304 | 208 | 95.3 | glotblastn |
| WNU8_H315 | plantago\|11v2\|SRR066373X100182_P1 | 737 | 4305 | 208 | 95.3 | globlastp |
| WNU8_H316 | plantago\|11v2\|SRR066373X101749_P1 | 738 | 4305 | 208 | 95.3 | globlastp |
| WNU8_H317 | platanus\|11v1\|SRR096786X106302_P1 | 739 | 4306 | 208 | 95.3 | globlastp |
| WNU8_H318 | poppy\|11v1\|FE965841_P1 | 740 | 4307 | 208 | 95.3 | globlastp |
| WNU8_H319 | poppy\|11v1\|FE968602_P1 | 741 | 4308 | 208 | 95.3 | globlastp |
| WNU8_H320 | poppy\|11v1\|FG612840_T1 | 742 | 4309 | 208 | 95.3 | glotblastn |
| WNU8_H321 | poppy\|11v1\|SRR030259.111052_P1 | 743 | 4310 | 208 | 95.3 | globlastp |
| WNU8_H322 | poppy\|11v1\|SRR030267.75877_P1 | 744 | 4308 | 208 | 95.3 | globlastp |
| WNU8_H323 | rye\|12v1\|BF429367 | 745 | 4311 | 208 | 95.3 | globlastp |
| WNU8_H324 | rye\|12v1\|DRR001012.101877 | 746 | 4312 | 208 | 95.3 | glotblastn |
| WNU8_H325 | silene\|11v1\|DV768325 | 747 | 4313 | 208 | 95.3 | globlastp |
| WNU8_H326 | silene\|11v1\|SRR096785X101252 | 748 | 4314 | 208 | 95.3 | globlastp |
| WNU8_H327 | solanum_phureja\|09v1\|SPHAI773886 | 749 | 4315 | 208 | 95.3 | globlastp |
| WNU8_H328 | soybean\|11v1\|GLYMA05G11630 | 750 | 4316 | 208 | 95.3 | globlastp |
| WNU8_H328 | soybean\|12v1\|GLYMA05G11630T2_P1 | 751 | 4316 | 208 | 95.3 | globlastp |
| WNU8_H329 | soybean\|11v1\|GLYMA17G23900 | 752 | 4317 | 208 | 95.3 | globlastp |
| WNU8_H330 | sugarcane\|10v1\|CA110141 | 753 | 4318 | 208 | 95.3 | globlastp |
| WNU8_H331 | tomato\|11v1\|NTU04632 | 754 | 4319 | 208 | 95.3 | globlastp |
| WNU8_H332 | wheat\|12v3\|HX143170 | 755 | 4320 | 208 | 95.3 | globlastp |
| WNU8_H329, WNU8_H711 | soybean\|12v1\|GLYMA17G23900_P1 | 756 | 4317 | 208 | 95.3 | globlastp |
| WNU8_H1026 | castorbean\|12v1\|EG658125_P1 | 757 | 4321 | 208 | 95.1 | globlastp |
| WNU8_H1027 | poplar\|13v1\|AI161969_P1 | 758 | 4322 | 208 | 95.1 | globlastp |
| WNU8_H1028 | switchgrass\|12v1\|FE605464_P1 | 759 | 4323 | 208 | 95.1 | globlastp |
| WNU8_H333 | amborella\|12v3\|FD428667_P1 | 760 | 4324 | 208 | 95.1 | globlastp |
| WNU8_H334 | apple\|11v1\|CN862600_P1 | 761 | 4325 | 208 | 95.1 | globlastp |
| WNU8_H335 | apple\|11v1\|MDU80268_P1 | 762 | 4326 | 208 | 95.1 | globlastp |
| WNU8_H336 | artemisia\|10v1\|EY102338_P1 | 763 | 4327 | 208 | 95.1 | globlastp |
| WNU8_H337 | banana\|12v1\|DQ057979_P1 | 764 | 4328 | 208 | 95.1 | globlastp |
| WNU8_H338 | banana\|12v1\|ES431512_P1 | 765 | 4329 | 208 | 95.1 | globlastp |
| WNU8_H339 | banana\|12v1\|FF561778_P1 | 766 | 4330 | 208 | 95.1 | globlastp |
| WNU8_H340 | beech\|11v1\|SRR006293.11634_P1 | 767 | 4331 | 208 | 95.1 | globlastp |
| WNU8_H341 | beech\|11v1\|SRR006293.11715_P1 | 768 | 4332 | 208 | 95.1 | globlastp |
| WNU8_H342 | beech\|11v1\|SRR006293.26950_P1 | 769 | 4333 | 208 | 95.1 | globlastp |
| WNU8_H343 | beet\|12v1\|BF011125_P1 | 770 | 4334 | 208 | 95.1 | globlastp |
| WNU8_H344 | blueberry\|12v1\|CF811324_P1 | 771 | 4335 | 208 | 95.1 | globlastp |
| WNU8_H345 | blueberry\|12v1\|DR068176_P1 | 772 | 4336 | 208 | 95.1 | globlastp |
| WNU8_H346 | blueberry\|12v1\|SRR353282X11412D1_P1 | 773 | 4337 | 208 | 95.1 | globlastp |
| WNU8_H347 | cacao\|10v1\|CU471873_P1 | 774 | 4338 | 208 | 95.1 | globlastp |
| WNU8_H348 | cannabis\|12v1\|GR220640_P1 | 775 | 4339 | 208 | 95.1 | globlastp |
| WNU8_H349 | castorbean\|11v1\|EG658125 | 776 | 4321 | 208 | 95.1 | globlastp |
| WNU8_H350 | cirsium\|11v1\|SRR346952.124276_P1 | 777 | 4340 | 208 | 95.1 | globlastp |
| WNU8_H351 | cotton\|11v1\|AI055181_P1 | 778 | 4341 | 208 | 95.1 | globlastp |
| WNU8_H352 | cotton\|11v1\|AI730775_P1 | 779 | 4342 | 208 | 95.1 | globlastp |
| WNU8_H353 | cotton\|11v1\|BQ407515_P1 | 780 | 4343 | 208 | 95.1 | globlastp |
| WNU8_H354 | cotton\|11v1\|CO074038_P1 | 781 | 4343 | 208 | 95.1 | globlastp |
| WNU8_H355 | eucalyptus\|11v2\|CB968056_P1 | 782 | 4344 | 208 | 95.1 | globlastp |
| WNU8_H356 | eucalyptus\|11v2\|CD668816_P1 | 783 | 4345 | 208 | 95.1 | globlastp |
| WNU8_H357 | eucalyptus\|11v2\|CD669665_P1 | 784 | 4346 | 208 | 95.1 | globlastp |
| WNU8_H358 | flaveria\|11v1\|SRR149229.104017_P1 | 785 | 4347 | 208 | 95.1 | globlastp |
| WNU8_H359 | flaveria\|11v1\|SRR149229.124433_P1 | 786 | 4347 | 208 | 95.1 | globlastp |
| WNU8_H360 | flaveria\|11v1\|SRR149229.444305_P1 | 787 | 4348 | 208 | 95.1 | globlastp |
| WNU8_H361 | flaveria\|11v1\|SRR149229.93595_P1 | 788 | 4347 | 208 | 95.1 | globlastp |
| WNU8_H362 | flaveria\|11v1\|SRR149232.15044_P1 | 789 | 4349 | 208 | 95.1 | globlastp |
| WNU8_H363 | gossypium_raimondii\|12v1\|AI055181_P1 | 790 | 4341 | 208 | 95.1 | globlastp |
| WNU8_H364 | gossypium_raimondii\|12v1\|AI730775_P1 | 791 | 4350 | 208 | 95.1 | globlastp |
| WNU8_H365 | grape\|11v1\|GSVIVT01016317001_P1 | 792 | 4351 | 208 | 95.1 | globlastp |
| WNU8_H366 | humulus\|11v1\|ES652342_P1 | 793 | 4352 | 208 | 95.1 | globlastp |
| WNU8_H367 | lettuce\|12v1\|DW043995_P1 | 794 | 4353 | 208 | 95.1 | globlastp |
| WNU8_H368 | lotus\|09v1\|CN825649_P1 | 795 | 4354 | 208 | 95.1 | globlastp |
| WNU8_H369 | momordica\|10v1\|SRR071315S0016076_P1 | 796 | 4355 | 208 | 95.1 | globlastp |
| WNU8_H370 | phyla\|11v2\|SRR099035X100072_P1 | 797 | 4356 | 208 | 95.1 | globlastp |
| WNU8_H371 | phyla\|11v2\|SRR099035X101326_P1 | 798 | 4356 | 208 | 95.1 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H372 | phyla\|11v2\|SRR099035X101336_P1 | 799 | 4356 | 208 | 95.1 | globlastp |
| WNU8_H373 | phyla\|11v2\|SRR099035X103026_P1 | 800 | 4356 | 208 | 95.1 | globlastp |
| WNU8_H374 | pigeonpea\|11v1\|SRR054580X118863_P1 | 801 | 4357 | 208 | 95.1 | globlastp |
| WNU8_H375 | podocarpus\|10v1\|SRR065014S0015649_P1 | 802 | 4358 | 208 | 95.1 | globlastp |
| WNU8_H376 | poppy\|11v1\|FE965023_P1 | 803 | 4359 | 208 | 95.1 | globlastp |
| WNU8_H377 | poppy\|11v1\|FE966271_P1 | 804 | 4360 | 208 | 95.1 | globlastp |
| WNU8_H378 | poppy\|11v1\|SRR030259.131651_P1 | 805 | 4360 | 208 | 95.1 | globlastp |
| WNU8_H379 | poppy\|11v1\|SRR030259.204870_P1 | 806 | 4360 | 208 | 95.1 | globlastp |
| WNU8_H380 | poppy\|11v1\|SRR030259.371307_P1 | 807 | 4359 | 208 | 95.1 | globlastp |
| WNU8_H381 | poppy\|11v1\|SRR030265.228007_P1 | 808 | 4361 | 208 | 95.1 | globlastp |
| WNU8_H382 | poppy\|11v1\|SRR030266.80491_P1 | 809 | 4361 | 208 | 95.1 | globlastp |
| WNU8_H383 | poppy\|11v1\|SRR033669.106346_P1 | 810 | 4362 | 208 | 95.1 | globlastp |
| WNU8_H384 | poppy\|11v1\|SRR096789.100989_P1 | 811 | 4361 | 208 | 95.1 | globlastp |
| WNU8_H385 | poppy\|11v1\|SRR096789.114426_P1 | 812 | 4361 | 208 | 95.1 | globlastp |
| WNU8_H386 | primula\|11v1\|SRR098679X10087_P1 | 813 | 4363 | 208 | 95.1 | globlastp |
| WNU8_H387 | pteridium\|11v1\|SRR043594X102662 | 814 | 4364 | 208 | 95.1 | globlastp |
| WNU8_H388 | solanum_phureja\|09v1\|SPHAI781348 | 815 | 4365 | 208 | 95.1 | globlastp |
| WNU8_H389 | solanum_phureja\|09v1\|SPHAJ302119 | 816 | 4365 | 208 | 95.1 | globlastp |
| WNU8_H390 | solanum_phureja\|09v1\|SPHBG123241 | 817 | 4365 | 208 | 95.1 | globlastp |
| WNU8_H391 | strawberry\|11v1\|CO378450 | 818 | 4366 | 208 | 95.1 | globlastp |
| WNU8_H392 | tomato\|11v1\|AF108894 | 819 | 4367 | 208 | 95.1 | globlastp |
| WNU8_H393 | tomato\|11v1\|BG123241 | 820 | 4367 | 208 | 95.1 | globlastp |
| WNU8_H394 | trigonella\|11v1\|SRR066194X107491 | 821 | 4368 | 208 | 95.1 | globlastp |
| WNU8_H395 | tripterygium\|11v1\|SRR098677X100595 | 822 | 4369 | 208 | 95.1 | globlastp |
| WNU8_H396 | tripterygium\|11v1\|SRR098677X100891 | 823 | 4369 | 208 | 95.1 | globlastp |
| WNU8_H397 | tripterygium\|11v1\|SRR098677X101036 | 824 | 4369 | 208 | 95.1 | globlastp |
| WNU8_H398 | tripterygium\|11v1\|SRR098677X12791XX1 | 825 | 4369 | 208 | 95.1 | globlastp |
| WNU8_H399 | utricularia\|11v1\|SRR094438.100179 | 826 | 4370 | 208 | 95.1 | globlastp |
| WNU8_H400 | apple\|11v1\|CX022900_T1 | 827 | 4371 | 208 | 95.08 | glotblastn |
| WNU8_H401 | cannabis\|12v1\|GR220972_T1 | 828 | 4372 | 208 | 95.08 | glotblastn |
| WNU8_H402 | cotton\|11v1\|BQ416159_T1 | 829 | 4373 | 208 | 95.08 | glotblastn |
| WNU8_H403 | eschscholzia\|11v1\|CD476470_T1 | 830 | 4374 | 208 | 95.08 | glotblastn |
| WNU8_H404 | flaveria\|11v1\|SRR149232.101720_T1 | 831 | 4375 | 208 | 95.08 | glotblastn |
| WNU8_H405 | grape\|11v1\|CB001916_T1 | 832 | 4376 | 208 | 95.08 | glotblastn |
| WNU8_H406 | poppy\|11v1\|SRR096789.135633_T1 | 833 | 4377 | 208 | 95.08 | glotblastn |
| WNU8_H407 | sorghum\|12v1\|CD204773 | 834 | 4378 | 208 | 95.08 | glotblastn |
| WNU8_H408 | soybean\|11v1\|CF806389 | 835 | 4379 | 208 | 95.08 | glotblastn |
| WNU8_H409 | wheat\|12v3\|AW448510 | 836 | 4380 | 208 | 95.08 | glotblastn |
| WNU8_H1029 | prunus_mume\|13v1\|BU039165_P1 | 837 | 4381 | 208 | 94.9 | globlastp |
| WNU8_H410 | amorphophallus\|11v2\|SRR089351X10266_P1 | 838 | 4382 | 208 | 94.9 | globlastp |
| WNU8_H411 | amorphophallus\|11v2\|SRR089351X105525XX1_P1 | 839 | 4382 | 208 | 94.9 | globlastp |
| WNU8_H412 | amorphophallus\|11v2\|SRR089351X128278_P1 | 840 | 4382 | 208 | 94.9 | globlastp |
| WNU8_H413 | amsonia\|11v1\|SRR098688X100175_P1 | 841 | 4383 | 208 | 94.9 | globlastp |
| WNU8_H414 | aquilegia\|10v2\|DR935423_P1 | 842 | 4384 | 208 | 94.9 | globlastp |
| WNU8_H415 | aquilegia\|10v2\|DT744770_P1 | 843 | 4385 | 208 | 94.9 | globlastp |
| WNU8_H416 | banana\|12v1\|FF560532_P1 | 844 | 4386 | 208 | 94.9 | globlastp |
| WNU8_H417 | basilicum\|10v1\|DY321893_P1 | 845 | 4387 | 208 | 94.9 | globlastp |
| WNU8_H418 | blueberry\|12v1\|DR067017_P1 | 846 | 4388 | 208 | 94.9 | globlastp |
| WNU8_H419 | blueberry\|12v1\|SRR353282X100165D1_P1 | 847 | 4389 | 208 | 94.9 | globlastp |
| WNU8_H420 | blueberry\|12v1\|SRR353282X100928D1_P1 | 848 | 4390 | 208 | 94.9 | globlastp |
| WNU8_H421 | cacao\|10v1\|CA797400_P1 | 849 | 4391 | 208 | 94.9 | globlastp |
| WNU8_H422 | cacao\|10v1\|CF972784_P1 | 850 | 4392 | 208 | 94.9 | globlastp |
| WNU8_H423 | cedrus\|11v1\|SRR065007X100666_P1 | 851 | 4393 | 208 | 94.9 | globlastp |
| WNU8_H424 | cirsium\|11v1\|SRR346952.1004975_P1 | 852 | 4394 | 208 | 94.9 | globlastp |
| WNU8_H425 | cirsium\|11v1\|SRR346952.1052090_P1 | 853 | 4394 | 208 | 94.9 | globlastp |
| WNU8_H426 | clementine\|11v1\|BE205741_P1 | 854 | 4395 | 208 | 94.9 | globlastp |
| WNU8_H427 | cleome_gynandra\|10v1\|SRR015532S0001773_P1 | 855 | 4396 | 208 | 94.9 | globlastp |
| WNU8_H428 | cleome_spinosa\|10v1\|GR933669_P1 | 856 | 4397 | 208 | 94.9 | globlastp |
| WNU8_H429 | cleome_spinosa\|10v1\|SRR015531S0001111_P1 | 857 | 4398 | 208 | 94.9 | globlastp |
| WNU8_H430 | coffea\|10v1\|DV663574_P1 | 858 | 4399 | 208 | 94.9 | globlastp |
| WNU8_H431 | cotton\|11v1\|CO071370_P1 | 859 | 4400 | 208 | 94.9 | globlastp |
| WNU8_H432 | cotton\|11v1\|DT048133_P1 | 860 | 4401 | 208 | 94.9 | globlastp |
| WNU8_H433 | dandelion\|10v1\|DR399309_P1 | 861 | 4402 | 208 | 94.9 | globlastp |
| WNU8_H434 | eschscholzia\|11v1\|CD476398_P1 | 862 | 4403 | 208 | 94.9 | globlastp |
| WNU8_H435 | eucalyptus\|11v2\|CB967966_P1 | 863 | 4404 | 208 | 94.9 | globlastp |
| WNU8_H436 | euphorbia\|11v1\|AW862637_P1 | 864 | 4405 | 208 | 94.9 | globlastp |
| WNU8_H437 | grape\|11v1\|GSVIVT01025638001_P1 | 865 | 4406 | 208 | 94.9 | globlastp |
| WNU8_H438 | humulus\|11v1\|FG346869_P1 | 866 | 4407 | 208 | 94.9 | globlastp |
| WNU8_H439 | humulus\|11v1\|GD245567_P1 | 867 | 4408 | 208 | 94.9 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H440 | maize\|10v1\|BG320525_P1 | 868 | 4409 | 208 | 94.9 | globlastp |
| WNU8_H441 | oil_palm\|11v1\|EL682924_P1 | 869 | 4410 | 208 | 94.9 | globlastp |
| WNU8_H442 | oil_palm\|11v1\|EL930607_P1 | 870 | 4411 | 208 | 94.9 | globlastp |
| WNU8_H443 | oil_palm\|11v1\|ES323752_P1 | 871 | 4411 | 208 | 94.9 | globlastp |
| WNU8_H444 | orange\|11v1\|BE205741_P1 | 872 | 4412 | 208 | 94.9 | globlastp |
| WNU8_H445 | orobanche\|10v1\|SRR023189S0000079_P1 | 873 | 4413 | 208 | 94.9 | globlastp |
| WNU8_H446 | orobanche\|10v1\|SRR023189S0001178_P1 | 874 | 4414 | 208 | 94.9 | globlastp |
| WNU8_H447 | parthenium\|10v1\|GW776061_P1 | 875 | 4415 | 208 | 94.9 | globlastp |
| WNU8_H448 | pepper\|12v1\|AF108894_P1 | 876 | 4416 | 208 | 94.9 | globlastp |
| WNU8_H449 | pepper\|12v1\|BM061844_P1 | 877 | 4416 | 208 | 94.9 | globlastp |
| WNU8_H450 | phalaenopsis\|11v1\|CB033270XX1_P1 | 878 | 4417 | 208 | 94.9 | globlastp |
| WNU8_H451 | phalaenopsis\|11v1\|CK858530_P1 | 879 | 4418 | 208 | 94.9 | globlastp |
| WNU8_H452 | platanus\|11v1\|AM286248_P1 | 880 | 4419 | 208 | 94.9 | globlastp |
| WNU8_H453 | platanus\|11v1\|SRR096786X101171_P1 | 881 | 4419 | 208 | 94.9 | globlastp |
| WNU8_H454 | poppy\|11v1\|SRR030259.124479_P1 | 882 | 4420 | 208 | 94.9 | globlastp |
| WNU8_H455 | prunus\|10v1\|BU039165 | 883 | 4381 | 208 | 94.9 | globlastp |
| WNU8_H456 | rye\|12v1\|DRR001012.156956 | 884 | 4421 | 208 | 94.9 | globlastp |
| WNU8_H457 | spruce\|11v1\|ES245248 | 885 | 4422 | 208 | 94.9 | globlastp |
| WNU8_H458 | spruce\|11v1\|ES250415 | 886 | 4422 | 208 | 94.9 | globlastp |
| WNU8_H459 | spruce\|11v1\|EX345407 | 887 | 4422 | 208 | 94.9 | globlastp |
| WNU8_H460 | strawberry\|11v1\|CO381963 | 888 | 4423 | 208 | 94.9 | globlastp |
| WNU8_H461 | sunflower\|12v1\|AJ318256 | 889 | 4424 | 208 | 94.9 | globlastp |
| WNU8_H462 | sunflower\|12v1\|AY094064 | 890 | 4424 | 208 | 94.9 | globlastp |
| WNU8_H463 | sunflower\|12v1\|BU671873 | 891 | 4424 | 208 | 94.9 | globlastp |
| WNU8_H464 | sunflower\|12v1\|BU671985 | 892 | 4424 | 208 | 94.9 | globlastp |
| WNU8_H465 | sunflower\|12v1\|CD851234 | 893 | 4424 | 208 | 94.9 | globlastp |
| WNU8_H466 | sunflower\|12v1\|DY909098 | 894 | 4424 | 208 | 94.9 | globlastp |
| WNU8_H467 | sunflower\|12v1\|DY915476 | 895 | 4424 | 208 | 94.9 | globlastp |
| WNU8_H468 | tabernaemontana\|11v1\|SRR098689X101208 | 896 | 4425 | 208 | 94.9 | globlastp |
| WNU8_H469 | tabernaemontana\|11v1\|SRR098689X106153XX1 | 897 | 4426 | 208 | 94.9 | globlastp |
| WNU8_H470 | tomato\|11v1\|R28725 | 898 | 4427 | 208 | 94.9 | globlastp |
| WNU8_H471 | tragopogon\|10v1\|SRR020205S0002006 | 899 | 4428 | 208 | 94.9 | globlastp |
| WNU8_H472 | trigonella\|11v1\|SRR066194X10242 | 900 | 4429 | 208 | 94.9 | globlastp |
| WNU8_H501 | poplar\|13v1\|AI164807_P1 | 901 | 4430 | 208 | 94.9 | globlastp |
| WNU8_H473 | eucalyptus\|11v2\|CU400103_T1 | 902 | 4431 | 208 | 94.88 | glotblastn |
| WNU8_H474 | medicago\|12v1\|BF639628_T1 | 903 | 4432 | 208 | 94.87 | glotblastn |
| WNU8_H1030 | monkeyflower\|12v1\|DV205853_T1 | 904 | 4433 | 208 | 94.85 | glotblastn |
| WNU8_H475 | avocado\|10v1\|CO996848_T1 | 905 | 4434 | 208 | 94.85 | glotblastn |
| WNU8_H476 | beet\|12v1\|AW697790_T1 | 906 | 4435 | 208 | 94.85 | glotblastn |
| WNU8_H477 | cannabis\|12v1\|GR222004_T1 | 907 | 4436 | 208 | 94.85 | glotblastn |
| WNU8_H478 | eschscholzia\|11v1\|SRR014116.105105_T1 | 908 | 4437 | 208 | 94.85 | glotblastn |
| WNU8_H479 | flaveria\|11v1\|SRR149229.114917_T1 | 909 | 4438 | 208 | 94.85 | glotblastn |
| WNU8_H480 | gossypium_raimondii\|12v1\|AI726186_T1 | 910 | 4439 | 208 | 94.85 | glotblastn |
| WNU8_H481 | maize\|10v1\|CD441766_T1 | 911 | 4440 | 208 | 94.85 | glotblastn |
| WNU8_H482 | rye\|12v1\|DRR001012.347328 | 912 | 4441 | 208 | 94.85 | glotblastn |
| WNU8_H1031 | castorbean\|12v1\|EE256050_P1 | 913 | 4442 | 208 | 94.7 | globlastp |
| WNU8_H1032 | castorbean\|12v1\|EG656787_P1 | 914 | 4442 | 208 | 94.7 | globlastp |
| WNU8_H1033 | olea\|13v1\|GFXAM946404X1_P1 | 915 | 4443 | 208 | 94.7 | globlastp |
| WNU8_H1034 | olea\|13v1\|SRR014463X20349D1_P1 | 916 | 4444 | 208 | 94.7 | globlastp |
| WNU8_H1035 | poplar\|13v1\|AI166447_P1 | 917 | 4445 | 208 | 94.7 | globlastp |
| WNU8_H483 | ambrosia\|11v1\|SRR346943.126871_P1 | 918 | 4446 | 208 | 94.7 | globlastp |
| WNU8_H484 | arabidopsis_lyrata\|09v1\|JGIAL000754_P1 | 919 | 4447 | 208 | 94.7 | globlastp |
| WNU8_H485 | arabidopsis_lyrata\|09v1\|JGIAL030663_P1 | 920 | 4447 | 208 | 94.7 | globlastp |
| WNU8_H486 | arabidopsis\|10v1\|AT1G07901_P1 | 921 | 4447 | 208 | 94.7 | globlastp |
| WNU8_H487 | arabidopsis\|10v1\|AT1G07930_P1 | 922 | 4447 | 208 | 94.7 | globlastp |
| WNU8_H488 | arabidopsis\|10v1\|AT1G07940_P1 | 923 | 4447 | 208 | 94.7 | globlastp |
| WNU8_H489 | arabidopsis\|10v1\|AT5G60390_P1 | 924 | 4447 | 208 | 94.7 | globlastp |
| WNU8_H490 | cacao\|10v1\|CA794319_P1 | 925 | 4448 | 208 | 94.7 | globlastp |
| WNU8_H492 | castorbean\|11v1\|EG656787 | 926 | 4442 | 208 | 94.7 | globlastp |
| WNU8_H493 | cirsium\|11v1\|SRR346952.102421_P1 | 927 | 4449 | 208 | 94.7 | globlastp |
| WNU8_H494 | cleome_spinosa\|10v1\|SRR015531S0002488_P1 | 928 | 4450 | 208 | 94.7 | globlastp |
| WNU8_H495 | coffea\|10v1\|CF588804_P1 | 929 | 4451 | 208 | 94.7 | globlastp |
| WNU8_H496 | cotton\|11v1\|AW187614_P1 | 930 | 4452 | 208 | 94.7 | globlastp |
| WNU8_H497 | cotton\|11v1\|BQ414984_P1 | 931 | 4452 | 208 | 94.7 | globlastp |
| WNU8_H498 | cucumber\|09v1\|CSCRP008322_P1 | 932 | 4453 | 208 | 94.7 | globlastp |
| WNU8_H499 | fraxinus\|11v1\|SRR058827.100679_P1 | 933 | 4454 | 208 | 94.7 | globlastp |
| WNU8_H500 | olea\|11v1\|SRR014463.10146 | 934 | 4455 | 208 | 94.7 | globlastp |
| WNU8_H501 | poplar\|10v1\|AI161969 | 935 | 4456 | 208 | 94.7 | globlastp |
| WNU8_H502 | sunflower\|12v1\|BU028740 | 936 | 4457 | 208 | 94.7 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H503 | sunflower\|12v1\|DY946305 | 937 | 4458 | 208 | 94.7 | globlastp |
| WNU8_H504 | thellungiella_halophilum\|11v1\|BM986048 | 938 | 4459 | 208 | 94.7 | globlastp |
| WNU8_H505 | thellungiella_halophilum\|11v1\|DN773185 | 939 | 4459 | 208 | 94.7 | globlastp |
| WNU8_H506 | thellungiella_halophilum\|11v1\|DN773401 | 940 | 4459 | 208 | 94.7 | globlastp |
| WNU8_H507 | thellungiella_halophilum\|11v1\|DN773796 | 941 | 4459 | 208 | 94.7 | globlastp |
| WNU8_H508 | triphysaria\|10v1\|BE574839 | 942 | 4460 | 208 | 94.7 | globlastp |
| WNU8_H509 | triphysaria\|10v1\|BM357290 | 943 | 4460 | 208 | 94.7 | globlastp |
| WNU8_H510 | valeriana\|11v1\|SRR099039X149703 | 944 | 4461 | 208 | 94.7 | globlastp |
| WNU8_H511 | foxtail_millet\|11v3\|SICRP094659_T1 | 945 | 4462 | 208 | 94.69 | glotblastn |
| WNU8_H512 | ambrosia\|11v1\|SRR346935.127621_T1 | 946 | 4463 | 208 | 94.63 | glotblastn |
| WNU8_H513 | castorbean\|11v1\|EG661854 | 947 | 4464 | 208 | 94.63 | glotblastn |
| WNU8_H514 | grape\|11v1\|CB288374_T1 | 948 | 4465 | 208 | 94.63 | glotblastn |
| WNU8_H515 | poppy\|11v1\|SRR030259.267771_T1 | 949 | 4466 | 208 | 94.63 | glotblastn |
| WNU8_H516 | sorghum\|12v1\|SB12V1CRP038294 | 950 | 4467 | 208 | 94.63 | glotblastn |
| WNU8_H517 | valeriana\|11v1\|SRR099039X100036 | 951 | 4468 | 208 | 94.63 | glotblastn |
| WNU8_H518 | wheat\|12v3\|AL820214 | 952 | 4469 | 208 | 94.63 | glotblastn |
| WNU8_H1036 | prunus_mume\|13v1\|AJ533915_P1 | 953 | 4470 | 208 | 94.6 | globlastp |
| WNU8_H519 | abies\|11v2\|SRR098676X101737_P1 | 954 | 4471 | 208 | 94.6 | globlastp |
| WNU8_H520 | amorphophallus\|11v2\|SRR089351X106775_P1 | 955 | 4472 | 208 | 94.6 | globlastp |
| WNU8_H521 | apple\|11v1\|CN860744_P1 | 956 | 4473 | 208 | 94.6 | globlastp |
| WNU8_H522 | artemisia\|10v1\|EY037542_P1 | 957 | 4474 | 208 | 94.6 | globlastp |
| WNU8_H523 | euonymus\|11v1\|SRR070038X100853_P1 | 958 | 4475 | 208 | 94.6 | globlastp |
| WNU8_H524 | euonymus\|11v1\|SRR070038X11282_P1 | 959 | 4476 | 208 | 94.6 | globlastp |
| WNU8_H525 | euphorbia\|11v1\|AW862626_P1 | 960 | 4477 | 208 | 94.6 | globlastp |
| WNU8_H526 | flax\|11v1\|CA482954_P1 | 961 | 4478 | 208 | 94.6 | globlastp |
| WNU8_H527 | flax\|11v1\|CV478249_P1 | 962 | 4478 | 208 | 94.6 | globlastp |
| WNU8_H528 | ipomoea_batatas\|10v1\|CB330042_P1 | 963 | 4479 | 208 | 94.6 | globlastp |
| WNU8_H529 | ipomoea_nil\|10v1\|BJ553094_P1 | 964 | 4480 | 208 | 94.6 | globlastp |
| WNU8_H530 | lolium\|10v1\|AU245749_P1 | 965 | 4481 | 208 | 94.6 | globlastp |
| WNU8_H531 | lolium\|10v1\|DT669536_P1 | 966 | 4482 | 208 | 94.6 | globlastp |
| WNU8_H532 | millet\|10v1\|EVO454PM009336_P1 | 967 | 4483 | 208 | 94.6 | globlastp |
| WNU8_H533 | oil_palm\|11v1\|EL608609_P1 | 968 | 4484 | 208 | 94.6 | globlastp |
| WNU8_H534 | oil_palm\|11v1\|EL681356XX1_P1 | 969 | 4485 | 208 | 94.6 | globlastp |
| WNU8_H535 | phalaenopsis\|11v1\|SRR125771.1013977_P1 | 970 | 4486 | 208 | 94.6 | globlastp |
| WNU8_H536 | poplar\|10v1\|AI161649 | 971 | 4487 | 208 | 94.6 | globlastp |
| WNU8_H537 | pseudotsuga\|10v1\|SRR065119S0000257 | 972 | 4488 | 208 | 94.6 | globlastp |
| WNU8_H538 | spikemoss\|gb165\|DN839525 | 973 | 4489 | 208 | 94.6 | globlastp |
| WNU8_H539 | trigonella\|11v1\|SRR066194X137675 | 974 | 4490 | 208 | 94.6 | globlastp |
| WNU8_H540 | trigonella\|11v1\|SRR066194X154517 | 975 | 4490 | 208 | 94.6 | globlastp |
| WNU8_H541 | tripterygium\|11v1\|SRR098677X101761 | 976 | 4491 | 208 | 94.6 | globlastp |
| WNU8_H536 | poplar\|13v1\|AI161506_T1 | 977 | 4492 | 208 | 94.41 | glotblastn |
| WNU8_H542 | b_juncea\|12v1\|E6ANDIZ01A0NBV_T1 | 978 | 4493 | 208 | 94.41 | glotblastn |
| WNU8_H543 | canola\|11v1\|SRR329671.156242_T1 | 979 | 4494 | 208 | 94.41 | glotblastn |
| WNU8_H544 | cichorium\|gb171\|AY378166_T1 | 980 | 4495 | 208 | 94.41 | glotblastn |
| WNU8_H545 | lotus\|09v1\|BP070850_T1 | 981 | 4496 | 208 | 94.41 | glotblastn |
| WNU8_H546 | oil_palm\|11v1\|EB643526_T1 | 982 | 4497 | 208 | 94.41 | glotblastn |
| WNU8_H547 | primula\|11v1\|SRR098679X113006_T1 | 983 | 4498 | 208 | 94.41 | glotblastn |
| WNU8_H548 | scabiosa\|11v1\|SRR063723X103333 | 984 | 4499 | 208 | 94.41 | glotblastn |
| WNU8_H549 | sugarcane\|10v1\|AF281361 | 985 | 4500 | 208 | 94.41 | glotblastn |
| WNU8_H550 | tomato\|11v1\|AI773886 | 986 | 4501 | 208 | 94.41 | glotblastn |
| WNU8_H1037 | bean\|12v2\|SRR001336.212815_P1 | 987 | 4502 | 208 | 94.4 | globlastp |
| WNU8_H1038 | monkeyflower\|12v1\|DV207107_P1 | 988 | 4503 | 208 | 94.4 | globlastp |
| WNU8_H1039 | monkeyflower\|12v1\|DV207353_P1 | 989 | 4503 | 208 | 94.4 | globlastp |
| WNU8_H1040 | monkeyflower\|12v1\|DV208772_P1 | 990 | 4503 | 208 | 94.4 | globlastp |
| WNU8_H551 | abies\|11v2\|SRR098676X100568_P1 | 991 | 4504 | 208 | 94.4 | globlastp |
| WNU8_H552 | amborella\|12v3\|CK749009_P1 | 992 | 4505 | 208 | 94.4 | globlastp |
| WNU8_H554 | cacao\|10v1\|CA795371_P1 | 993 | 4506 | 208 | 94.4 | globlastp |
| WNU8_H555 | cannabis\|12v1\|SOLX00017332_P1 | 994 | 4507 | 208 | 94.4 | globlastp |
| WNU8_H556 | catharanthus\|11v1\|EG554695_P1 | 995 | 4508 | 208 | 94.4 | globlastp |
| WNU8_H557 | catharanthus\|11v1\|EG555941_P1 | 996 | 4508 | 208 | 94.4 | globlastp |
| WNU8_H558 | catharanthus\|11v1\|EG557697_P1 | 997 | 4508 | 208 | 94.4 | globlastp |
| WNU8_H559 | cedrus\|11v1\|SRR065007X100199_P1 | 998 | 4509 | 208 | 94.4 | globlastp |
| WNU8_H560 | cedrus\|11v1\|SRR065007X10026_P1 | 999 | 4509 | 208 | 94.4 | globlastp |
| WNU8_H561 | cotton\|11v1\|BF268921_P1 | 1000 | 4510 | 208 | 94.4 | globlastp |
| WNU8_H562 | cotton\|11v1\|BF269646_P1 | 1001 | 4510 | 208 | 94.4 | globlastp |
| WNU8_H563 | euonymus\|11v1\|SRR070038X100282_P1 | 1002 | 4511 | 208 | 94.4 | globlastp |
| WNU8_H564 | euonymus\|11v1\|SRR070038X10269_P1 | 1003 | 4511 | 208 | 94.4 | globlastp |
| WNU8_H565 | euonymus\|11v1\|SRR070038X103854_P1 | 1004 | 4511 | 208 | 94.4 | globlastp |
| WNU8_H566 | euonymus\|11v1\|SRR070038X104549_P1 | 1005 | 4511 | 208 | 94.4 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H567 | euonymus\|11v1\|SRR070038X106777_P1 | 1006 | 4511 | 208 | 94.4 | globlastp |
| WNU8_H568 | euonymus\|11v1\|SRR070038X111303_P1 | 1007 | 4511 | 208 | 94.4 | globlastp |
| WNU8_H569 | euonymus\|11v1\|SRR070038X115972_P1 | 1008 | 4511 | 208 | 94.4 | globlastp |
| WNU8_H570 | euphorbia\|11v1\|AW862613_P1 | 1009 | 4512 | 208 | 94.4 | globlastp |
| WNU8_H571 | euphorbia\|11v1\|SRR098678X102266_P1 | 1010 | 4513 | 208 | 94.4 | globlastp |
| WNU8_H572 | fraxinus\|11v1\|SRR058827.102102_P1 | 1011 | 4514 | 208 | 94.4 | globlastp |
| WNU8_H573 | fraxinus\|11v1\|SRR058827.108997_P1 | 1012 | 4515 | 208 | 94.4 | globlastp |
| WNU8_H574 | gnetum\|10v1\|CB082379_P1 | 1013 | 4516 | 208 | 94.4 | globlastp |
| WNU8_H575 | hevea\|10v1\|EC601487_P1 | 1014 | 4517 | 208 | 94.4 | globlastp |
| WNU8_H576 | lettuce\|12v1\|CV700260_P1 | 1015 | 4518 | 208 | 94.4 | globlastp |
| WNU8_H577 | maritime_pine\|10v1\|AL749939_P1 | 1016 | 4519 | 208 | 94.4 | globlastp |
| WNU8_H578 | melon\|10v1\|DV631424_P1 | 1017 | 4520 | 208 | 94.4 | globlastp |
| WNU8_H579 | monkeyflower\|10v1\|DV205853 | 1018 | 4503 | 208 | 94.4 | globlastp |
| WNU8_H580 | monkeyflower\|10v1\|DV207107 | 1019 | 4503 | 208 | 94.4 | globlastp |
| WNU8_H581 | nasturtium\|11v1\|GH163859_P1 | 1020 | 4521 | 208 | 94.4 | globlastp |
| WNU8_H582 | oat\|11v1\|G0582886_P1 | 1021 | 4522 | 208 | 94.4 | globlastp |
| WNU8_H583 | pepper\|12v1\|BM063862_P1 | 1022 | 4523 | 208 | 94.4 | globlastp |
| WNU8_H584 | phalaenopsis\|11v1\|SRR125771.1001018_P1 | 1023 | 4524 | 208 | 94.4 | globlastp |
| WNU8_H585 | pine\|10v2\|H75081_P1 | 1024 | 4525 | 208 | 94.4 | globlastp |
| WNU8_H586 | podocarpus\|10v1\|SRR065014S0002906_P1 | 1025 | 4526 | 208 | 94.4 | globlastp |
| WNU8_H587 | prunus\|10v1\|AJ533915 | 1026 | 4527 | 208 | 94.4 | globlastp |
| WNU8_H588 | pseudotsuga\|10v1\|GFXAY832557X1 | 1027 | 4528 | 208 | 94.4 | globlastp |
| WNU8_H589 | pteridium\|11v1\|SRR043594X102541 | 1028 | 4529 | 208 | 94.4 | globlastp |
| WNU8_H590 | pteridium\|11v1\|SRR043594X104777 | 1029 | 4530 | 208 | 94.4 | globlastp |
| WNU8_H591 | salvia\|10v1\|FJ858191 | 1030 | 4531 | 208 | 94.4 | globlastp |
| WNU8_H592 | sequoia\|10v1\|SRR065044S0007394 | 1031 | 4532 | 208 | 94.4 | globlastp |
| WNU8_H593 | spikemoss\|gb165\|FE440656 | 1032 | 4533 | 208 | 94.4 | globlastp |
| WNU8_H594 | spruce\|11v1\|ES875403 | 1033 | 4534 | 208 | 94.4 | globlastp |
| WNU8_H595 | tabernaemontana\|11v1\|SRR098689X100678 | 1034 | 4535 | 208 | 94.4 | globlastp |
| WNU8_H596 | trigonella\|11v1\|SRR066194X74267 | 1035 | 4536 | 208 | 94.4 | globlastp |
| WNU8_H597 | tripterygium\|11v1\|SRR098677X107031 | 1036 | 4537 | 208 | 94.4 | globlastp |
| WNU8_H598 | valeriana\|11v1\|SRR099039X100438 | 1037 | 4538 | 208 | 94.4 | globlastp |
| WNU8_H599 | watermelon\|11v1\|AB029104 | 1038 | 4539 | 208 | 94.4 | globlastp |
| WNU8_H600 | watermelon\|11v1\|CK700722 | 1039 | 4539 | 208 | 94.4 | globlastp |
| WNU8_H601 | amorphophallus\|11v2\|SRR089351X100293_T1 | 1040 | 4540 | 208 | 94.22 | glotblastn |
| WNU8_H602 | rye\|12v1\|DRR001013.151108 | 1041 | 4541 | 208 | 94.21 | glotblastn |
| WNU8_H1041 | chickpea\|13v2\|GR915502_P1 | 1042 | 4542 | 208 | 94.2 | globlastp |
| WNU8_H1042 | chickpea\|13v2\|SRR133517.111803_P1 | 1043 | 4542 | 208 | 94.2 | globlastp |
| WNU8_H1043 | olea\|13v1\|SRR014463X11728D1_P1 | 1044 | 4543 | 208 | 94.2 | globlastp |
| WNU8_H1044 | prunus_mume\|13v1\|BU045587_P1 | 1045 | 4544 | 208 | 94.2 | globlastp |
| WNU8_H1045 | prunus_mume\|13v1\|SRR345679.95461_P1 | 1046 | 4545 | 208 | 94.2 | globlastp |
| WNU8_H603 | amborella\|12v3\|CO997427_P1 | 1047 | 4546 | 208 | 94.2 | globlastp |
| WNU8_H604 | amorphophallus\|11v2\|SRR089351X10941_P1 | 1048 | 4547 | 208 | 94.2 | globlastp |
| WNU8_H605 | arnica\|11v1\|SRR099034X100032_P1 | 1049 | 4548 | 208 | 94.2 | globlastp |
| WNU8_H606 | arnica\|11v1\|SRR099034X100335_P1 | 1050 | 4549 | 208 | 94.2 | globlastp |
| WNU8_H607 | arnica\|11v1\|SRR099034X103888_P1 | 1051 | 4550 | 208 | 94.2 | globlastp |
| WNU8_H608 | arnica\|11v1\|SRR099034X116643_P1 | 1052 | 4550 | 208 | 94.2 | globlastp |
| WNU8_H609 | catharanthus\|11v1\|EG554541_P1 | 1053 | 4551 | 208 | 94.2 | globlastp |
| WNU8_H610 | chickpea\|11v1\|GR915502 | 1054 | 4552 | 208 | 94.2 | glotblastn |
| WNU8_H611 | euonymus\|11v1\|SRR070038X43550_P1 | 1055 | 4553 | 208 | 94.2 | globlastp |
| WNU8_H612 | lettuce\|12v1\|DW046184_P1 | 1056 | 4554 | 208 | 94.2 | globlastp |
| WNU8_H613 | medicago\|12v1\|AW684157_P1 | 1057 | 4555 | 208 | 94.2 | globlastp |
| WNU8_H614 | olea\|11v1\|SRR014463.10556 | 1058 | 4556 | 208 | 94.2 | globlastp |
| WNU8_H615 | phalaenopsis\|11v1\|CK857786_P1 | 1059 | 4557 | 208 | 94.2 | globlastp |
| WNU8_H616 | poppy\|11v1\|SRR096789.104983_P1 | 1060 | 4558 | 208 | 94.2 | globlastp |
| WNU8_H617 | primula\|11v1\|SRR098679X101131_P1 | 1061 | 4559 | 208 | 94.2 | globlastp |
| WNU8_H618 | prunus\|10v1\|BU045587 | 1062 | 4560 | 208 | 94.2 | globlastp |
| WNU8_H619 | rose\|12v1\|BQ106350 | 1063 | 4561 | 208 | 94.2 | globlastp |
| WNU8_H620 | rose\|12v1\|SRR397984.101837 | 1064 | 4562 | 208 | 94.2 | globlastp |
| WNU8_H621 | scabiosa\|11v1\|SRR063723X101062 | 1065 | 4563 | 208 | 94.2 | globlastp |
| WNU8_H622 | strawberry\|11v1\|CO382086 | 1066 | 4564 | 208 | 94.2 | globlastp |
| WNU8_H623 | sunflower\|12v1\|EL418188 | 1067 | 4565 | 208 | 94.2 | globlastp |
| WNU8_H624 | thalictrum\|11v1\|SRR096787X100511 | 1068 | 4566 | 208 | 94.2 | globlastp |
| WNU8_H625 | triphysaria\|10v1\|BM356801 | 1069 | 4567 | 208 | 94.2 | globlastp |
| WNU8_H626 | triphysaria\|10v1\|DR174744 | 1070 | 4568 | 208 | 94.2 | globlastp |
| WNU8_H627 | valeriana\|11v1\|SRR099039X115328 | 1071 | 4569 | 208 | 94.2 | globlastp |
| WNU8_H628 | vinca\|11v1\|SRR098690X100355 | 1072 | 4570 | 208 | 94.2 | globlastp |
| WNU8_H629 | vinca\|11v1\|SRR098690X100729 | 1073 | 4571 | 208 | 94.2 | globlastp |
| WNU8_H630 | watermelon\|11v1\|BTM17968633162350 | 1074 | 4572 | 208 | 94.2 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H500, WNU8_H614 | olea\|13v1\|SRR014463X10146D1_P1 | 1075 | 4556 | 208 | 94.2 | globlastp |
| WNU8_H610, WNU8_H997 | chickpea\|13v2\|SRR133517.120898_P1 | 1076 | 4542 | 208 | 94.2 | globlastp |
| WNU8_H1046 | switchgrass\|12v1\|FL854656_T1 | 1077 | 4573 | 208 | 94.18 | glotblastn |
| WNU8_H631 | ambrosia\|11v1\|SRR346935.194619_T1 | 1078 | 4574 | 208 | 94.18 | glotblastn |
| WNU8_H632 | b_juncea\|12v1\|E6ANDIZ01A09HC_T1 | 1079 | 4575 | 208 | 94.18 | glotblastn |
| WNU8_H633 | b_juncea\|12v1\|E6ANDIZ01BA83M_T1 | 1080 | 4576 | 208 | 94.18 | glotblastn |
| WNU8_H634 | beech\|11v1\|SRR006293.20105_T1 | 1081 | 4577 | 208 | 94.18 | glotblastn |
| WNU8_H635 | castorbean\|11v1\|RCPRD029589 | 1082 | 4578 | 208 | 94.18 | glotblastn |
| WNU8_H636 | gossypium_raimondii\|12v1\|GR12V1PRD009747_T1 | 1083 | 4579 | 208 | 94.18 | glotblastn |
| WNU8_H637 | phalaenopsis\|11v1\|CB032056_T1 | 1084 | 4580 | 208 | 94.18 | glotblastn |
| WNU8_H638 | poppy\|11v1\|SRR030267.285961_T1 | 1085 | 4581 | 208 | 94.18 | glotblastn |
| WNU8_H639 | gossypium_raimondii\|12v1\|SRR032367.1025615_T1 | 1086 | 4582 | 208 | 94.01 | glotblastn |
| WNU8_H640 | ambrosia\|11v1\|SRR346943.100746_P1 | 1087 | 4583 | 208 | 94 | globlastp |
| WNU8_H641 | aquilegia\|10v2\|DR920295_P1 | 1088 | 4584 | 208 | 94 | globlastp |
| WNU8_H642 | arnica\|11v1\|SRR099034X100789_P1 | 1089 | 4585 | 208 | 94 | globlastp |
| WNU8_H643 | b_juncea\|12v1\|E6ANDIZ01A00QZ_P1 | 1090 | 4586 | 208 | 94 | globlastp |
| WNU8_H644 | b_juncea\|12v1\|E6ANDIZ01A04RE_P1 | 1091 | 4586 | 208 | 94 | globlastp |
| WNU8_H645 | b_juncea\|12v1\|E6ANDIZ01A05I7_P1 | 1092 | 4587 | 208 | 94 | globlastp |
| WNU8_H646 | b_juncea\|12v1\|E6ANDIZ01A0DRC_P1 | 1093 | 4586 | 208 | 94 | globlastp |
| WNU8_H647 | b_juncea\|12v1\|E6ANDIZ01A1Q2C_P1 | 1094 | 4586 | 208 | 94 | globlastp |
| WNU8_H648 | b_juncea\|12v1\|E6ANDIZ01A1T4L_P1 | 1095 | 4586 | 208 | 94 | globlastp |
| WNU8_H649 | b_juncea\|12v1\|E6ANDIZ01A2YFN_P1 | 1096 | 4586 | 208 | 94 | globlastp |
| WNU8_H650 | b_juncea\|12v1\|E6ANDIZ01A3XGA_P1 | 1097 | 4586 | 208 | 94 | globlastp |
| WNU8_H651 | b_juncea\|12v1\|E6ANDIZ01A4TRW1_P1 | 1098 | 4586 | 208 | 94 | globlastp |
| WNU8_H652 | b_juncea\|12v1\|E6ANDIZ01A4TV2_P1 | 1099 | 4586 | 208 | 94 | globlastp |
| WNU8_H653 | b_juncea\|12v1\|E6ANDIZ01A6O5I_P1 | 1100 | 4586 | 208 | 94 | globlastp |
| WNU8_H654 | b_juncea\|12v1\|E6ANDIZ01A71DP_P1 | 1101 | 4586 | 208 | 94 | globlastp |
| WNU8_H655 | b_juncea\|12v1\|E6ANDIZ01A7UYD_P1 | 1102 | 4586 | 208 | 94 | globlastp |
| WNU8_H656 | b_juncea\|12v1\|E6ANDIZ01A8EX1_P1 | 1103 | 4586 | 208 | 94 | globlastp |
| WNU8_H657 | b_juncea\|12v1\|E6ANDIZ01A98K5_P1 | 1104 | 4586 | 208 | 94 | globlastp |
| WNU8_H658 | b_juncea\|12v1\|E6ANDIZ01AESP5_P1 | 1105 | 4586 | 208 | 94 | globlastp |
| WNU8_H659 | b_juncea\|12v1\|E6ANDIZ01AO6V5_P1 | 1106 | 4586 | 208 | 94 | globlastp |
| WNU8_H660 | b_juncea\|12v1\|E6ANDIZ01AR2C5_P1 | 1107 | 4586 | 208 | 94 | globlastp |
| WNU8_H661 | b_rapa\|11v1\|BG543067_P1 | 1108 | 4586 | 208 | 94 | globlastp |
| WNU8_H662 | b_rapa\|11v1\|BG543807_P1 | 1109 | 4586 | 208 | 94 | globlastp |
| WNU8_H663 | b_rapa\|11v1\|BNU21744_P1 | 1110 | 4586 | 208 | 94 | globlastp |
| WNU8_H664 | b_rapa\|11v1\|BQ791801_P1 | 1111 | 4586 | 208 | 94 | globlastp |
| WNU8_H665 | b_rapa\|11v1\|CD813870_P1 | 1112 | 4586 | 208 | 94 | globlastp |
| WNU8_H666 | b_rapa\|11v1\|L38205_P1 | 1113 | 4586 | 208 | 94 | globlastp |
| WNU8_H667 | canola\|11v1\|AI352739_P1 | 1114 | 4586 | 208 | 94 | globlastp |
| WNU8_H668 | canola\|11v1\|CB331912_P1 | 1115 | 4586 | 208 | 94 | globlastp |
| WNU8_H669 | canola\|11v1\|CN726590_P1 | 1116 | 4586 | 208 | 94 | globlastp |
| WNU8_H670 | canola\|11v1\|CN729818_P1 | 1117 | 4586 | 208 | 94 | globlastp |
| WNU8_H671 | canola\|11v1\|CN729909_P1 | 1118 | 4586 | 208 | 94 | globlastp |
| WNU8_H672 | canola\|11v1\|CN730343_P1 | 1119 | 4586 | 208 | 94 | globlastp |
| WNU8_H673 | canola\|11v1\|CN730658_P1 | 1120 | 4586 | 208 | 94 | globlastp |
| WNU8_H674 | canola\|11v1\|CN730882_P1 | 1121 | 4586 | 208 | 94 | globlastp |
| WNU8_H675 | canola\|11v1\|CN735190_P1 | 1122 | 4586 | 208 | 94 | globlastp |
| WNU8_H676 | canola\|11v1\|CN735423_P1 | 1123 | 4586 | 208 | 94 | globlastp |
| WNU8_H677 | canola\|11v1\|CN826026XX1_P1 | 1124 | 4586 | 208 | 94 | globlastp |
| WNU8_H678 | canola\|11v1\|CN826539_P1 | 1125 | 4586 | 208 | 94 | globlastp |
| WNU8_H679 | canola\|11v1\|CN827011_P1 | 1126 | 4586 | 208 | 94 | globlastp |
| WNU8_H680 | canola\|11v1\|CN827537_P1 | 1127 | 4586 | 208 | 94 | globlastp |
| WNU8_H681 | canola\|11v1\|CN828604_P1 | 1128 | 4586 | 208 | 94 | globlastp |
| WNU8_H682 | canola\|11v1\|DY001542_P1 | 1129 | 4586 | 208 | 94 | globlastp |
| WNU8_H683 | canola\|11v1\|DY002283_P1 | 1130 | 4586 | 208 | 94 | globlastp |
| WNU8_H684 | canola\|11v1\|DY010813_P1 | 1131 | 4586 | 208 | 94 | globlastp |
| WNU8_H685 | canola\|11v1\|EE476856_P1 | 1132 | 4586 | 208 | 94 | globlastp |
| WNU8_H686 | canola\|11v1\|EE551290_P1 | 1133 | 4586 | 208 | 94 | globlastp |
| WNU8_H687 | canola\|11v1\|EG020415_P1 | 1134 | 4586 | 208 | 94 | globlastp |
| WNU8_H688 | canola\|11v1\|SRR019557.37092_P1 | 1135 | 4586 | 208 | 94 | globlastp |
| WNU8_H689 | distylium\|11v1\|SRR065077X100439_P1 | 1136 | 4588 | 208 | 94 | globlastp |
| WNU8_H690 | epimedium\|11v1\|SRR013502.10405_P1 | 1137 | 4589 | 208 | 94 | globlastp |
| WNU8_H691 | euonymus\|11v1\|SRR070038X101785_P1 | 1138 | 4590 | 208 | 94 | globlastp |
| WNU8_H692 | euonymus\|11v1\|SRR070038X103768_P1 | 1139 | 4591 | 208 | 94 | globlastp |
| WNU8_H693 | marchantia\|gb166\|BJ841010_P1 | 1140 | 4592 | 208 | 94 | globlastp |
| WNU8_H694 | nasturtium\|11v1\|SRR032558.348984_P1 | 1141 | 4593 | 208 | 94 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H695 | oat\|11v1\|CN816326_P1 | 1142 | 4594 | 208 | 94 | globlastp |
| WNU8_H696 | oat\|11v1\|GO584378_P1 | 1143 | 4595 | 208 | 94 | globlastp |
| WNU8_H697 | oat\|11v1\|GO586922_P1 | 1144 | 4594 | 208 | 94 | globlastp |
| WNU8_H698 | oat\|11v1\|GR313243_P1 | 1145 | 4594 | 208 | 94 | globlastp |
| WNU8_H699 | oat\|11v1\|GR313302_P1 | 1146 | 4595 | 208 | 94 | globlastp |
| WNU8_H700 | oat\|11v1\|GR313710_P1 | 1147 | 4594 | 208 | 94 | globlastp |
| WNU8_H701 | poplar\|10v1\|AI166447 | 1148 | 4596 | 208 | 94 | globlastp |
| WNU8_H702 | sequoia\|10v1\|SRR065044S0000261 | 1149 | 4597 | 208 | 94 | globlastp |
| WNU8_H703 | taxus\|10v1\|SRR032523S0007597 | 1150 | 4598 | 208 | 94 | globlastp |
| WNU8_H723 | poplar\|13v1\|AI162399_P1 | 1151 | 4599 | 208 | 94 | globlastp |
| WNU8_H724 | poplar\|13v1\|AI165649_P1 | 1152 | 4600 | 208 | 94 | globlastp |
| WNU8_H704 | prunus\|10v1\|CN917657 | 1153 | 4601 | 208 | 93.99 | glotblastn |
| WNU8_H1047 | chickpea\|13v2\|SRR133517.120108_T1 | 1154 | 4602 | 208 | 93.97 | glotblastn |
| WNU8_H705 | castorbean\|11v1\|RCPRD007088 | 1155 | 4603 | 208 | 93.97 | glotblastn |
| WNU8_H706 | b_juncea\|12v1\|E6ANDIZ01AESGE_T1 | 1156 | 4604 | 208 | 93.96 | glotblastn |
| WNU8_H707 | banana\|12v1\|FL657364_T1 | 1157 | 4605 | 208 | 93.96 | glotblastn |
| WNU8_H708 | fraxinus\|11v1\|SRR058827.102633XX1_T1 | 1158 | 4606 | 208 | 93.96 | glotblastn |
| WNU8_H709 | maize\|10v1\|FL097864_T1 | 1159 | 4607 | 208 | 93.96 | glotblastn |
| WNU8_H710 | soybean\|11v1\|BE474039 | 1160 | 4608 | 208 | 93.96 | glotblastn |
| WNU8_H711 | soybean\|11v1\|BG839367 | 1161 | 4609 | 208 | 93.96 | glotblastn |
| WNU8_H712 | taxus\|10v1\|SRR065067S0001016 | 1162 | 4610 | 208 | 93.96 | glotblastn |
| WNU8_H713 | castorbean\|11v1\|SRR020784.101496 | 1163 | 4611 | 208 | 93.81 | glotblastn |
| WNU8_H1048 | monkeyflower\|12v1\|CV521399_P1 | 1164 | 4612 | 208 | 93.8 | globlastp |
| WNU8_H1049 | olea\|13v1\|SRR592583X197957D1_P1 | 1165 | 4613 | 208 | 93.8 | globlastp |
| WNU8_H714 | b_juncea\|12v1\|E6ANDIZ01A3EP6_P1 | 1166 | 4614 | 208 | 93.8 | globlastp |
| WNU8_H715 | b_juncea\|12v1\|E6ANDIZ01AQ7GF_P1 | 1167 | 4615 | 208 | 93.8 | globlastp |
| WNU8_H716 | b_rapa\|11v1\|BG544735_P1 | 1168 | 4616 | 208 | 93.8 | globlastp |
| WNU8_H717 | lettuce\|12v1\|BQ981354_P1 | 1169 | 4617 | 208 | 93.8 | globlastp |
| WNU8_H718 | medicago\|12v1\|CX524501_P1 | 1170 | 4618 | 208 | 93.8 | globlastp |
| WNU8_H719 | monkeyflower\|10v1\|CV521399 | 1171 | 4612 | 208 | 93.8 | globlastp |
| WNU8_H720 | pine\|10v2\|AW010032_P1 | 1172 | 4619 | 208 | 93.8 | globlastp |
| WNU8_H721 | pine\|10v2\|AW010442_P1 | 1173 | 4619 | 208 | 93.8 | globlastp |
| WNU8_H722 | plantago\|11v2\|SRR066373X111879_P1 | 1174 | 4620 | 208 | 93.8 | globlastp |
| WNU8_H723 | poplar\|10v1\|AI162399 | 1175 | 4621 | 208 | 93.8 | globlastp |
| WNU8_H724 | poplar\|10v1\|AI165649 | 1176 | 4622 | 208 | 93.8 | globlastp |
| WNU8_H725 | poplar\|10v1\|BI069666 | 1177 | 4623 | 208 | 93.8 | globlastp |
| WNU8_H725 | poplar\|13v1\|BI069666_P1 | 1178 | 4623 | 208 | 93.8 | globlastp |
| WNU8_H726 | sunflower\|12v1\|DY934396 | 1179 | 4624 | 208 | 93.8 | globlastp |
| WNU8_H727 | trigonella\|11v1\|SRR066194X124381 | 1180 | 4625 | 208 | 93.8 | globlastp |
| WNU8_H728 | ambrosia\|11v1\|SRR346935.275617_T1 | 1181 | 4626 | 208 | 93.76 | glotblastn |
| WNU8_H729 | b_juncea\|12v1\|E6ANDIZ01A3Y8Q_T1 | 1182 | 4627 | 208 | 93.74 | glotblastn |
| WNU8_H730 | oil_palm\|11v1\|EL684389XX2_T1 | 1183 | 4628 | 208 | 93.74 | glotblastn |
| WNU8_H731 | poppy\|11v1\|SRR030259.134858_T1 | 1184 | 4629 | 208 | 93.74 | glotblastn |
| WNU8_H732 | vinca\|11v1\|SRR098690X101781 | 1185 | 4630 | 208 | 93.74 | glotblastn |
| WNU8_H1050 | chickpea\|13v2\|SRR133517.233336_P1 | 1186 | 4631 | 208 | 93.7 | globlastp |
| WNU8_H1051 | zostera\|12v1\|SRR057351X102271D1_P1 | 1187 | 4632 | 208 | 93.7 | globlastp |
| WNU8_H733 | cephalotaxus\|11v1\|SRR064395X100427_P1 | 1188 | 4633 | 208 | 93.7 | globlastp |
| WNU8_H734 | euonymus\|11v1\|SRR070038X176037_P1 | 1189 | 4634 | 208 | 93.7 | globlastp |
| WNU8_H735 | gnetum\|10v1\|SRR064399S0001449_P1 | 1190 | 4635 | 208 | 93.7 | globlastp |
| WNU8_H736 | oil_palm\|11v1\|ES414440XX1_P1 | 1191 | 4636 | 208 | 93.7 | globlastp |
| WNU8_H737 | sciadopitys\|10v1\|SRR065035S0000206 | 1192 | 4637 | 208 | 93.7 | globlastp |
| WNU8_H738 | spruce\|11v1\|SRR064180X11301 | 1193 | 4638 | 208 | 93.7 | globlastp |
| WNU8_H739 | tripterygium\|11v1\|SRR098677X101200 | 1194 | 4639 | 208 | 93.7 | globlastp |
| WNU8_H740 | zostera\|10v1\|AM766058 | 1195 | 4632 | 208 | 93.7 | globlastp |
| WNU8_H741 | eucalyptus\|11v2\|CU397481_T1 | 1196 | 4640 | 208 | 93.54 | glotblastn |
| WNU8_H742 | thellungiella_halophilum\|11v1\|DN776912 | 1197 | 4641 | 208 | 93.54 | glotblastn |
| WNU8_H743 | aquilegia\|10v2\|CRPAC006620_T1 | 1198 | 4642 | 208 | 93.51 | glotblastn |
| WNU8_H744 | b_rapa\|11v1\|AM395184_T1 | 1199 | 4643 | 208 | 93.51 | glotblastn |
| WNU8_H745 | b_rapa\|11v1\|CX190853_T1 | 1200 | 4644 | 208 | 93.51 | glotblastn |
| WNU8_H746 | b_rapa\|11v1\|L37459_T1 | 1201 | 4645 | 208 | 93.51 | glotblastn |
| WNU8_H747 | cacao\|10v1\|CRPTC024018_T1 | 1202 | 4646 | 208 | 93.51 | glotblastn |
| WNU8_H748 | ceratodon\|10v1\|SRR074890S0073885_T1 | 1203 | 4647 | 208 | 93.51 | glotblastn |
| WNU8_H749 | oat\|11v1\|CN818507_T1 | 1204 | 4648 | 208 | 93.51 | glotblastn |
| WNU8_H750 | primula\|11v1\|SRR098679X221186_T1 | 1205 | 4649 | 208 | 93.51 | glotblastn |
| WNU8_H751 | primula\|11v1\|SRR098682X115682_T1 | 1206 | 4650 | 208 | 93.51 | glotblastn |
| WNU8_H752 | tomato\|11v1\|BI919315 | 1207 | 4651 | 208 | 93.51 | glotblastn |
| WNU8_H1052 | olea\|13v1\|SRR014463X22600D1_P1 | 1208 | 4652 | 208 | 93.5 | globlastp |
| WNU8_H753 | ceratodon\|10v1\|SRR074890S0003758_P1 | 1209 | 4653 | 208 | 93.5 | globlastp |
| WNU8_H754 | ceratodon\|10v1\|SRR074890S0004771_P1 | 1210 | 4653 | 208 | 93.5 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H755 | ceratodon\|10v1\|SRR074890S0005849_P1 | 1211 | 4653 | 208 | 93.5 | globlastp |
| WNU8_H756 | ceratodon\|10v1\|SRR074890S0006087_P1 | 1212 | 4653 | 208 | 93.5 | globlastp |
| WNU8_H757 | ceratodon\|10v1\|SRR074890S0018183_P1 | 1213 | 4653 | 208 | 93.5 | globlastp |
| WNU8_H758 | ceratodon\|10v1\|SRR074890S0020766_P1 | 1214 | 4653 | 208 | 93.5 | globlastp |
| WNU8_H759 | ceratodon\|10v1\|SRR074890S0027994_P1 | 1215 | 4653 | 208 | 93.5 | globlastp |
| WNU8_H760 | ceratodon\|10v1\|SRR074890S0031249_P1 | 1216 | 4653 | 208 | 93.5 | globlastp |
| WNU8_H761 | ceratodon\|10v1\|SRR074890S0033316_P1 | 1217 | 4653 | 208 | 93.5 | globlastp |
| WNU8_H762 | ceratodon\|10v1\|SRR074890S0046096_P1 | 1218 | 4653 | 208 | 93.5 | globlastp |
| WNU8_H763 | ceratodon\|10v1\|SRR074890S0048907_P1 | 1219 | 4653 | 208 | 93.5 | globlastp |
| WNU8_H764 | ceratodon\|10v1\|SRR074890S0386187_P1 | 1220 | 4653 | 208 | 93.5 | globlastp |
| WNU8_H765 | ceratodon\|10v1\|SRR074890S0537086_P1 | 1221 | 4653 | 208 | 93.5 | globlastp |
| WNU8_H766 | ceratodon\|10v1\|SRR074890S0648778_P1 | 1222 | 4653 | 208 | 93.5 | globlastp |
| WNU8_H767 | ceratodon\|10v1\|SRR074890S0653196_P1 | 1223 | 4653 | 208 | 93.5 | globlastp |
| WNU8_H768 | ceratodon\|10v1\|SRR074890S0680883_P1 | 1224 | 4653 | 208 | 93.5 | globlastp |
| WNU8_H769 | ceratodon\|10v1\|SRR074890S1275775_P1 | 1225 | 4653 | 208 | 93.5 | globlastp |
| WNU8_H770 | ceratodon\|10v1\|SRR074890S1284354_P1 | 1226 | 4653 | 208 | 93.5 | globlastp |
| WNU8_H771 | ceratodon\|10v1\|SRR074890S1349436_P1 | 1227 | 4653 | 208 | 93.5 | globlastp |
| WNU8_H772 | ceratodon\|10v1\|SRR074890S1778058_P1 | 1228 | 4653 | 208 | 93.5 | globlastp |
| WNU8_H773 | ceratodon\|10v1\|SRR074891S0984886_P1 | 1229 | 4653 | 208 | 93.5 | globlastp |
| WNU8_H774 | cucumber\|09v1\|CSCRP010330_P1 | 1230 | 4654 | 208 | 93.5 | globlastp |
| WNU8_H775 | eucalyptus\|11v2\|CT981337_P1 | 1231 | 4655 | 208 | 93.5 | globlastp |
| WNU8_H776 | fraxinus\|11v1\|SRR058827.10011_P1 | 1232 | 4656 | 208 | 93.5 | globlastp |
| WNU8_H777 | marchantia\|gb166\|C96106_P1 | 1233 | 4657 | 208 | 93.5 | globlastp |
| WNU8_H778 | medicago\|12v1\|AW329865_P1 | 1234 | 4658 | 208 | 93.5 | globlastp |
| WNU8_H779 | oil_palm\|11v1\|SRR190698.104132_P1 | 1235 | 4659 | 208 | 93.5 | globlastp |
| WNU8_H780 | olea\|11v1\|SRR014463.17060 | 1236 | 4660 | 208 | 93.5 | globlastp |
| WNU8_H803 | ambrosia\|11v1\|SRR346949.167891_T1 | 1262 | 4686 | 208 | 93.1 | globlastp |
| WNU8_H804 | b_rapa\|11v1\|L47954_P1 | 1263 | 4687 | 208 | 93.1 | globlastp |
| WNU8_H805 | bruguiera\|gb166\|AB073629_P1 | 1264 | 4688 | 208 | 93.1 | globlastp |
| WNU8_H806 | distylium\|11v1\|SRR065077X104496_P1 | 1265 | 4689 | 208 | 93.1 | globlastp |
| WNU8_H807 | millet\|10v1\|EVO454PM002208_P1 | 1266 | 4690 | 208 | 93.1 | globlastp |
| WNU8_H808 | sciadopitys\|10v1\|SRR065035S0001689 | 1267 | 4691 | 208 | 93.1 | globlastp |
| WNU8_H809 | spikemoss\|gb165\|FE427444 | 1268 | 4692 | 208 | 93.1 | globlastp |
| WNU8_H810 | ambrosia\|11v1\|GW917875_T1 | 1269 | 4693 | 208 | 93.06 | glotblastn |
| WNU8_H811 | ambrosia\|11v1\|SRR346935.107782_T1 | 1270 | 4694 | 208 | 93.06 | glotblastn |
| WNU8_H812 | canola\|11v1\|SRR329670.105751_T1 | 1271 | 4695 | 208 | 93.06 | glotblastn |
| WNU8_H813 | ceratodon\|10v1\|SRR074890S0034678_T1 | 1272 | 4696 | 208 | 93.06 | glotblastn |
| WNU8_H814 | ceratodon\|10v1\|SRR074890S0476895_T1 | 1273 | 4697 | 208 | 93.06 | glotblastn |
| WNU8_H815 | poppy\|11v1\|SRR030259.112775_T1 | 1274 | 4698 | 208 | 93.06 | glotblastn |
| WNU8_H816 | bean\|12v1\|PVPRD017895 | 1275 | 4699 | 208 | 92.9 | glotblastn |
| WNU8_H817 | canola\|11v1\|DY006918_P1 | 1276 | 4700 | 208 | 92.9 | globlastp |
| WNU8_H818 | flaveria\|11v1\|SRR149232.106901_P1 | 1277 | 4701 | 208 | 92.9 | globlastp |
| WNU8_H819 | b_rapa\|11v1\|CX271716_T1 | 1278 | 4702 | 208 | 92.89 | glotblastn |
| WNU8_H820 | flaveria\|11v1\|SRR149229.10363_T1 | 1279 | 4703 | 208 | 92.86 | glotblastn |
| WNU8_H821 | ceratodon\|10v1\|SRR074890S0009329_T1 | 1280 | 4704 | 208 | 92.84 | glotblastn |
| WNU8_H822 | ceratodon\|10v1\|SRR074890S0071772_T1 | 1281 | 4705 | 208 | 92.84 | glotblastn |
| WNU8_H823 | fraxinus\|11v1\|SRR058827.105562_T1 | 1282 | 4706 | 208 | 92.84 | glotblastn |
| WNU8_H824 | oil_palm\|11v1\|ES273650_P1 | 1283 | 4707 | 208 | 92.8 | globlastp |
| WNU8_H825 | physcomitrella\|10v1\|AW126661_P1 | 1284 | 4708 | 208 | 92.8 | globlastp |
| WNU8_H826 | physcomitrella\|10v1\|AW145494_P1 | 1285 | 4708 | 208 | 92.8 | globlastp |
| WNU8_H827 | physcomitrella\|10v1\|AW509897_P1 | 1286 | 4708 | 208 | 92.8 | globlastp |
| WNU8_H828 | physcomitrella\|10v1\|AW738891_P1 | 1287 | 4709 | 208 | 92.8 | globlastp |
| WNU8_H829 | ceratodon\|10v1\|SRR074890S0609797_P1 | 1288 | 4710 | 208 | 92.7 | globlastp |
| WNU8_H830 | millet\|10v1\|CD725988_P1 | 1289 | 4711 | 208 | 92.7 | globlastp |
| WNU8_H831 | pseudotsuga\|10v1\|GFXAY832556X1 | 1290 | 4712 | 208 | 92.7 | glotblastn |
| WNU8_H1054 | chickpea\|13v2\|SRR133517.249466_T1 | 1291 | 4713 | 208 | 92.68 | glotblastn |
| WNU8_H832 | ceratodon\|10v1\|SRR074890S0005119_T1 | 1292 | 4714 | 208 | 92.62 | glotblastn |
| WNU8_H833 | cucurbita\|11v1\|SRR091276X121433_T1 | 1293 | 4715 | 208 | 92.62 | glotblastn |
| WNU8_H834 | fraxinus\|11v1\|SRR058827.10879_T1 | 1294 | 4716 | 208 | 92.62 | glotblastn |
| WNU8_H835 | phalaenopsis\|11v1\|CB031989_T1 | 1295 | 4717 | 208 | 92.62 | glotblastn |
| WNU8_H836 | poppy\|11v1\|SRR030263.430570_T1 | 1296 | 4718 | 208 | 92.62 | glotblastn |
| WNU8_H837 | physcomitrella\|10v1\|AJ225418_P1 | 1297 | 4719 | 208 | 92.6 | globlastp |
| WNU8_H838 | physcomitrella\|10v1\|AW145551_P1 | 1298 | 4719 | 208 | 92.6 | globlastp |
| WNU8_H839 | physcomitrella\|10v1\|BJ160016_P1 | 1299 | 4720 | 208 | 92.6 | globlastp |
| WNU8_H840 | physcomitrella\|10v1\|BJ186660_P1 | 1300 | 4721 | 208 | 92.6 | globlastp |
| WNU8_H841 | canola\|11v1\|DY005831_P1 | 1301 | 4722 | 208 | 92.4 | globlastp |
| WNU8_H842 | canola\|11v1\|EE420703_T1 | 1302 | 4723 | 208 | 92.39 | glotblastn |
| WNU8_H843 | ceratodon\|10v1\|SRR074890S0004170_T1 | 1303 | 4724 | 208 | 92.39 | glotblastn |
| WNU8_H844 | cotton\|11v1\|CO132300_T1 | 1304 | 4725 | 208 | 92.39 | glotblastn |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H845 | phalaenopsis\|11v1\|SRR125771.1377153_P1 | 1305 | 4726 | 208 | 92.3 | globlastp |
| WNU8_H846 | ambrosia\|11v1\|SRR346935.202314_P1 | 1306 | 4727 | 208 | 92.2 | globlastp |
| WNU8_H847 | centaurea\|11v1\|EH788025_P1 | 1307 | 4728 | 208 | 92.2 | globlastp |
| WNU8_H848 | cucumber\|09v1\|AB029104_P1 | 1308 | 4729 | 208 | 92.2 | globlastp |
| WNU8_H849 | flaveria\|11v1\|SRR149229.294193XX2_P1 | 1309 | 4730 | 208 | 92.2 | globlastp |
| WNU8_H850 | ceratodon\|10v1\|SRR074890S0327696_P1 | 1310 | 4731 | 208 | 92 | globlastp |
| WNU8_H851 | ceratodon\|10v1\|SRR074890S0008588_T1 | 1311 | 4732 | 208 | 91.96 | glotblastn |
| WNU8_H852 | ambrosia\|11v1\|SRR346935.24735_T1 | 1312 | 4733 | 208 | 91.95 | glotblastn |
| WNU8_H853 | eschscholzia\|11v1\|CD478773_T1 | 1313 | 4734 | 208 | 91.72 | glotblastn |
| WNU8_H854 | ambrosia\|11v1\|SRR346935.100197_P1 | 1314 | 4735 | 208 | 91.7 | globlastp |
| WNU8_H855 | trigonella\|11v1\|SRR066194X118591 | 1315 | 4736 | 208 | 91.7 | globlastp |
| WNU8_H856 | ceratodon\|10v1\|SRR074890S0010775_T1 | 1316 | 4737 | 208 | 91.52 | glotblastn |
| WNU8_H857 | poppy\|11v1\|SRR030261.55346_P1 | 1317 | 4738 | 208 | 91.5 | globlastp |
| WNU8_H858 | ceratodon\|10v1\|SRR074890S0104947_P1 | 1318 | 4739 | 208 | 91.3 | globlastp |
| WNU8_H859 | wheat\|12v3\|BF201530 | 1319 | 4740 | 208 | 91.3 | globlastp |
| WNU8_H860 | ambrosia\|11v1\|SRR346935.365378_T1 | 1320 | 4741 | 208 | 91.28 | glotblastn |
| WNU8_H861 | gossypium_raimondii\|12v1\|BG445555_T1 | 1321 | 4742 | 208 | 91.28 | glotblastn |
| WNU8_H862 | oak\|10v1\|DB998061_T1 | 1322 | 4743 | 208 | 91.28 | glotblastn |
| WNU8_H863 | sunflower\|12v1\|CF094003 | 1323 | 4744 | 208 | 91.28 | glotblastn |
| WNU8_H864 | flaveria\|11v1\|SRR149229.180096_P1 | 1324 | 4745 | 208 | 91.1 | globlastp |
| WNU8_H865 | pteridium\|11v1\|GW575201 | 1325 | 4746 | 208 | 91.1 | globlastp |
| WNU8_H866 | rye\|12v1\|DRR001012.135089 | 1326 | 4747 | 208 | 91.1 | globlastp |
| WNU8_H867 | utricularia\|11v1\|SRR094438.100291 | 1327 | 4748 | 208 | 90.9 | globlastp |
| WNU8_H868 | canola\|11v1\|EE540074_T1 | 1328 | 4749 | 208 | 90.83 | glotblastn |
| WNU8_H869 | ambrosia\|11v1\|SRR346935.122905_T1 | 1329 | 4750 | 208 | 90.6 | glotblastn |
| WNU8_H870 | rye\|12v1\|DRR001012.115547 | 1330 | 4751 | 208 | 90.6 | globlastp |
| WNU8_H871 | ambrosia\|11v1\|SRR346943.132429_P1 | 1331 | 4752 | 208 | 90.4 | globlastp |
| WNU8_H872 | oak\|10v1\|CU657890_P1 | 1332 | 4753 | 208 | 90.4 | globlastp |
| WNU8_H873 | artemisia\|10v1\|SRR019254S0035817_T1 | 1333 | 4754 | 208 | 90.38 | glotblastn |
| WNU8_H874 | gossypium_raimondii\|12v1\|FE896850_T1 | 1334 | 4755 | 208 | 90.38 | glotblastn |
| WNU8_H875 | ambrosia\|11v1\|SRR346935.118240_P1 | 1335 | 4756 | 208 | 90.3 | globlastp |
| WNU8_H876 | medicago\|12v1\|CB892601_P1 | 1336 | 4757 | 208 | 90.3 | globlastp |
| WNU8_H877 | amorphophallus\|11v2\|SRR089351X12124_T1 | 1337 | 4758 | 208 | 90.27 | glotblastn |
| WNU8_H878 | oat\|11v1\|GO586059_P1 | 1338 | 4759 | 208 | 90.2 | globlastp |
| WNU8_H879 | fraxinus\|11v1\|SRR058827.106715_T1 | 1339 | 4760 | 208 | 90.18 | glotblastn |
| WNU8_H880 | aquilegia\|10v2\|DR926759_P1 | 1340 | 4761 | 208 | 89.9 | globlastp |
| WNU8_H881 | b_rapa\|11v1\|EE534476_T1 | 1341 | 4762 | 208 | 89.71 | glotblastn |
| WNU8_H882 | strawberry\|11v1\|SRR034859S0001435 | 1342 | 4763 | 208 | 89.71 | glotblastn |
| WNU8_H883 | millet\|10v1\|EVO454PM023538_P1 | 1343 | 4764 | 208 | 89.7 | globlastp |
| WNU8_H1055 | chickpea\|13v2\|SRR133517.18034_T1 | 1344 | 4765 | 208 | 89.65 | glotblastn |
| WNU8_H884 | flaveria\|11v1\|SRR149229.2566_P1 | 1345 | 4766 | 208 | 89.5 | globlastp |
| WNU8_H885 | millet\|10v1\|CD724605_T1 | 1346 | 4767 | 208 | 89.49 | glotblastn |
| WNU8_H886 | b_juncea\|12v1\|E6ANDIZ01ANL2J_P1 | 1347 | 4768 | 208 | 89.4 | globlastp |
| WNU8_H887 | rye\|12v1\|BE586334 | 1348 | 4769 | 208 | 89.3 | globlastp |
| WNU8_H888 | rye\|12v1\|DRR001012.109643 | 1349 | 4769 | 208 | 89.3 | globlastp |
| WNU8_H889 | millet\|10v1\|EVO454PM261173_T1 | 1350 | 4770 | 208 | 89.04 | glotblastn |
| WNU8_H890 | canola\|11v1\|CN730466_P1 | 1351 | 4771 | 208 | 88.9 | globlastp |
| WNU8_H891 | curcuma\|10v1\|DY383453_T1 | 1352 | 4772 | 208 | 88.81 | glotblastn |
| WNU8_H892 | rye\|12v1\|DRR001012.420786 | 1353 | 4773 | 208 | 88.81 | glotblastn |
| WNU8_H893 | tobacco\|gb162\|AF120093 | 1354 | 4774 | 208 | 88.7 | globlastp |
| WNU8_H894 | canola\|11v1\|DY001946_P1 | 1355 | 4775 | 208 | 88.3 | globlastp |
| WNU8_H895 | rye\|12v1\|BE494657 | 1356 | 4776 | 208 | 88.2 | globlastp |
| WNU8_H896 | solanum_phureja\|09v1\|SPHR28725 | 1357 | 4777 | 208 | 88.17 | glotblastn |
| WNU8_H897 | cotton\|11v1\|BG447263_P1 | 1358 | 4778 | 208 | 88.1 | globlastp |
| WNU8_H898 | ceratodon\|10v1\|SSRR074890S0038570_T1 | 1359 | 4779 | 208 | 87.97 | glotblastn |
| WNU8_H899 | pine\|10v2\|AA556685_T1 | 1360 | 4780 | 208 | 87.92 | glotblastn |
| WNU8_H900 | pine\|10v2\|CD020050_T1 | 1361 | 4780 | 208 | 87.92 | glotblastn |
| WNU8_H901 | rye\|12v1\|DRR001012.248566 | 1362 | 4781 | 208 | 87.9 | globlastp |
| WNU8_H902 | oak\|10v1\|DB998952_P1 | 1363 | 4782 | 208 | 87.7 | globlastp |
| WNU8_H903 | wheat\|12v3\|BI751305 | 1364 | 4783 | 208 | 87.69 | glotblastn |
| WNU8_H904 | wheat\|12v3\|BE407061 | 1365 | 4784 | 208 | 87 | globlastp |
| WNU8_H905 | poppy\|11v1\|SRR030265.155045_T1 | 1366 | 4785 | 208 | 86.67 | glotblastn |
| WNU8_H906 | canola\|11v1\|SRR019559.16344_T1 | 1367 | 4786 | 208 | 86.58 | glotblastn |
| WNU8_H907 | arabidopsis_lyrata\|09v1\|JGIAL000755_P1 | 1368 | 4787 | 208 | 86.5 | globlastp |
| WNU8_H908 | flaveria\|11v1\|SRR149232.37699_T1 | 1369 | 4788 | 208 | 86.41 | glotblastn |
| WNU8_H909 | fraxinus\|11v1\|SRR058827.109980_P1 | 1370 | 4789 | 208 | 86.4 | globlastp |
| WNU8_H910 | canola\|11v1\|SRR001111.56668_T1 | 1371 | 4790 | 208 | 86.35 | glotblastn |
| WNU8_H911 | wheat\|12v3\|BE418902 | 1372 | 4791 | 208 | 86.3 | globlastp |
| WNU8_H912 | ceratodon\|10v1\|SSRR074890S0013208_T1 | 1373 | 4792 | 208 | 86.13 | glotblastn |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H913 | foxtail_millet\|11v3\|SIPRD012298_T1 | 1374 | 4793 | 208 | 86.12 | glotblastn |
| WNU8_H914 | b_juncea\|12v1\|E6ANDIZ01A0SLK_P1 | 1375 | 4794 | 208 | 86.1 | globlastp |
| WNU8_H915 | cotton\|11v1\|ES813128_P1 | 1376 | 4795 | 208 | 86.1 | globlastp |
| WNU8_H916 | millet\|10v1\|EVO454PM014933_P1 | 1377 | 4796 | 208 | 86.1 | globlastp |
| WNU8_H917 | wheat\|12v3\|BE500164 | 1378 | 4797 | 208 | 86.1 | globlastp |
| WNU8_H918 | maize\|10v1\|BT016906_T1 | 1379 | 4798 | 208 | 86 | glotblastn |
| WNU8_H919 | millet\|10v1\|EVO454PM094844_P1 | 1380 | 4799 | 208 | 85.9 | globlastp |
| WNU8_H920 | poppy\|11v1\|SRR096789.106870_P1 | 1381 | 4800 | 208 | 85.9 | globlastp |
| WNU8_H921 | eschscholzia\|11v1\|CD479225_P1 | 1382 | 4801 | 208 | 85.7 | globlastp |
| WNU8_H922 | rye\|12v1\|BE705268 | 1383 | 4802 | 208 | 85.7 | globlastp |
| WNU8_H923 | trigonella\|11v1\|SRR066195X227497 | 1384 | 4803 | 208 | 85.7 | globlastp |
| WNU8_H924 | oak\|10v1\|CU639938_P1 | 1385 | 4804 | 208 | 85.5 | globlastp |
| WNU8_H1056 | nicotiana_benthamiana\|12v1\|AF154660_T1 | 1386 | 4805 | 208 | 85.34 | glotblastn |
| WNU8_H1057 | switchgrass\|12v1\|FE599218_P1 | 1387 | 4806 | 208 | 85.2 | globlastp |
| WNU8_H925 | eschscholzia\|11v1\|CD479412_P1 | 1388 | 4807 | 208 | 85.2 | globlastp |
| WNU8_H926 | oak\|10v1\|FP029259_P1 | 1389 | 4808 | 208 | 85.2 | globlastp |
| WNU8_H927 | rye\|12v1\|DRR001013.218454 | 1390 | 4809 | 208 | 85.01 | glotblastn |
| WNU8_H928 | cotton\|11v1\|BE054260_P1 | 1391 | 4810 | 208 | 85 | globlastp |
| WNU8_H929 | eschscholzia\|11v1\|CV000181_P1 | 1392 | 4811 | 208 | 85 | globlastp |
| WNU8_H930 | foxtail_millet\|11v3\|PHY7SI030042M_P1 | 1393 | 4812 | 208 | 85 | globlastp |
| WNU8_H931 | flaveria\|11v1\|SRR149232.101059_P1 | 1394 | 4813 | 208 | 84.9 | globlastp |
| WNU8_H932 | flaveria\|11v1\|SRR149232.113793_P1 | 1395 | 4814 | 208 | 84.9 | globlastp |
| WNU8_H933 | banana\|12v1\|HQ853243_T1 | 1396 | 4815 | 208 | 84.86 | glotblastn |
| WNU8_H934 | amorphophallus\|11v2\|SRR089351X102337_P1 | 1397 | 4816 | 208 | 84.8 | globlastp |
| WNU8_H935 | flaveria\|11v1\|SRR149229.124813_P1 | 1398 | 4817 | 208 | 84.8 | globlastp |
| WNU8_H936 | millet\|10v1\|EVO454PM040965_P1 | 1399 | 4818 | 208 | 84.8 | globlastp |
| WNU8_H937 | poppy\|11v1\|SRR096789.103347_P1 | 1400 | 4819 | 208 | 84.8 | globlastp |
| WNU8_H938 | thalictrum\|11v1\|SRR096787X100429 | 1401 | 4820 | 208 | 84.79 | glotblastn |
| WNU8_H939 | ambrosia\|11v1\|GR935679_P1 | 1402 | 4821 | 208 | 84.6 | globlastp |
| WNU8_H940 | ambrosia\|11v1\|SRR346943.103270_P1 | 1403 | 4821 | 208 | 84.6 | globlastp |
| WNU8_H941 | pineapple\|10v1\|DT336013_P1 | 1404 | 4822 | 208 | 84.6 | globlastp |
| WNU8_H942 | poppy\|11v1\|SRR096789.101574_P1 | 1405 | 4823 | 208 | 84.6 | globlastp |
| WNU8_H943 | trigonella\|11v1\|SRR066194X102555 | 1406 | 4824 | 208 | 84.6 | globlastp |
| WNU8_H944 | salvia\|10v1\|CV162295 | 1407 | 4825 | 208 | 84.4 | globlastp |
| WNU8_H945 | flaveria\|11v1\|SRR149229.176629_T1 | 1408 | 4826 | 208 | 84.34 | glotblastn |
| WNU8_H946 | sunflower\|12v1\|CD848771 | 1409 | 4827 | 208 | 84.2 | globlastp |
| WNU8_H947 | eschscholzia\|11v1\|CD478050_T1 | 1410 | 4828 | 208 | 84.12 | glotblastn |
| WNU8_H948 | primula\|11v1\|SRR098679X101476_T1 | 1411 | 4829 | 208 | 84.07 | glotblastn |
| WNU8_H1058 | switchgrass\|12v1\|DN142142_P1 | 1412 | 4830 | 208 | 83.9 | globlastp |
| WNU8_H949 | ambrosia\|11v1\|SRR346935.258794_P1 | 1413 | 4831 | 208 | 83.9 | globlastp |
| WNU8_H950 | b_juncea\|12v1\|E6ANDIZ01A06P6_T1 | 1414 | 4832 | 208 | 83.89 | glotblastn |
| WNU8_H951 | millet\|10v1\|EB410919_P1 | 1415 | 4833 | 208 | 83.7 | globlastp |
| WNU8_H952 | poppy\|11v1\|SRR030259.104199_P1 | 1416 | 4834 | 208 | 83.7 | globlastp |
| WNU8_H953 | rye\|12v1\|DRR001012.472868 | 1417 | 4835 | 208 | 83.7 | globlastp |
| WNU8_H954 | tobacco\|gb162\|EB442628 | 1418 | 4836 | 208 | 83.7 | globlastp |
| WNU8_H955 | ambrosia\|11v1\|SRR346935.272068_T1 | 1419 | 4837 | 208 | 83.67 | glotblastn |
| WNU8_H956 | phalaenopsis\|11v1\|SRR125771.1004285_T1 | 1420 | 4838 | 208 | 83.67 | glotblastn |
| WNU8_H957 | canola\|11v1\|EE503309_T1 | 1421 | 4839 | 208 | 83.59 | glotblastn |
| WNU8_H1059 | poplar\|13v1\|SRR037106.322926_T1 | 1422 | 4840 | 208 | 83.5 | glotblastn |
| WNU8_H958 | utricularia\|11v1\|SRR094438.101387 | 1423 | 4841 | 208 | 83.5 | globlastp |
| WNU8_H959 | euonymus\|11v1\|SRR070038X11029_P1 | 1424 | 4842 | 208 | 83.4 | globlastp |
| WNU8_H960 | flaveria\|11v1\|SRR149232.121875_P1 | 1425 | 4843 | 208 | 83.4 | globlastp |
| WNU8_H961 | b_juncea\|12v1\|E6ANDIZ01A3F2Z_P1 | 1426 | 4844 | 208 | 83.3 | globlastp |
| WNU8_H962 | banana\|12v1\|ES432203_T1 | 1427 | 4845 | 208 | 83.22 | glotblastn |
| WNU8_H963 | wheat\|12v3\|BQ245085 | 1428 | 4846 | 208 | 83.22 | glotblastn |
| WNU8_H1060 | chickpea\|13v2\|GR917090_P1 | 1429 | 4847 | 208 | 83 | globlastp |
| WNU8_H964 | rye\|12v1\|DRR001012.144376 | 1430 | 4848 | 208 | 83 | globlastp |
| WNU8_H965 | rye\|12v1\|DRR001012.167511 | 1431 | 4849 | 208 | 83 | globlastp |
| WNU8_H966 | rye\|12v1\|DRR001012.727979 | 1432 | 4849 | 208 | 83 | globlastp |
| WNU8_H967 | eschscholzia\|11v1\|CD481374_P1 | 1433 | 4850 | 208 | 82.8 | globlastp |
| WNU8_H968 | primula\|11v1\|SRR098680X105746_P1 | 1434 | 4851 | 208 | 82.8 | globlastp |
| WNU8_H969 | ambrosia\|11v1\|SRR346935.110894_T1 | 1435 | 4852 | 208 | 82.77 | glotblastn |
| WNU8_H970 | cephalotaxus\|11v1\|SRR064395X10013_P1 | 1436 | 4853 | 208 | 82.6 | globlastp |
| WNU8_H971 | euonymus\|11v1\|SRR070038X103334_P1 | 1437 | 4854 | 208 | 82.6 | globlastp |
| WNU8_H972 | pineapple\|10v1\|DT335789_P1 | 1438 | 4855 | 208 | 82.6 | globlastp |
| WNU8_H1061 | switchgrass\|12v1\|PVJGIV8051000_T1 | 1439 | 4856 | 208 | 82.55 | glotblastn |
| WNU8_H973 | chelidonium\|11v1\|SRR084752X107771_T1 | 1440 | 4857 | 208 | 82.1 | glotblastn |
| WNU8_H974 | curcuma\|10v1\|DY388837_P1 | 1441 | 4858 | 208 | 82.1 | globlastp |
| WNU8_H975 | rye\|12v1\|BF146130 | 1442 | 4859 | 208 | 82.1 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU8_H976 | vinca\|11v1\|SRR098690X100048 | 1443 | 4860 | 208 | 82.1 | globlastp |
| WNU8_H1062 | chickpea\|13v2\|SRR133517.728325_T1 | 1444 | 4861 | 208 | 82.03 | globlastn |
| WNU8_H1063 | chickpea\|13v2\|SRR133517.1159_T1 | 1445 | 4862 | 208 | 81.97 | globlastn |
| WNU8_H977 | eschscholzia\|11v1\|CD476820_P1 | 1446 | 4863 | 208 | 81.9 | globlastp |
| WNU8_H978 | utricularia\|11v1\|SRR094438.103690 | 1447 | 4864 | 208 | 81.9 | globlastp |
| WNU8_H979 | rye\|12v1\|DRR001012.558136 | 1448 | 4865 | 208 | 81.88 | globlastn |
| WNU8_H980 | wheat\|12v3\|CA484380 | 1449 | 4866 | 208 | 81.88 | globlastn |
| WNU8_H981 | canola\|11v1\|BNU21744XX1_P1 | 1450 | 4867 | 208 | 81.4 | globlastp |
| WNU8_H982 | poppy\|11v1\|SRR096789.100249_P1 | 1451 | 4868 | 208 | 81.4 | globlastp |
| WNU8_H983 | wheat\|12v3\|AL822116 | 1452 | 4869 | 208 | 81.29 | globlastn |
| WNU8_H984 | cotton\|11v1\|ES822536_T1 | 1453 | 4870 | 208 | 81.25 | globlastn |
| WNU8_H985 | lovegrass\|gb167\|EH185033_T1 | 1454 | 4871 | 208 | 81.21 | globlastn |
| WNU8_H986 | b_juncea\|12v1\|E6ANDIZ01BSCGA_P1 | 1455 | 4872 | 208 | 81.2 | globlastp |
| WNU8_H987 | parthenium\|10v1\|GW779513_P1 | 1456 | 4873 | 208 | 81.2 | globlastp |
| WNU8_H988 | orobanche\|10v1\|SSRR023189S0001008_P1 | 1457 | 4874 | 208 | 81.1 | globlastp |
| WNU8_H989 | poppy\|11v1\|SRR030260.128199_T1 | 1458 | 4875 | 208 | 81.06 | globlastn |
| WNU8_H990 | flaveria\|11v1\|SRR149239.161671_P1 | 1459 | 4876 | 208 | 81 | globlastp |
| WNU8_H991 | marchantia\|gb166\|BJ848715_P1 | 1460 | 4877 | 208 | 81 | globlastp |
| WNU8_H992 | podocarpus\|10v1\|SSRR065014S0001888_P1 | 1461 | 4878 | 208 | 81 | globlastp |
| WNU8_H993 | canola\|11v1\|EV196524XX2_T1 | 1462 | 4879 | 208 | 80.98 | globlastn |
| WNU8_H994 | flaveria\|11v1\|SRR149241.119767_T1 | 1463 | 4880 | 208 | 80.76 | globlastn |
| WNU8_H995 | beech\|11v1\|SRR006293.10304_P1 | 1464 | 4881 | 208 | 80.4 | globlastp |
| WNU8_H996 | canola\|11v1\|SRR019556.19904_P1 | 1465 | 4882 | 208 | 80.4 | globlastp |
| WNU8_H997 | chickpea\|11v1\|AY112726 | 1466 | 4883 | 208 | 80.4 | globlastp |
| WNU8_H998 | canola\|11v1\|EE405799XX2_T1 | 1467 | 4884 | 208 | 80.31 | globlastn |
| WNU8_H999 | canola\|11v1\|SRR329661.125622_T1 | 1468 | 4885 | 208 | 80.31 | globlastn |
| WNU9_H1 | leymus\|gb166\|EG398632_P1 | 1469 | 4886 | 209 | 95.5 | globlastp |
| WNU9_H2 | wheat\|12v3\|AL822016 | 1470 | 4887 | 209 | 95.5 | globlastp |
| WNU9_H3 | rye\|12v1\|DRR001012.199117 | 1471 | 4888 | 209 | 93.47 | globlastn |
| WNU9_H4 | oat\|11v1\|GO598730_P1 | 1472 | 4889 | 209 | 86.1 | globlastp |
| WNU9_H5 | brachypodium\|12v1\|BRADI3G57060_P1 | 1473 | 4890 | 209 | 83.4 | globlastp |
| WNU9_H12 | switchgrass\|12v1\|FE624489_P1 | 1474 | 4891 | 209 | 82.5 | globlastp |
| WNU9_H6 | switchgrass\|gb167\|FE624489 | 1475 | 4892 | 209 | 82.5 | globlastp |
| WNU9_H13 | switchgrass\|12v1\|FE635297_P1 | 1476 | 4893 | 209 | 81.5 | globlastp |
| WNU9_H7 | maize\|10v1\|AI677093_P1 | 1477 | 4894 | 209 | 81.5 | globlastp |
| WNU9_H8 | switchgrass\|gb167\|FE607705 | 1478 | 4895 | 209 | 81.5 | globlastp |
| WNU9_H9 | sorghum\|12v1\|SB04G029010 | 1479 | 4896 | 209 | 81 | globlastp |
| WNU9_H10 | rice\|11v1\|AU065182 | 1480 | 4897 | 209 | 80.4 | globlastp |
| WNU9_H11 | foxtail_millet\|11v3\|PHY7SI018400M_P1 | 1481 | 4898 | 209 | 80 | globlastp |
| WNU10_H2 | brachypodium\|12v1\|BRADI3G58320_P1 | 1482 | 4899 | 210 | 88.4 | globlastp |
| WNU10_H11 | wheat\|12v3\|BQ237924 | 1483 | 4900 | 210 | 88.3 | globlastp |
| WNU10_H3 | brachypodium\|12v1\|BRADI3G58327_P1 | 1484 | 4901 | 210 | 86.4 | globlastp |
| WNU10_H5 | rice\|11v1\|AA750675 | 1485 | 4902 | 210 | 83.2 | globlastp |
| WNU10_H6 | foxtail_millet\|11v3\|PHY7SI016581M_P1 | 1486 | 4903 | 210 | 81.2 | globlastp |
| WNU10_H8 | switchgrass\|gb167\|DN141218 | 1487 | 4904 | 210 | 81.1 | globlastp |
| WNU10_H14 | switchgrass\|12v1\|DN141218_P1 | 1488 | 4905 | 210 | 80.9 | globlastp |
| WNU10_H15 | switchgrass\|12v1\|FE632994_P1 | 1489 | 4906 | 210 | 80.9 | globlastp |
| WNU10_H7 | sorghum\|12v1\|SB04G033850 | 1490 | 4907 | 210 | 80.8 | globlastp |
| WNU11_H1 | wheat\|12v3\|CA642552 | 1491 | 4908 | 211 | 92.7 | globlastp |
| WNU11_H2 | wheat\|12v3\|BQ245800 | 1492 | 4909 | 211 | 91.8 | globlastp |
| WNU11_H3 | wheat\|12v3\|BE419463 | 1493 | 4910 | 211 | 90.9 | globlastp |
| WNU11_H4 | rye\|12v1\|DRR001012.174712 | 1494 | 4911 | 211 | 90.1 | globlastp |
| WNU11_H5 | rye\|12v1\|DRR001012.157939 | 1495 | 4912 | 211 | 89.2 | globlastp |
| WNU11_H6 | lolium\|10v1\|AU247649_P1 | 1496 | 4913 | 211 | 86.5 | globlastp |
| WNU11_H7 | oat\|11v1\|CN817037_P1 | 1497 | 4914 | 211 | 85.6 | globlastp |
| WNU11_H8 | oat\|11v1\|GR333192_P1 | 1498 | 4914 | 211 | 85.6 | globlastp |
| WNU13_H1 | brachypodium\|12v1\|BRADI4G44997_T1 | 1499 | 4915 | 213 | 85.16 | globlastn |
| WNU13_H2 | wheat\|12v3\|AL817063 | 1500 | 4916 | 213 | 82.5 | globlastp |
| WNU13_H3 | rye\|12v1\|DRR001012.156654 | 1501 | 4917 | 213 | 82.3 | globlastp |
| WNU13_H4 | switchgrass\|12v1\|DN145145_T1 | 1502 | 4918 | 213 | 80.09 | globlastn |
| WNU14_H1 | wheat\|12v3\|BI479735 | 1503 | 4919 | 214 | 97.7 | globlastp |
| WNU14_H2 | rye\|12v1\|DRR001012.102019 | 1504 | 4920 | 214 | 97.1 | globlastp |
| WNU14_H3 | rye\|12v1\|DRR001012.115426 | 1505 | 4921 | 214 | 97.1 | globlastp |
| WNU14_H4 | rye\|12v1\|DRR001012.156071 | 1506 | 4922 | 214 | 90.08 | globlastp |
| WNU15_H1 | rye\|12v1\|DRR001012.112543 | 1507 | 4923 | 215 | 93 | globlastp |
| WNU15_H2 | wheat\|12v3\|BE404360 | 1508 | 4924 | 215 | 92.99 | globlastn |
| WNU15_H3 | wheat\|12v3\|BE422752 | 1509 | 4925 | 215 | 92.8 | globlastp |
| WNU15_H4 | wheat\|12v3\|BM134630 | 1510 | 4926 | 215 | 92.8 | globlastn |
| WNU15_H5 | oat\|11v1\|CN820180_P1 | 1511 | 4927 | 215 | 85.4 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU15_H6 | brachypodium\|12v1\|BRADI2G17000_P1 | 1512 | 4928 | 215 | 83.4 | globlastp |
| WNU16_H1 | wheat\|12v3\|CA501314 | 1513 | 4929 | 216 | 97.2 | globlastp |
| WNU16_H2 | leymus\|gb166\|EG390149_P1 | 1514 | 4930 | 216 | 92.3 | globlastp |
| WNU16_H4 | switchgrass\|12v1\|FE626303_P1 | 1515 | 4931 | 216 | 80.9 | globlastp |
| WNU16_H5 | switchgrass\|12v1\|FL841650_P1 | 1516 | 4932 | 216 | 80.3 | globlastp |
| WNU16_H3 | switchgrass\|gb167\|FL841650 | 1517 | 4933 | 216 | 80.3 | globlastp |
| WNU17_H1 | wheat\|12v3\|BE414307 | 1518 | 217 | 217 | 100 | globlastp |
| WNU17_H2 | wheat\|12v3\|BE427605 | 1519 | 217 | 217 | 100 | globlastp |
| WNU17_H3 | brachypodium\|12v1\|BRADI2G16770_P1 | 1520 | 4934 | 217 | 99.3 | globlastp |
| WNU17_H4 | fescue\|gb161\|DT688428_P1 | 1521 | 4935 | 217 | 99.3 | globlastp |
| WNU17_H5 | oat\|11v1\|GR340361_P1 | 1522 | 4935 | 217 | 99.3 | globlastp |
| WNU17_H6 | oat\|11v1\|GR349432_P1 | 1523 | 4935 | 217 | 99.3 | globlastp |
| WNU17_H7 | rye\|12v1\|DRR001012.157480 | 1524 | 4936 | 217 | 99.3 | globlastp |
| WNU17_H8 | canola\|11v1\|CN730363_T1 | 1525 | 4937 | 217 | 98.04 | glotblastn |
| WNU17_H9 | b_juncea\|12v1\|E6ANDIZ02FND41_P1 | 1526 | 4938 | 217 | 98 | globlastp |
| WNU17_H10 | b_rapa\|11v1\|CN730363_P1 | 1527 | 4938 | 217 | 98 | globlastp |
| WNU17_H11 | b_rapa\|11v1\|L47869_P1 | 1528 | 4939 | 217 | 98 | globlastp |
| WNU17_H12 | barley\|12v1\|BI946826_P1 | 1529 | 4940 | 217 | 98 | globlastp |
| WNU17_H13 | canola\|11v1\|CN730530_P1 | 1530 | 4939 | 217 | 98 | globlastp |
| WNU17_H14 | leymus\|gb166\|EG374708_P1 | 1531 | 4940 | 217 | 98 | globlastp |
| WNU17_H15 | millet\|10v1\|EVO454PM003141_P1 | 1532 | 4941 | 217 | 98 | globlastp |
| WNU17_H16 | millet\|10v1\|EVO454PM089657_P1 | 1533 | 4941 | 217 | 98 | globlastp |
| WNU17_H17 | oat\|11v1\|GR342863_P1 | 1534 | 4940 | 217 | 98 | globlastp |
| WNU17_H18 | pseudoroegneria\|gb167\|FF340632 | 1535 | 4940 | 217 | 98 | globlastp |
| WNU17_H19 | rye\|12v1\|BE705287 | 1536 | 4940 | 217 | 98 | globlastp |
| WNU17_H20 | rye\|12v1\|CD453254 | 1537 | 4940 | 217 | 98 | globlastp |
| WNU17_H21 | wheat\|12v3\|BE402224 | 1538 | 4940 | 217 | 98 | globlastp |
| WNU17_H22 | wheat\|12v3\|BE404292 | 1539 | 4940 | 217 | 98 | globlastp |
| WNU17_H433 | monkeyflower\|12v1\|DV210516_P1 | 1540 | 4942 | 217 | 97.4 | globlastp |
| WNU17_H23 | arabidopsis_lyrata\|09v1\|JGIAL001776_P1 | 1541 | 4942 | 217 | 97.4 | globlastp |
| WNU17_H24 | arabidopsis\|10v1\|AT1G16890_P1 | 1542 | 4942 | 217 | 97.4 | globlastp |
| WNU17_H25 | b_juncea\|12v1\|E6ANDIZ01A5B07_P1 | 1543 | 4942 | 111 | 97.4 | globlastp |
| WNU17_H26 | b_juncea\|12v1\|E6ANDIZ01BWYBD_P1 | 1544 | 4942 | 111 | 97.4 | globlastp |
| WNU17_H27 | b_juncea\|12v1\|E6ANDIZ01DEBC1_P1 | 1545 | 4942 | 111 | 97.4 | globlastp |
| WNU17_H28 | b_juncea\|12v1\|E6ANDIZ01EH3VM_P1 | 1546 | 4942 | 111 | 97.4 | globlastp |
| WNU17_H29 | b_oleracea\|gb161\|DY027215_P1 | 1547 | 4943 | 111 | 97.4 | globlastp |
| WNU17_H30 | b_oleracea\|gb161\|DY027796_P1 | 1548 | 4944 | 211 | 97.4 | globlastp |
| WNU17_H31 | b_rapa\|11v1\|BQ790813_P1 | 1549 | 4945 | 111 | 97.4 | globlastp |
| WNU17_H32 | b_rapa\|11v1\|BQ791570_P1 | 1550 | 4944 | 211 | 97.4 | globlastp |
| WNU17_H33 | b_rapa\|11v1\|CD817358_P1 | 1551 | 4942 | 217 | 97.4 | globlastp |
| WNU17_H34 | canola\|11v1\|CN730552_P1 | 1552 | 4944 | 217 | 97.4 | globlastp |
| WNU17_H35 | canola\|11v1\|CN731240_P1 | 1553 | 4945 | 217 | 97.4 | globlastp |
| WNU17_H36 | canola\|11v1\|DY024565_P1 | 1554 | 4943 | 217 | 97.4 | globlastp |
| WNU17_H37 | canola\|11v1\|EG020704_P1 | 1555 | 4942 | 217 | 97.4 | globlastp |
| WNU17_H38 | canola\|11v1\|EG021063_P1 | 1556 | 4945 | 217 | 97.4 | globlastp |
| WNU17_H39 | canola\|11v1\|EV012066_P1 | 1557 | 4945 | 217 | 97.4 | globlastp |
| WNU17_H40 | cenchrus\|gb166\|BM084863_P1 | 1558 | 4946 | 217 | 97.4 | globlastp |
| WNU17_H41 | eggplant\|10v1\|FS005444_P1 | 1559 | 4942 | 217 | 97.4 | globlastp |
| WNU17_H42 | euonymus\|11v1\|SRR070038X217657_P1 | 1560 | 4942 | 217 | 97.4 | globlastp |
| WNU17_H43 | fescue\|gb161\|DT685373_P1 | 1561 | 4946 | 217 | 97.4 | globlastp |
| WNU17_H44 | foxtail_millet\|11v3\|PHY7SI023172M_P1 | 1562 | 4946 | 217 | 97.4 | globlastp |
| WNU17_H45 | grape\|11v1\|GSVIVT01020701001_P1 | 1563 | 4942 | 217 | 97.4 | globlastp |
| WNU17_H46 | lettuce\|12v1\|DW069539_P1 | 1564 | 4947 | 217 | 97.4 | globlastp |
| WNU17_H47 | lotus\|09v1\|CB828211_P1 | 1565 | 4944 | 217 | 97.4 | globlastp |
| WNU17_H48 | monkeyflower\|10v1\|DV210516 | 1566 | 4942 | 217 | 97.4 | globlastp |
| WNU17_H49 | nasturtium\|11v1\|SRR032558.105835_P1 | 1567 | 4948 | 217 | 97.4 | globlastp |
| WNU17_H50 | pepper\|12v1\|BM066751_P1 | 1568 | 4942 | 217 | 97.4 | globlastp |
| WNU17_H51 | phyla\|11v2\|SRR099037X112851_P1 | 1569 | 4942 | 217 | 97.4 | globlastp |
| WNU17_H52 | pigeonpea\|11v1\|GR472520_P1 | 1570 | 4942 | 217 | 97.4 | globlastp |
| WNU17_H53 | radish\|gb164\|EV535692 | 1571 | 4942 | 217 | 97.4 | globlastp |
| WNU17_H54 | radish\|gb164\|EV539302 | 1572 | 4942 | 217 | 97.4 | globlastp |
| WNU17_H55 | radish\|gb164\|EV567217 | 1573 | 4942 | 217 | 97.4 | globlastp |
| WNU17_H56 | radish\|gb164\|EW714058 | 1574 | 4942 | 217 | 97.4 | globlastp |
| WNU17_H57 | radish\|gb164\|EW726281 | 1575 | 4942 | 217 | 97.4 | globlastp |
| WNU17_H58 | radish\|gb164\|EX755281 | 1576 | 4942 | 217 | 97.4 | globlastp |
| WNU17_H59 | radish\|gb164\|EX765304 | 1577 | 4942 | 217 | 97.4 | globlastp |
| WNU17_H60 | senecio\|gb170\|DY665106 | 1578 | 4949 | 217 | 97.4 | globlastp |
| WNU17_H61 | sugarcane\|11v1\|AA961288 | 1579 | 4946 | 217 | 97.4 | globlastp |
| WNU17_H62 | thellungiella_halophilum\|11v1\|DN774469 | 1580 | 4950 | 217 | 97.4 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU17_H63 | thellungiella_parvulum\|11v1\|BY805345 | 1581 | 4942 | 217 | 97.4 | globlastp |
| WNU17_H64 | thellungiella_parvulum\|11v1\|DN774469 | 1582 | 4950 | 217 | 97.4 | globlastp |
| WNU17_H65 | tobacco\|gb162\|CV018033 | 1583 | 4942 | 217 | 97.4 | globlastp |
| WNU17_H66 | tobacco\|gb162\|EB428813 | 1584 | 4942 | 217 | 97.4 | globlastp |
| WNU17_H67 | tomato\|11v1\|BG126290 | 1585 | 4942 | 217 | 97.4 | globlastp |
| WNU17_H68 | triphysaria\|10v1\|EY130377 | 1586 | 4951 | 217 | 97.4 | globlastp |
| WNU17_H69 | brachypodium\|12v1\|BRADI2G46290T2_T1 | 1587 | 4952 | 217 | 96.73 | glotblastn |
| WNU17_H70 | centaurea\|11v1\|EH737366_T1 | 1588 | 4953 | 217 | 96.73 | glotblastn |
| WNU17_H71 | cirsium\|11v1\|SRR346952.1004074_T1 | 1589 | 4954 | 217 | 96.73 | glotblastn |
| WNU17_H72 | cotton\|11v1\|DW512153_T1 | 1590 | 4955 | 217 | 96.73 | glotblastn |
| WNU17_H73 | salvia\|10v1\|SRR014553S0029303 | 1591 | 4956 | 217 | 96.73 | glotblastn |
| WNU17_H434 | nicotiana_benthamiana\|12v1\|EB428813_P1 | 1592 | 4957 | 217 | 96.7 | globlastp |
| WNU17_H435 | nicotiana_benthamiana\|12v1\|EB448956_P1 | 1593 | 4958 | 217 | 96.7 | globlastp |
| WNU17_H436 | switchgrass\|12v1\|DN143106_P1 | 1594 | 4959 | 217 | 96.7 | globlastp |
| WNU17_H437 | switchgrass\|12v1\|FE603001_P1 | 1595 | 4959 | 217 | 96.7 | globlastp |
| WNU17_H74 | ambrosia\|11v1\|SRR346935.169112_P1 | 1596 | 4958 | 217 | 96.7 | globlastp |
| WNU17_H75 | ambrosia\|11v1\|SRR346943.103583_P1 | 1597 | 4958 | 217 | 96.7 | globlastp |
| WNU17_H76 | amorphophallus\|11v2\|SRR089351X103836_P1 | 1598 | 4960 | 217 | 96.7 | globlastp |
| WNU17_H77 | amsonia\|11v1\|SRR098688X10543_P1 | 1599 | 4958 | 217 | 96.7 | globlastp |
| WNU17_H78 | arabidopsis_lyrata\|09v1\|JGIAL008169_P1 | 1600 | 4958 | 217 | 96.7 | globlastp |
| WNU17_H79 | arnica\|11v1\|SRR099034X115110_P1 | 1601 | 4958 | 217 | 96.7 | globlastp |
| WNU17_H80 | avocado\|10v1\|FD503593_P1 | 1602 | 4961 | 217 | 96.7 | globlastp |
| WNU17_H81 | blueberry\|12v1\|SRR353282X26947D1_P1 | 1603 | 4962 | 217 | 96.7 | globlastp |
| WNU17_H82 | canola\|11v1\|DY005277_P1 | 1604 | 4963 | 217 | 96.7 | globlastp |
| WNU17_H83 | catharanthus\|11v1\|EG558230_P1 | 1605 | 4958 | 217 | 96.7 | globlastp |
| WNU17_H84 | centaurea\|11v1\|EH780394_P1 | 1606 | 4958 | 217 | 96.7 | globlastp |
| WNU17_H85 | chestnut\|gb170\|SRR006295S0003346_P1 | 1607 | 4964 | 217 | 96.7 | globlastp |
| WNU17_H86 | cichorium\|gb171\|EH684694_P1 | 1608 | 4958 | 217 | 96.7 | globlastp |
| WNU17_H87 | cichorium\|gb171\|EH695309_P1 | 1609 | 4965 | 217 | 96.7 | globlastp |
| WNU17_H88 | clover\|gb162\|BB935221_P1 | 1610 | 4958 | 217 | 96.7 | globlastp |
| WNU17_H89 | coffea\|10v1\|DV665508_P1 | 1611 | 4958 | 217 | 96.7 | globlastp |
| WNU17_H90 | cotton\|11v1\|CO495392XX1_P1 | 1612 | 4958 | 217 | 96.7 | globlastp |
| WNU17_H91 | cucurbita\|11v1\|SRR091276X100473_P1 | 1613 | 4958 | 217 | 96.7 | globlastp |
| WNU17_H92 | cyamopsis\|10v1\|EG979319_P1 | 1614 | 4958 | 217 | 96.7 | globlastp |
| WNU17_H93 | cynara\|gb167\|GE589151_P1 | 1615 | 4958 | 217 | 96.7 | globlastp |
| WNU17_H94 | dandelion\|10v1\|DR398709_P1 | 1616 | 4958 | 217 | 96.7 | globlastp |
| WNU17_H95 | eggplant\|10v1\|FS007798_P1 | 1617 | 4958 | 217 | 96.7 | globlastp |
| WNU17_H96 | euonymus\|11v1\|SRR070038X115123_P1 | 1618 | 4966 | 217 | 96.7 | globlastp |
| WNU17_H97 | euonymus\|11v1\|SRR070038X117366_P1 | 1619 | 4967 | 217 | 96.7 | globlastp |
| WNU17_H98 | euphorbia\|11v1\|DV122132_P1 | 1620 | 4958 | 217 | 96.7 | globlastp |
| WNU17_H99 | flaveria\|11v1\|SRR149229.134328_P1 | 1621 | 4958 | 217 | 96.7 | globlastp |
| WNU17_H100 | flaveria\|11v1\|SRR149229.14807_P1 | 1622 | 4958 | 217 | 96.7 | globlastp |
| WNU17_H101 | flaveria\|11v1\|SRR149229.23144_P1 | 1623 | 4958 | 217 | 96.7 | globlastp |
| WNU17_H102 | flaveria\|11v1\|SRR149232.113312_P1 | 1624 | 4958 | 217 | 96.7 | globlastp |
| WNU17_H103 | flax\|11v1\|JG022693_P1 | 1625 | 4968 | 217 | 96.7 | globlastp |
| WNU17_H104 | flax\|11v1\|JG035547_P1 | 1626 | 4968 | 217 | 96.7 | globlastp |
| WNU17_H105 | foxtail_millet\|11v3\|EC613913_P1 | 1627 | 4959 | 217 | 96.7 | globlastp |
| WNU17_H106 | gossypium_raimondii\|12v1\|AI726003_P1 | 1628 | 4958 | 217 | 96.7 | globlastp |
| WNU17_H107 | guizotia\|10v1\|GE552627_P1 | 1629 | 4965 | 217 | 96.7 | globlastp |
| WNU17_H108 | iceplant\|gb164\|AI943435_P1 | 1630 | 4969 | 217 | 96.7 | globlastp |
| WNU17_H109 | ipomoea_batatas\|10v1\|EE876680_P1 | 1631 | 4970 | 217 | 96.7 | globlastp |
| WNU17_H110 | lettuce\|12v1\|DW047293_P1 | 1632 | 4958 | 217 | 96.7 | globlastp |
| WNU17_H111 | lotus\|09v1\|AW719221_P1 | 1633 | 4971 | 217 | 96.7 | globlastp |
| WNU17_H112 | maize\|10v1\|AI621751_P1 | 1634 | 4972 | 217 | 96.7 | globlastp |
| WNU17_H113 | maize\|10v1\|T20360_P1 | 1635 | 4973 | 217 | 96.7 | globlastp |
| WNU17_H114 | medicago\|12v1\|AA460332_P1 | 1636 | 4958 | 217 | 96.7 | globlastp |
| WNU17_H115 | nasturtium\|11v1\|GH169196_P1 | 1637 | 4974 | 217 | 96.7 | globlastp |
| WNU17_H116 | oak\|10v1\|DN950778_P1 | 1638 | 4964 | 217 | 96.7 | globlastp |
| WNU17_H117 | peanut\|10v1\|CD038839_P1 | 1639 | 4958 | 217 | 96.7 | globlastp |
| WNU17_H118 | peanut\|10v1\|EE127715_P1 | 1640 | 4958 | 217 | 96.7 | globlastp |
| WNU17_H119 | periwinkle\|gb164\|EG558230_P1 | 1641 | 4958 | 217 | 96.7 | globlastp |
| WNU17_H120 | petunia\|gb171\|FN000074_P1 | 1642 | 4970 | 217 | 96.7 | globlastp |
| WNU17_H121 | potato\|10v1\|BE919486_P1 | 1643 | 4971 | 217 | 96.7 | globlastp |
| WNU17_H122 | potato\|10v1\|BG590551_P1 | 1644 | 4975 | 217 | 96.7 | globlastp |
| WNU17_H123 | radish\|gb164\|EW733273 | 1645 | 4976 | 217 | 96.7 | globlastp |
| WNU17_H124 | radish\|gb164\|EY949993 | 1646 | 4976 | 217 | 96.7 | globlastp |
| WNU17_H125 | rice\|11v1\|BE228269 | 1647 | 4959 | 217 | 96.7 | globlastp |
| WNU17_H126 | safflower\|gb162\|EL398795 | 1648 | 4958 | 217 | 96.7 | globlastp |
| WNU17_H127 | solanum_phureja\|09v1\|SPHBG126290 | 1649 | 4975 | 217 | 96.7 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU17_H128 | solanum_phureja\|09v1\|SPHBG134126 | 1650 | 4971 | 217 | 96.7 | globlastp |
| WNU17_H129 | soybean\|11v1\|GLYMA06G33840 | 1651 | 4977 | 217 | 96.7 | globlastp |
| WNU17_H129 | soybean\|12v1\|GLYMA06G33840_P1 | 1652 | 4977 | 217 | 96.7 | globlastp |
| WNU17_H130 | soybean\|11v1\|GLYMA13G34600 | 1653 | 4958 | 217 | 96.7 | globlastp |
| WNU17_H130 | soybean\|12v1\|GLYMA13G34600T2_P1 | 1654 | 4958 | 217 | 96.7 | globlastp |
| WNU17_H131 | soybean\|11v1\|GLYMA20G10030 | 1655 | 4978 | 217 | 96.7 | globlastp |
| WNU17_H131 | soybean\|12v1\|GLYMA20G10030_P1 | 1656 | 4978 | 217 | 96.7 | globlastp |
| WNU17_H132 | spurge\|gb161\|DV122132 | 1657 | 4958 | 217 | 96.7 | globlastp |
| WNU17_H133 | sunflower\|12v1\|CD850417 | 1658 | 4958 | 217 | 96.7 | globlastp |
| WNU17_H134 | sunflower\|12v1\|DY925368 | 1659 | 4958 | 217 | 96.7 | globlastp |
| WNU17_H135 | switchgrass\|gb167\|DN143106 | 1660 | 4959 | 217 | 96.7 | globlastp |
| WNU17_H136 | switchgrass\|gb167\|FE603001 | 1661 | 4959 | 217 | 96.7 | globlastp |
| WNU17_H137 | tabernaemontana\|11v1\|SRR098689X110278 | 1662 | 4958 | 217 | 96.7 | globlastp |
| WNU17_H138 | tea\|10v1\|FE942783 | 1663 | 4965 | 217 | 96.7 | globlastp |
| WNU17_H139 | thellungiella_halophilum\|11v1\|BY805345 | 1664 | 4979 | 217 | 96.7 | globlastp |
| WNU17_H140 | tobacco\|gb162\|EB427071 | 1665 | 4958 | 217 | 96.7 | globlastp |
| WNU17_H141 | triphysaria\|10v1\|EX985155 | 1666 | 4980 | 217 | 96.7 | globlastp |
| WNU17_H142 | triphysaria\|10v1\|EY130295 | 1667 | 4981 | 217 | 96.7 | globlastp |
| WNU17_H143 | utricularia\|11v1\|SRR094438.102997 | 1668 | 4979 | 217 | 96.7 | globlastp |
| WNU17_H144 | valeriana\|11v1\|SRR099039X102133 | 1669 | 4965 | 217 | 96.7 | globlastp |
| WNU17_H145 | vinca\|11v1\|SRR098690X112996 | 1670 | 4965 | 217 | 96.7 | globlastp |
| WNU17_H438 | castorbean\|12v1\|EE255403_P1 | 1671 | 4982 | 217 | 96.1 | globlastp |
| WNU17_H439 | chickpea\|13v2\|FE668632_P1 | 1672 | 4983 | 217 | 96.1 | globlastp |
| WNU17_H440 | monkeyflower\|12v1\|CV521813_P1 | 1673 | 4984 | 217 | 96.1 | globlastp |
| WNU17_H441 | prunus_mume\|13v1\|BU042798_P1 | 1674 | 4985 | 217 | 96.1 | globlastp |
| WNU17_H442 | zostera\|12v1\|SRR057351X11589D1_P1 | 1675 | 4986 | 217 | 96.1 | globlastp |
| WNU17_H146 | antirrhinum\|gb166\|AJ788570_P1 | 1676 | 4987 | 217 | 96.1 | globlastp |
| WNU17_H147 | arabidopsis\|10v1\|AT1G78870_P1 | 1677 | 4988 | 217 | 96.1 | globlastp |
| WNU17_H148 | artemisia\|10v1\|EY049658_P1 | 1678 | 4989 | 217 | 96.1 | globlastp |
| WNU17_H149 | avocado\|10v1\|CK762705_P1 | 1679 | 4990 | 217 | 96.1 | globlastp |
| WNU17_H150 | banana\|12v1\|FF557470_P1 | 1680 | 4982 | 217 | 96.1 | globlastp |
| WNU17_H151 | beech\|11v1\|SRR006293.25722_P1 | 1681 | 4982 | 217 | 96.1 | globlastp |
| WNU17_H152 | blueberry\|12v1\|SRR353282X31338D1_P1 | 1682 | 4991 | 217 | 96.1 | globlastp |
| WNU17_H153 | bupleurum\|11v1\|SRR301254.137136_P1 | 1683 | 4992 | 217 | 96.1 | globlastp |
| WNU17_H154 | cacao\|10v1\|CU475181_P1 | 1684 | 4982 | 217 | 96.1 | globlastp |
| WNU17_H155 | cassava\|09v1\|DV452105_P1 | 1685 | 4982 | 217 | 96.1 | globlastp |
| WNU17_H156 | castorbean\|11v1\|EE255403 | 1686 | 4982 | 217 | 96.1 | globlastp |
| WNU17_H157 | cedrus\|11v1\|SRR065007X100480_P1 | 1687 | 4993 | 217 | 96.1 | globlastp |
| WNU17_H158 | centaurea\|11v1\|SRR346938.10212_P1 | 1688 | 4994 | 217 | 96.1 | globlastp |
| WNU17_H159 | chestnut\|gb170\|SRR006295S0005351_P1 | 1689 | 4982 | 217 | 96.1 | globlastp |
| WNU17_H160 | chickpea\|11v1\|FE668632 | 1690 | 4983 | 217 | 96.1 | globlastp |
| WNU17_H161 | clementine\|11v1\|CF417240_P1 | 1691 | 4982 | 217 | 96.1 | globlastp |
| WNU17_H162 | cleome_gynandra\|10v1\|SRR015532S0027837_P1 | 1692 | 4982 | 217 | 96.1 | globlastp |
| WNU17_H163 | cleome_spinosa\|10v1\|GR932301_P1 | 1693 | 4982 | 217 | 96.1 | globlastp |
| WNU17_H164 | cleome_spinosa\|10v1\|SRR015531S0013877_P1 | 1694 | 4982 | 217 | 96.1 | globlastp |
| WNU17_H165 | cotton\|11v1\|AI726003_P1 | 1695 | 4995 | 217 | 96.1 | globlastp |
| WNU17_H166 | cotton\|11v1\|AI729870_P1 | 1696 | 4982 | 217 | 96.1 | globlastp |
| WNU17_H167 | cotton\|11v1\|DT527415_P1 | 1697 | 4996 | 217 | 96.1 | globlastp |
| WNU17_H168 | cowpea\|12v1\|FC460687_P1 | 1698 | 4997 | 217 | 96.1 | globlastp |
| WNU17_H169 | cowpea\|12v1\|FF391401_P1 | 1699 | 4998 | 217 | 96.1 | globlastp |
| WNU17_H170 | cucumber\|09v1\|DV632828_P1 | 1700 | 4982 | 217 | 96.1 | globlastp |
| WNU17_H171 | dandelion\|10v1\|DR398472_P1 | 1701 | 4999 | 217 | 96.1 | globlastp |
| WNU17_H172 | eschscholzia\|11v1\|CD479283_P1 | 1702 | 5000 | 217 | 96.1 | globlastp |
| WNU17_H173 | euphorbia\|11v1\|BP961080_P1 | 1703 | 4982 | 217 | 96.1 | globlastp |
| WNU17_H174 | flaveria\|11v1\|SRR149229.121259_P1 | 1704 | 5001 | 217 | 96.1 | globlastp |
| WNU17_H175 | flaveria\|11v1\|SRR149244.109043_P1 | 1705 | 5002 | 217 | 96.1 | globlastp |
| WNU17_H176 | flax\|11v1\|GW864855_P1 | 1706 | 5003 | 217 | 96.1 | globlastp |
| WNU17_H177 | fraxinus\|11v1\|SRR058827.103663_P1 | 1707 | 4982 | 217 | 96.1 | globlastp |
| WNU17_H178 | fraxinus\|11v1\|SRR058827.107638_P1 | 1708 | 4990 | 217 | 96.1 | globlastp |
| WNU17_H179 | gossypium_raimondii\|12v1\|AI729870_P1 | 1709 | 4982 | 217 | 96.1 | globlastp |
| WNU17_H180 | grape\|11v1\|GSVIVT01014215001_P1 | 1710 | 4982 | 217 | 96.1 | globlastp |
| WNU17_H181 | guizotia\|10v1\|GE562307_P1 | 1711 | 5001 | 217 | 96.1 | globlastp |
| WNU17_H182 | humulus\|11v1\|EX518933_P1 | 1712 | 4983 | 217 | 96.1 | globlastp |
| WNU17_H183 | ipomoea_batatas\|10v1\|EE875329_P1 | 1713 | 5004 | 217 | 96.1 | globlastp |
| WNU17_H184 | ipomoea_nil\|10v1\|CJ747934_P1 | 1714 | 5005 | 217 | 96.1 | globlastp |
| WNU17_H185 | ipomoea_nil\|10v1\|CJ752578_P1 | 1715 | 4982 | 217 | 96.1 | globlastp |
| WNU17_H186 | jatropha\|09v1\|GT228569_P1 | 1716 | 4982 | 217 | 96.1 | globlastp |
| WNU17_H187 | kiwi\|gb166\|FG423895_P1 | 1717 | 5006 | 217 | 96.1 | globlastp |
| WNU17_H188 | liquorice\|gb171\|FS244937_P1 | 1718 | 4982 | 217 | 96.1 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU17_H189 | maize\|10v1\|AA979832_P1 | 1719 | 5007 | 217 | 96.1 | globlastp |
| WNU17_H190 | maize\|10v1\|AW171809_P1 | 1720 | 5008 | 217 | 96.1 | globlastp |
| WNU17_H191 | melon\|10v1\|DV632828_P1 | 1721 | 4982 | 217 | 96.1 | globlastp |
| WNU17_H192 | momordica\|10v1\|SRR071315S0000326_P1 | 1722 | 4982 | 217 | 96.1 | globlastp |
| WNU17_H193 | oak\|10v1\|FP025798_P1 | 1723 | 4982 | 217 | 96.1 | globlastp |
| WNU17_H194 | olea\|11v1\|SRR014463.21469 | 1724 | 4990 | 217 | 96.1 | globlastp |
| WNU17_H194 | olea\|13v1\|SRR014463X21469D1_P1 | 1725 | 4990 | 217 | 96.1 | globlastp |
| WNU17_H195 | olea\|11v1\|SRR014463.22162 | 1726 | 4982 | 217 | 96.1 | globlastp |
| WNU17_H195 | olea\|13v1\|SRR014463X22162D1_P1 | 1727 | 4982 | 217 | 96.1 | globlastp |
| WNU17_H196 | orange\|11v1\|CF417240_P1 | 1728 | 4982 | 217 | 96.1 | globlastp |
| WNU17_H197 | orobanche\|10v1\|SRR023189S0012723_P1 | 1729 | 5009 | 217 | 96.1 | globlastp |
| WNU17_H198 | papaya\|gb165\|EX231148_P1 | 1730 | 4982 | 217 | 96.1 | globlastp |
| WNU17_H199 | parthenium\|10v1\|GW778911_P1 | 1731 | 5010 | 217 | 96.1 | globlastp |
| WNU17_H200 | pepper\|12v1\|BM066122_P1 | 1732 | 5011 | 217 | 96.1 | globlastp |
| WNU17_H201 | phyla\|11v2\|SRR099035X100283_P1 | 1733 | 4987 | 217 | 96.1 | globlastp |
| WNU17_H202 | phyla\|11v2\|SRR099035X100758_P1 | 1734 | 4983 | 217 | 96.1 | globlastp |
| WNU17_H203 | pigeonpea\|11v1\|GR470024_P1 | 1735 | 4998 | 217 | 96.1 | globlastp |
| WNU17_H204 | plantago\|11v2\|SRR066373X103675_P1 | 1736 | 4982 | 217 | 96.1 | globlastp |
| WNU17_H205 | poppy\|11v1\|FG599569_P1 | 1737 | 5012 | 217 | 96.1 | globlastp |
| WNU17_H206 | poppy\|11v1\|SRR096789.122196_P1 | 1738 | 5011 | 217 | 96.1 | globlastp |
| WNU17_H207 | prunus\|10v1\|CB822666 | 1739 | 5013 | 217 | 96.1 | globlastp |
| WNU17_H208 | rose\|12v1\|BQ103975 | 1740 | 5013 | 217 | 96.1 | globlastp |
| WNU17_H209 | silene\|11v1\|GH292005 | 1741 | 5014 | 217 | 96.1 | globlastp |
| WNU17_H210 | silene\|11v1\|GH294038 | 1742 | 5015 | 217 | 96.1 | globlastp |
| WNU17_H211 | sorghum\|12v1\|SB03G030840 | 1743 | 5007 | 217 | 96.1 | globlastp |
| WNU17_H212 | soybean\|11v1\|GLYMA12G35790 | 1744 | 5016 | 217 | 96.1 | globlastp |
| WNU17_H212 | soybean\|12v1\|GLYMA12G35790_P1 | 1745 | 5016 | 217 | 96.1 | globlastp |
| WNU17_H213 | strawberry\|11v1\|CO817378 | 1746 | 5013 | 217 | 96.1 | globlastp |
| WNU17_H214 | sugarcane\|10v1\|BQ533055 | 1747 | 5007 | 217 | 96.1 | globlastp |
| WNU17_H215 | sunflower\|12v1\|CD850786 | 1748 | 5001 | 217 | 96.1 | globlastp |
| WNU17_H216 | switchgrass\|gb167\|DN145151 | 1749 | 5017 | 217 | 96.1 | globlastp |
| WNU17_H217 | thalictrum\|11v1\|SRR096787X117438 | 1750 | 5018 | 217 | 96.1 | globlastp |
| WNU17_H218 | tomato\|11v1\|BG134126 | 1751 | 4983 | 217 | 96.1 | globlastp |
| WNU17_H219 | tragopogon\|10v1\|SRR020205S0000057 | 1752 | 5019 | 217 | 96.1 | globlastp |
| WNU17_H220 | trigonella\|11v1\|SRR066194X104236 | 1753 | 5020 | 217 | 96.1 | globlastp |
| WNU17_H221 | tripterygium\|11v1\|SRR098677X10016 | 1754 | 5021 | 217 | 96.1 | globlastp |
| WNU17_H222 | walnuts\|gb166\|CB303910 | 1755 | 4982 | 217 | 96.1 | globlastp |
| WNU17_H223 | walnuts\|gb166\|CV198359 | 1756 | 4982 | 217 | 96.1 | globlastp |
| WNU17_H224 | watermelon\|11v1\|DV632828 | 1757 | 4982 | 217 | 96.1 | globlastp |
| WNU17_H225 | zostera\|10v1\|SRR057351S0000733 | 1758 | 4986 | 217 | 96.1 | globlastp |
| WNU17_H226 | artemisia\|10v1\|EY098112_T1 | 1759 | 5022 | 217 | 96.08 | glotblastn |
| WNU17_H227 | b_rapa\|11v1\|BQ704394_T1 | 1760 | 5023 | 217 | 96.08 | glotblastn |
| WNU17_H228 | sarracenia\|11v1\|SRR192669.10343 | 1761 | 5024 | 217 | 96.08 | glotblastn |
| WNU17_H229 | sarracenia\|11v1\|SRR192669.105437 | 1762 | 5025 | 217 | 96.08 | glotblastn |
| WNU17_H230 | senecio\|gb170\|DY663326 | 1763 | 5026 | 217 | 96.08 | glotblastn |
| WNU17_H231 | wheat\|12v3\|CA486470 | 1764 | 5027 | 217 | 96.08 | glotblastn |
| WNU17_H232 | ambrosia\|11v1\|SRR346935.112046_T1 | 1765 | 5024 | 217 | 95.42 | glotblastn |
| WNU17_H233 | flaveria\|11v1\|SRR149232.212348_T1 | 1766 | 5028 | 217 | 95.42 | glotblastn |
| WNU17_H234 | poppy\|11v1\|SRR030259.119059_T1 | 1767 | 5029 | 217 | 95.42 | glotblastn |
| WNU17_H443 | bean\|12v2\|CA906757_P1 | 1768 | 5030 | 217 | 95.4 | globlastp |
| WNU17_H235 | acacia\|10v1\|FS588158_P1 | 1769 | 5031 | 217 | 95.4 | globlastp |
| WNU17_H236 | amorphophallus\|11v2\|SRR089351X103308_P1 | 1770 | 5032 | 217 | 95.4 | globlastp |
| WNU17_H237 | antirrhinum\|gb166\|AJ558475_P1 | 1771 | 5033 | 217 | 95.4 | globlastp |
| WNU17_H238 | aristolochia\|10v1\|FD752041_P1 | 1772 | 5034 | 217 | 95.4 | globlastp |
| WNU17_H239 | banana\|12v1\|FF559774_P1 | 1773 | 5035 | 217 | 95.4 | globlastp |
| WNU17_H240 | basilicum\|10v1\|DY340408_P1 | 1774 | 5036 | 217 | 95.4 | globlastp |
| WNU17_H241 | bean\|12v1\|CA906757 | 1775 | 5030 | 217 | 95.4 | globlastp |
| WNU17_H242 | beet\|12v1\|EG549424_P1 | 1776 | 5037 | 217 | 95.4 | globlastp |
| WNU17_H243 | beet\|12v1\|EG550821_P1 | 1777 | 5038 | 217 | 95.4 | globlastp |
| WNU17_H244 | blueberry\|12v1\|SRR353282X43109D1_P1 | 1778 | 5039 | 217 | 95.4 | globlastp |
| WNU17_H245 | blueberry\|12v1\|SRR353282X90355D1_P1 | 1779 | 5039 | 217 | 95.4 | globlastp |
| WNU17_H246 | catharanthus\|11v1\|AF091621_P1 | 1780 | 5040 | 217 | 95.4 | globlastp |
| WNU17_H247 | centaurea\|11v1\|EH723118_P1 | 1781 | 5041 | 217 | 95.4 | globlastp |
| WNU17_H248 | centaurea\|11v1\|EH737491_P1 | 1782 | 5041 | 217 | 95.4 | globlastp |
| WNU17_H249 | centaurea\|11v1\|EH760412_P1 | 1783 | 5041 | 217 | 95.4 | globlastp |
| WNU17_H250 | chelidonium\|11v1\|SRR084752X105322_P1 | 1784 | 5042 | 217 | 95.4 | globlastp |
| WNU17_H251 | cirsium\|11v1\|SRR346952.1008801_P1 | 1785 | 5041 | 217 | 95.4 | globlastp |
| WNU17_H252 | cirsium\|11v1\|SRR346952.102609_P1 | 1786 | 5043 | 217 | 95.4 | globlastp |
| WNU17_H253 | cucurbita\|11v1\|FG227319_P1 | 1787 | 5044 | 217 | 95.4 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
| --- | --- | --- | --- | --- | --- | --- |
| WNU17_H254 | cynara\|gb167\|GE588125_P1 | 1788 | 5043 | 217 | 95.4 | globlastp |
| WNU17_H255 | eucalyptus\|11v2\|CD669014_P1 | 1789 | 5045 | 217 | 95.4 | globlastp |
| WNU17_H256 | euonymus\|11v1\|SRR070038X136525_P1 | 1790 | 5046 | 217 | 95.4 | globlastp |
| WNU17_H257 | fagopyrum\|11v1\|SRR063689X102569_P1 | 1791 | 5047 | 217 | 95.4 | globlastp |
| WNU17_H258 | fagopyrum\|11v1\|SRR063689X17391_P1 | 1792 | 5048 | 217 | 95.4 | globlastp |
| WNU17_H259 | flax\|11v1\|JG133969_P1 | 1793 | 5049 | 217 | 95.4 | globlastp |
| WNU17_H260 | fraxinus\|11v1\|SRR058827.169109_P1 | 1794 | 5050 | 217 | 95.4 | globlastp |
| WNU17_H261 | ginseng\|10v1\|DV555857_P1 | 1795 | 5051 | 217 | 95.4 | globlastp |
| WNU17_H262 | guizotia\|10v1\|GE555906_P1 | 1796 | 5052 | 217 | 95.4 | globlastp |
| WNU17_H263 | heritiera\|10v1\|SRR005794S0001119_P1 | 1797 | 5045 | 217 | 95.4 | globlastp |
| WNU17_H264 | iceplant\|gb164\|BE034207_P1 | 1798 | 5053 | 217 | 95.4 | globlastp |
| WNU17_H265 | ipomoea_batatas\|10v1\|DV035340_P1 | 1799 | 5054 | 217 | 95.4 | globlastp |
| WNU17_H266 | ipomoea_nil\|10v1\|CJ747207_P1 | 1800 | 5055 | 217 | 95.4 | globlastp |
| WNU17_H267 | kiwi\|gb166\|FG409170_P1 | 1801 | 5056 | 217 | 95.4 | globlastp |
| WNU17_H268 | liriodendron\|gb166\|FD488994_P1 | 1802 | 5057 | 217 | 95.4 | globlastp |
| WNU17_H269 | oil_palm\|11v1\|EL688490_P1 | 1803 | 5034 | 217 | 95.4 | globlastp |
| WNU17_H270 | orobanche\|10v1\|SRR023189S0006106_P1 | 1804 | 5058 | 217 | 95.4 | globlastp |
| WNU17_H271 | pine\|10v2\|AA739766_P1 | 1805 | 5059 | 217 | 95.4 | globlastp |
| WNU17_H272 | plantago\|11v2\|SRR066373X164128_P1 | 1806 | 5060 | 217 | 95.4 | globlastp |
| WNU17_H273 | poplar\|10v1\|AI161701 | 1807 | 5045 | 217 | 95.4 | globlastp |
| WNU17_H273 | poplar\|13v1\|AI161701_P1 | 1808 | 5045 | 217 | 95.4 | globlastp |
| WNU17_H274 | poplar\|10v1\|AI162761 | 1809 | 5054 | 217 | 95.4 | globlastp |
| WNU17_H274 | poplar\|13v1\|AI162761_P1 | 1810 | 5054 | 217 | 95.4 | globlastp |
| WNU17_H275 | poppy\|11v1\|SRR030259.105591_P1 | 1811 | 5061 | 217 | 95.4 | globlastp |
| WNU17_H276 | prunus\|10v1\|BU042798 | 1812 | 5062 | 217 | 95.4 | globlastp |
| WNU17_H277 | pseudotsuga\|10v1\|SRR065119S0012686 | 1813 | 5063 | 217 | 95.4 | globlastp |
| WNU17_H278 | radish\|gb164\|EY919768 | 1814 | 5064 | 217 | 95.4 | globlastp |
| WNU17_H279 | safflower\|gb162\|EL386327 | 1815 | 5041 | 217 | 95.4 | globlastp |
| WNU17_H280 | salvia\|10v1\|SRR014553S0000609 | 1816 | 5065 | 217 | 95.4 | globlastp |
| WNU17_H281 | sarracenia\|11v1\|SRR192669.117327 | 1817 | 5066 | 217 | 95.4 | globlastp |
| WNU17_H282 | scabiosa\|11v1\|SRR063723X10994 | 1818 | 5067 | 217 | 95.4 | globlastp |
| WNU17_H283 | silene\|11v1\|GH291836 | 1819 | 5068 | 217 | 95.4 | globlastp |
| WNU17_H284 | sorghum\|12v1\|SB02G021080 | 1820 | 5069 | 217 | 95.4 | globlastp |
| WNU17_H285 | spruce\|11v1\|ES250195 | 1821 | 5070 | 217 | 95.4 | globlastp |
| WNU17_H286 | strawberry\|11v1\|DY667301 | 1822 | 5071 | 217 | 95.4 | globlastp |
| WNU17_H287 | sugarcane\|10v1\|CA066851 | 1823 | 5069 | 217 | 95.4 | globlastp |
| WNU17_H288 | sunflower\|12v1\|CF077956 | 1824 | 5072 | 217 | 95.4 | globlastp |
| WNU17_H289 | taxus\|10v1\|SRR032523S0000732XX1 | 1825 | 5073 | 217 | 95.4 | globlastp |
| WNU17_H290 | tragopogon\|10v1\|SRR020205S0002138 | 1826 | 5074 | 217 | 95.4 | globlastp |
| WNU17_H291 | utricularia\|11v1\|SRR094438.10007 | 1827 | 5075 | 217 | 95.4 | globlastp |
| WNU17_H292 | utricularia\|11v1\|SRR094438.109222 | 1828 | 5076 | 217 | 95.4 | globlastp |
| WNU17_H293 | valeriana\|11v1\|SRR099039X114224 | 1829 | 5067 | 217 | 95.4 | globlastp |
| WNU17_H294 | valeriana\|11v1\|SRR099039X80681 | 1830 | 5077 | 217 | 95.4 | globlastp |
| WNU17_H444 | bean\|12v2\|CA898393_P1 | 1831 | 5078 | 217 | 94.8 | globlastp |
| WNU17_H445 | olea\|13v1\|SRR014463X11653D1_P1 | 1832 | 5079 | 217 | 94.8 | globlastp |
| WNU17_H446 | switchgrass\|12v1\|DN152618_P1 | 1833 | 5080 | 217 | 94.8 | globlastp |
| WNU17_H295 | abies\|11v2\|SRR098676X114290_P1 | 1834 | 5081 | 217 | 94.8 | globlastp |
| WNU17_H296 | ambrosia\|11v1\|SRR346943.118378_P1 | 1835 | 5082 | 217 | 94.8 | globlastp |
| WNU17_H297 | amorphophallus\|11v2\|SRR089351X101818_P1 | 1836 | 5083 | 217 | 94.8 | globlastp |
| WNU17_H298 | arnica\|11v1\|SRR099034X136000_P1 | 1837 | 5082 | 217 | 94.8 | globlastp |
| WNU17_H299 | artemisia\|10v1\|GW331403_P1 | 1838 | 5084 | 217 | 94.8 | globlastp |
| WNU17_H300 | banana\|12v1\|FF560038_P1 | 1839 | 5085 | 217 | 94.8 | globlastp |
| WNU17_H302 | cannabis\|12v1\|SOLX00033268_P1 | 1840 | 5086 | 217 | 94.8 | globlastp |
| WNU17_H303 | cannabis\|12v1\|SOLX00040838_P1 | 1841 | 5086 | 217 | 94.8 | globlastp |
| WNU17_H304 | canola\|11v1\|ES899299_P1 | 1842 | 5087 | 217 | 94.8 | globlastp |
| WNU17_H305 | cephalotaxus\|11v1\|SRR064395X106265_P1 | 1843 | 5088 | 217 | 94.8 | globlastp |
| WNU17_H306 | cirsium\|11v1\|SRR346952.11489_P1 | 1844 | 5089 | 217 | 94.8 | globlastp |
| WNU17_H307 | cleome_gynandra\|10v1\|SRR015532S0000743_P1 | 1845 | 5090 | 217 | 94.8 | globlastp |
| WNU17_H308 | cotton\|11v1\|AY560546_P1 | 1846 | 5091 | 217 | 94.8 | globlastp |
| WNU17_H309 | cotton\|11v1\|BF272909_P1 | 1847 | 5092 | 217 | 94.8 | globlastp |
| WNU17_H310 | cotton\|11v1\|CO092732_P1 | 1848 | 5093 | 217 | 94.8 | globlastp |
| WNU17_H311 | cotton\|11v1\|DV850261_P1 | 1849 | 5094 | 217 | 94.8 | globlastp |
| WNU17_H312 | cotton\|11v1\|SRR032367.852137_P1 | 1850 | 5091 | 217 | 94.8 | globlastp |
| WNU17_H313 | cycas\|gb166\|CB090914_P1 | 1851 | 5095 | 217 | 94.8 | globlastp |
| WNU17_H314 | dandelion\|10v1\|GO663352_P1 | 1852 | 5096 | 217 | 94.8 | globlastp |
| WNU17_H315 | eschscholzia\|11v1\|CK744884_P1 | 1853 | 5097 | 217 | 94.8 | globlastp |
| WNU17_H316 | fagopyrum\|11v1\|SRR063689X121403XX1_P1 | 1854 | 5098 | 217 | 94.8 | globlastp |
| WNU17_H317 | ginger\|gb164\|DY369735_P1 | 1855 | 5099 | 217 | 94.8 | globlastp |
| WNU17_H318 | gnetum\|10v1\|DN954342_P1 | 1856 | 5100 | 217 | 94.8 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU17_H319 | gossypium_raimondii\|12v1\|AY560546_P1 | 1857 | 5091 | 217 | 94.8 | globlastp |
| WNU17_H320 | gossypium_raimondii\|12v1\|BF272909_P1 | 1858 | 5093 | 217 | 94.8 | globlastp |
| WNU17_H321 | gossypium_raimondii\|12v1\|DT527415_P1 | 1859 | 5094 | 217 | 94.8 | globlastp |
| WNU17_H322 | humulus\|11v1\|FG345870_P1 | 1860 | 5101 | 217 | 94.8 | globlastp |
| WNU17_H323 | humulus\|11v1\|GD244056_P1 | 1861 | 5101 | 217 | 94.8 | globlastp |
| WNU17_H324 | humulus\|11v1\|SRR098683X102824_P1 | 1862 | 5101 | 217 | 94.8 | globlastp |
| WNU17_H325 | kiwi\|gb166\|FG426345_P1 | 1863 | 5102 | 217 | 94.8 | globlastp |
| WNU17_H326 | liriodendron\|gb166\|CK745391_P1 | 1864 | 5103 | 217 | 94.8 | globlastp |
| WNU17_H327 | maritime_pine\|10v1\|AL749594_P1 | 1865 | 5104 | 217 | 94.8 | globlastp |
| WNU17_H328 | millet\|10v1\|EVO454PM030933_P1 | 1866 | 5105 | 217 | 94.8 | globlastp |
| WNU17_H329 | olea\|11v1\|SRR014463.11653 | 1867 | 5079 | 217 | 94.8 | globlastp |
| WNU17_H330 | onion\|12v1\|SRR073446X118270D1_P1 | 1868 | 5106 | 217 | 94.8 | globlastp |
| WNU17_H331 | periwinkle\|gb164\|AF091621_P1 | 1869 | 5107 | 217 | 94.8 | globlastp |
| WNU17_H332 | phalaenopsis\|11v1\|SRR125771.1002079_P1 | 1870 | 5108 | 217 | 94.8 | globlastp |
| WNU17_H333 | phalaenopsis\|11v1\|SRR125771.1026536_P1 | 1871 | 5109 | 217 | 94.8 | globlastp |
| WNU17_H334 | primula\|11v1\|SRR098679X107296_P1 | 1872 | 5110 | 217 | 94.8 | globlastp |
| WNU17_H335 | radish\|gb164\|EV535483 | 1873 | 5111 | 217 | 94.8 | globlastp |
| WNU17_H336 | rose\|12v1\|SRR397984.120485 | 1874 | 5112 | 217 | 94.8 | globlastp |
| WNU17_H337 | sciadopitys\|10v1\|SRR065035S0012583 | 1875 | 5113 | 217 | 94.8 | globlastp |
| WNU17_H338 | sciadopitys\|10v1\|SRR065035S0075123 | 1876 | 5114 | 217 | 94.8 | globlastp |
| WNU17_H339 | switchgrass\|gb167\|DN152618 | 1877 | 5080 | 217 | 94.8 | globlastp |
| WNU17_H349 | olea\|13v1\|SRR014463X30186D1_P1 | 1878 | 5115 | 217 | 94.8 | globlastp |
| WNU17_H340 | onion\|12v1\|FS210737_T1 | 1879 | 5116 | 217 | 94.77 | glotblastn |
| WNU17_H341 | sarracenia\|11v1\|SRR192669.100640 | 1880 | 5117 | 217 | 94.77 | glotblastn |
| WNU17_H342 | sarracenia\|11v1\|SRR192669.16863 | 1881 | 5118 | 217 | 94.77 | glotblastn |
| WNU17_H343 | tragopogon\|10v1\|SRR020205S0024946 | 1882 | 5119 | 217 | 94.77 | glotblastn |
| WNU17_H344 | tripterygium\|11v1\|SRR098677X104747 | 1883 | 5120 | 217 | 94.77 | glotblastn |
| WNU17_H345 | aquilegia\|10v2\|JGIAC026301_P1 | 1884 | 5121 | 217 | 94.2 | globlastp |
| WNU17_H346 | amborella\|12v3\|CV012534_T1 | 1885 | 5122 | 217 | 94.12 | glotblastn |
| WNU17_H347 | flaveria\|11v1\|SRR149229.290471XX1_T1 | 1886 | 5024 | 217 | 94.12 | glotblastn |
| WNU17_H348 | fraxinus\|11v1\|SRR058827.135458_T1 | 1887 | 5123 | 217 | 94.12 | glotblastn |
| WNU17_H349 | olea\|11v1\|SRR014463.30186 | 1888 | 5124 | 217 | 94.12 | glotblastn |
| WNU17_H447 | switchgrass\|12v1\|FE600938_P1 | 1889 | 5125 | 217 | 94.1 | globlastp |
| WNU17_H350 | amsonia\|11v1\|SRR098688X100872_P1 | 1890 | 5126 | 217 | 94.1 | globlastp |
| WNU17_H351 | banana\|12v1\|ES431646_P1 | 1891 | 5127 | 217 | 94.1 | globlastp |
| WNU17_H352 | cichorium\|gb171\|EH709360_P1 | 1892 | 5128 | 217 | 94.1 | globlastp |
| WNU17_H353 | eschscholzia\|11v1\|SRR014116.107763_P1 | 1893 | 5129 | 217 | 94.1 | globlastp |
| WNU17_H354 | pineapple\|10v1\|DT337097_P1 | 1894 | 5130 | 217 | 94.1 | globlastp |
| WNU17_H355 | platanus\|11v1\|SRR096786X104389_P1 | 1895 | 5131 | 217 | 94.1 | globlastp |
| WNU17_H356 | podocarpus\|10v1\|SRR065014S0008331_P1 | 1896 | 5132 | 217 | 94.1 | globlastp |
| WNU17_H357 | spruce\|11v1\|ES249358 | 1897 | 5133 | 217 | 94.1 | globlastp |
| WNU17_H358 | spruce\|11v1\|EX353857 | 1898 | 5133 | 217 | 94.1 | globlastp |
| WNU17_H359 | switchgrass\|gb167\|FE600938 | 1899 | 5125 | 217 | 94.1 | globlastp |
| WNU17_H360 | tabernaemontana\|11v1\|SRR098689X120633 | 1900 | 5134 | 217 | 94.1 | globlastp |
| WNU17_H361 | zinnia\|gb171\|AU305997 | 1901 | 5135 | 217 | 94.1 | globlastp |
| WNU17_H362 | abies\|11v2\|SRR098676X111177_P1 | 1902 | 5136 | 217 | 93.5 | globlastp |
| WNU17_H363 | amborella\|12v3\|CK755984_P1 | 1903 | 5137 | 217 | 93.5 | globlastp |
| WNU17_H364 | barley\|12v1\|BE413397_P1 | 1904 | 5138 | 217 | 93.5 | globlastp |
| WNU17_H365 | distylium\|11v1\|SRR065077X112289_P1 | 1905 | 5139 | 217 | 93.5 | globlastp |
| WNU17_H366 | fagopyrum\|11v1\|SRR063703X105646_P1 | 1906 | 5140 | 217 | 93.5 | globlastp |
| WNU17_H367 | foxtail_millet\|11v3\|PHY7SI031377M_P1 | 1907 | 5141 | 217 | 93.5 | globlastp |
| WNU17_H368 | maritime_pine\|10v1\|BX000624_P1 | 1908 | 5142 | 217 | 93.5 | globlastp |
| WNU17_H369 | pine\|10v2\|AW010211_P1 | 1909 | 5142 | 217 | 93.5 | globlastp |
| WNU17_H370 | pseudoroegneria\|gb167\|FF362940 | 1910 | 5138 | 217 | 93.5 | globlastp |
| WNU17_H371 | rye\|12v1\|DRR001012.127556 | 1911 | 5143 | 217 | 93.5 | globlastp |
| WNU17_H372 | sequoia\|10v1\|SRR065044S0003204 | 1912 | 5144 | 217 | 93.5 | globlastp |
| WNU17_H373 | vinca\|11v1\|SRR098690X184197 | 1913 | 5145 | 217 | 93.5 | globlastp |
| WNU17_H374 | wheat\|12v3\|BM134951 | 1914 | 5138 | 217 | 93.5 | globlastp |
| WNU17_H375 | wheat\|12v3\|BM138072 | 1915 | 5138 | 217 | 93.5 | globlastp |
| WNU17_H376 | cedrus\|11v1\|SRR065007X109223_T1 | 1916 | 5146 | 217 | 93.46 | glotblastn |
| WNU17_H377 | gossypium_raimondii\|12v1\|SRR032881.293179_T1 | 1917 | 5147 | 217 | 92.81 | glotblastn |
| WNU17_H378 | podocarpus\|10v1\|SRR065014S0040197_T1 | 1918 | 5148 | 217 | 92.81 | glotblastn |
| WNU17_H379 | oat\|11v1\|GO589794_P1 | 1919 | 5149 | 217 | 92.8 | globlastp |
| WNU17_H380 | platanus\|11v1\|SRR096786X128074_P1 | 1920 | 5150 | 217 | 92.8 | globlastp |
| WNU17_H381 | rhizophora\|10v1\|SRR005792S0000964 | 1921 | 5151 | 217 | 92.8 | globlastp |
| WNU17_H382 | ceratodon\|10v1\|SRR074890S0015879_P1 | 1922 | 5152 | 217 | 92.3 | globlastp |
| WNU17_H383 | cephalotaxus\|11v1\|SRR064395X305668_P1 | 1923 | 5153 | 217 | 92.2 | globlastp |
| WNU17_H384 | sequoia\|10v1\|SRR065044S0044135 | 1924 | 5154 | 217 | 92.2 | globlastp |
| WNU17_H385 | distylium\|11v1\|SRR065077X110866_T1 | 1925 | 5155 | 217 | 92.16 | glotblastn |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU17_H386 | *pteridium*|11v1|SRR043594X100139 | 1926 | 5156 | 217 | 92.16 | glotblastn |
| WNU17_H387 | *cryptomeria*|gb166|BY887735_P1 | 1927 | 5157 | 217 | 91.5 | globlastp |
| WNU17_H388 | spruce|11v1|CO207826 | 1928 | 5158 | 217 | 91.5 | glotblastn |
| WNU17_H389 | hornbeam|12v1|SRR364455.106790_T1 | 1929 | — | 217 | 91.5 | glotblastn |
| WNU17_H390 | b_juncea|12v1|E6ANDIZ01A0KI8_P1 | 1930 | 5159 | 217 | 90.8 | globlastp |
| WNU17_H391 | *epimedium*|11v1|SRR013505.12485_P1 | 1931 | 5160 | 217 | 90.8 | globlastp |
| WNU17_H392 | *fagopyrum*|11v1|SRR063689X102345_P1 | 1932 | 5161 | 217 | 90.8 | globlastp |
| WNU17_H393 | *rhizophora*|10v1|SRR005792S0000918 | 1933 | 5162 | 217 | 90.8 | globlastp |
| WNU17_H394 | *physcomitrella*|10v1|AW599579_P1 | 1934 | 5163 | 217 | 90.4 | globlastp |
| WNU17_H395 | *physcomitrella*|10v1|BJ941521_P1 | 1935 | 5164 | 217 | 90.4 | globlastp |
| WNU17_H396 | *ceratodon*|10v1|SRR074890S0028051_P1 | 1936 | 5165 | 217 | 89.9 | globlastp |
| WNU17_H397 | fern|gb171|DK943806_P1 | 1937 | 5166 | 217 | 89.8 | globlastp |
| WNU17_H398 | *fraxinus*|11v1|SRR058827.161949_T1 | 1938 | 5167 | 217 | 89.54 | glotblastn |
| WNU17_H399 | apple|11v1|CN491361_P1 | 1939 | 5168 | 217 | 89.5 | globlastp |
| WNU17_H400 | *eschscholzia*|11v1|SRR014116.76220_P1 | 1940 | 5169 | 217 | 89.5 | globlastp |
| WNU17_H401 | *vinca*|11v1|SRR098690X151645 | 1941 | 5170 | 217 | 89.5 | globlastp |
| WNU17_H402 | *marchantia*|gb166|C96568_P1 | 1942 | 5171 | 217 | 89.2 | globlastp |
| WNU17_H403 | *pteridium*|11v1|SRR043594X104315 | 1943 | 5172 | 217 | 89.2 | globlastp |
| WNU17_H404 | *arnica*|11v1|SRR099034X105698_P1 | 1944 | 5173 | 217 | 88.9 | globlastp |
| WNU17_H405 | clementine|11v1|BQ624371_P1 | 1945 | 5174 | 217 | 88.9 | globlastp |
| WNU17_H406 | orange|11v1|BQ624371_P1 | 1946 | 5174 | 217 | 88.9 | globlastp |
| WNU17_H407 | banana|12v1|MAGEN2012013021_P1 | 1947 | 5175 | 217 | 88.2 | globlastp |
| WNU17_H408 | radish|gb164|EV540304 | 1948 | 5176 | 217 | 88.2 | globlastp |
| WNU17_H409 | *cirsium*|11v1|SRR346952.1008500_P1 | 1949 | 5177 | 217 | 87.6 | globlastp |
| WNU17_H410 | *phyla*|11v2|SRR099035X34188_T1 | 1950 | 5178 | 217 | 87.58 | glotblastn |
| WNU17_H411 | *ceratodon*|10v1|AW086960_P1 | 1951 | 5179 | 217 | 87.3 | globlastp |
| WNU17_H412 | *leymus*|gb166|CN466070_P1 | 1952 | 5180 | 217 | 86.5 | globlastp |
| WNU18_H2 | rye|12v1|BE586989 | 1976 | 218 | 218 | 100 | globlastp |
| WNU18_H3 | rye|12v1|BE705680 | 1977 | 218 | 218 | 100 | globlastp |
| WNU18_H4 | rye|12v1|DRR001012.106515 | 1978 | 218 | 218 | 100 | globlastp |
| WNU18_H5 | wheat|12v3|BE404152 | 1979 | 218 | 218 | 100 | globlastp |
| WNU18_H6 | *brachypodium*|12v1|BRADI4G26140_P1 | 1980 | 5202 | 218 | 96.6 | globlastp |
| WNU18_H7 | *fescue*|gb161|DT686090_P1 | 1981 | 5203 | 218 | 96 | globlastp |
| WNU18_H8 | *lolium*|10v1|AU246279_P1 | 1982 | 5203 | 218 | 96 | globlastp |
| WNU18_H9 | oat|11v1|GO583146_P1 | 1983 | 5204 | 218 | 96 | globlastp |
| WNU18_H10 | oat|11v1|GO587032_P1 | 1984 | 5204 | 218 | 96 | globlastp |
| WNU18_H11 | rye|12v1|DRR001012.124006 | 1985 | 5205 | 218 | 96 | globlastp |
| WNU18_H12 | barley|12v1|BI959091_P1 | 1986 | 5206 | 218 | 95.3 | globlastp |
| WNU18_H13 | foxtail_millet|11v3|PHY7SI026958M_P1 | 1987 | 5207 | 218 | 95.3 | globlastp |
| WNU18_H14 | wheat|12v3|BE405456 | 1988 | 5206 | 218 | 95.3 | globlastp |
| WNU18_H15 | foxtail_millet|11v3|PHY7SI011704M_P1 | 1989 | 5208 | 218 | 94.6 | globlastp |
| WNU18_H16 | millet|10v1|PMSLX0000156D2_P1 | 1990 | 5209 | 218 | 94.6 | globlastp |
| WNU18_H17 | millet|10v1|PMSLX0033210_P1 | 1991 | 5208 | 218 | 94.6 | globlastp |
| WNU18_H18 | rice|11v1|BE039864 | 1992 | 5210 | 218 | 94 | globlastp |
| WNU18_H19 | rice|11v1|RICRPSAAA | 1993 | 5210 | 218 | 94 | globlastp |
| WNU18_H20 | rice|11v1|BI808225 | 1994 | 5211 | 218 | 93.96 | glotblastn |
| WNU18_H21 | *brachypodium*|12v1|BRADI4G43980_P1 | 1995 | 5212 | 218 | 93.3 | globlastp |
| WNU18_H22 | maize|10v1|AI920628_P1 | 1996 | 5213 | 218 | 93.3 | globlastp |
| WNU18_H23 | oat|11v1|GO587074_P1 | 1997 | 5214 | 218 | 93.3 | globlastp |
| WNU18_H24 | *sorghum*|12v1|SB08G001870 | 1998 | 5215 | 218 | 93.3 | globlastp |
| WNU18_H40 | switchgrass|12v1|FE642069_P1 | 1999 | 5216 | 218 | 92.6 | globlastp |
| WNU18_H41 | switchgrass|12v1|FL740608_P1 | 2000 | 5216 | 218 | 92.6 | globlastp |
| WNU18_H25 | *sorghum*|12v1|SB05G001680 | 2001 | 5217 | 218 | 92.6 | globlastp |
| WNU18_H26 | sugarcane|10v1|BQ536327 | 2002 | 5218 | 218 | 92.6 | globlastp |
| WNU18_H27 | sugarcane|10v1|CA066765 | 2003 | 5219 | 218 | 92.6 | globlastp |
| WNU18_H28 | switchgrass|gb167|DN140806 | 2004 | 5216 | 218 | 92.6 | globlastp |
| WNU18_H29 | switchgrass|gb167|FE642069 | 2005 | 5216 | 218 | 92.6 | globlastp |
| WNU18_H30 | millet|10v1|EVO454PM242725_P1 | 2006 | 5220 | 218 | 91.9 | globlastp |
| WNU18_H42 | switchgrass|12v1|DN147240_P1 | 2007 | 5221 | 218 | 91.3 | globlastp |
| WNU18_H31 | *cenchrus*|gb166|EB657189_P1 | 2008 | 5222 | 218 | 91.3 | globlastp |
| WNU18_H32 | maize|10v1|AI395919_P1 | 2009 | 5223 | 218 | 91.3 | globlastp |
| WNU18_H33 | switchgrass|gb167|DN147240 | 2010 | 5221 | 218 | 91.3 | globlastp |
| WNU18_H34 | switchgrass|gb167|FL824347 | 2011 | 5221 | 218 | 91.3 | globlastp |
| WNU18_H35 | maize|10v1|AW126613_T1 | 2012 | 5224 | 218 | 89.26 | glotblastn |
| WNU18_H36 | maize|10v1|AW146945_P1 | 2013 | 5225 | 218 | 86.9 | globlastp |
| WNU18_H37 | wheat|12v3|CA617476 | 2014 | 5226 | 218 | 85.91 | glotblastn |
| WNU18_H38 | *cynodon*|10v1|ES301273_P1 | 2015 | 5227 | 218 | 81.9 | globlastp |
| WNU18_H39 | *fescue*|gb161|CK801591_P1 | 2016 | 5228 | 218 | 80 | globlastp |
| WNU19_H1 | wheat|12v3|BE403638 | 2017 | 5229 | 219 | 99.9 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU19_H2 | wheat\|12v3\|BE399910 | 2018 | 5230 | 219 | 99.8 | globlastp |
| WNU19_H3 | rye\|12v1\|DRR001012.138836 | 2019 | 5231 | 219 | 99.64 | globlastp |
| WNU19_H4 | rye\|12v1\|DRR001012.148210 | 2020 | 5232 | 219 | 99.5 | globlastp |
| WNU19_H5 | wheat\|12v3\|BE400773 | 2021 | 5233 | 219 | 99.5 | globlastp |
| WNU19_H6 | wheat\|12v3\|BE400818 | 2022 | 5234 | 219 | 99.4 | globlastp |
| WNU19_H7 | wheat\|12v3\|BQ236190 | 2023 | 5235 | 219 | 99.4 | globlastp |
| WNU19_H8 | wheat\|12v3\|BF428831 | 2024 | 5236 | 219 | 99.3 | globlastp |
| WNU19_H9 | wheat\|12v3\|BE400787 | 2025 | 5237 | 219 | 99.2 | globlastp |
| WNU19_H10 | wheat\|12v3\|BE412230 | 2026 | 5238 | 219 | 98.8 | globlastp |
| WNU19_H11 | wheat\|12v3\|BE637890 | 2027 | 5239 | 219 | 98.7 | glotblastn |
| WNU19_H12 | rye\|12v1\|BE495456 | 2028 | 5240 | 219 | 98.6 | globlastp |
| WNU19_H13 | rye\|12v1\|DRR001012.102874 | 2029 | 5240 | 219 | 98.6 | globlastp |
| WNU19_H14 | wheat\|12v3\|BE402187 | 2030 | 5240 | 219 | 98.6 | globlastp |
| WNU19_H15 | wheat\|12v3\|BE591621 | 2031 | 5240 | 219 | 98.6 | globlastp |
| WNU19_H16 | wheat\|12v3\|BE400982 | 2032 | 5241 | 219 | 98.5 | globlastp |
| WNU19_H17 | rye\|12v1\|DRR001012.102774 | 2033 | 5242 | 219 | 98.46 | glotblastn |
| WNU19_H18 | rye\|12v1\|DRR001012.106463 | 2034 | 5243 | 219 | 98.46 | glotblastn |
| WNU19_H19 | barley\|12v1\|BE412416_P1 | 2035 | 5244 | 219 | 96.8 | globlastp |
| WNU19_H20 | brachypodium\|12v1\|BRADI3G44480_P1 | 2036 | 5245 | 219 | 96.8 | globlastp |
| WNU19_H21 | brachypodium\|12v1\|BRADI3G44160_P1 | 2037 | 5246 | 219 | 96.7 | globlastp |
| WNU19_H22 | wheat\|12v3\|BE400209 | 2038 | 5247 | 219 | 95.4 | globlastp |
| WNU19_H23 | brachypodium\|12v1\|BRADI2G45070_P1 | 2039 | 5248 | 219 | 94.9 | globlastp |
| WNU19_H24 | oat\|11v1\|GO583982_P1 | 2040 | 5249 | 219 | 94.9 | globlastp |
| WNU19_H25 | oat\|11v1\|GO586975_P1 | 2041 | 5249 | 219 | 94.9 | globlastp |
| WNU19_H26 | rice\|11v1\|AA749896 | 2042 | 5250 | 219 | 94.5 | globlastp |
| WNU19_H27 | rye\|12v1\|DRR001012.103583 | 2043 | 5251 | 219 | 94.42 | glotblastn |
| WNU19_H267 | switchgrass\|12v1\|FE604024_P1 | 2044 | 5252 | 219 | 94.4 | globlastp |
| WNU19_H28 | foxtail_millet\|11v3\|EC612202_P1 | 2045 | 5253 | 219 | 94.4 | globlastp |
| WNU19_H29 | foxtail_millet\|11v3\|PHY7SI020903M_P1 | 2046 | 5253 | 219 | 94.4 | globlastp |
| WNU19_H268 | switchgrass\|12v1\|DN151890_P1 | 2047 | 5254 | 219 | 94.3 | globlastp |
| WNU19_H30 | switchgrass\|gb167\|DN151890 | 2048 | 5254 | 219 | 94.3 | globlastp |
| WNU19_H31 | rice\|11v1\|AA753882 | 2049 | 5255 | 219 | 94.2 | globlastp |
| WNU19_H32 | cenchrus\|gb166\|BM084104_P1 | 2050 | 5256 | 219 | 94.1 | globlastp |
| WNU19_H33 | millet\|10v1\|EVO454PM000899_T1 | 2051 | 5257 | 219 | 94.07 | glotblastn |
| WNU19_H34 | sorghum\|12v1\|SB03G034200 | 2052 | 5258 | 219 | 94 | globlastp |
| WNU19_H35 | sorghum\|12v1\|SB01G002040 | 2053 | 5259 | 219 | 93.95 | glotblastn |
| WNU19_H36 | rice\|11v1\|CK032966 | 2054 | 5260 | 219 | 93.85 | glotblastn |
| WNU19_H37 | maize\|10v1\|AI615128_P1 | 2055 | 5261 | 219 | 93.7 | globlastp |
| WNU19_H38 | maize\|10v1\|AI438426_P1 | 2056 | 5262 | 219 | 93.6 | globlastp |
| WNU19_H39 | maize\|10v1\|BE511139_P1 | 2057 | 5262 | 219 | 93.6 | globlastp |
| WNU19_H40 | maize\|10v1\|AI881430_P1 | 2058 | 5263 | 219 | 93.5 | globlastp |
| WNU19_H41 | wheat\|12v3\|BJ244184 | 2059 | 5264 | 219 | 93.2 | globlastp |
| WNU19_H269 | zostera\|12v1\|AM766155_P1 | 2060 | 5265 | 219 | 93.1 | globlastp |
| WNU19_H42 | zostera\|10v1\|AM766155 | 2061 | 5265 | 219 | 93.1 | globlastp |
| WNU19_H43 | oak\|10v1\|CU640356_P1 | 2062 | 5266 | 219 | 92.9 | globlastp |
| WNU19_H44 | apple\|11v1\|CN544862_T1 | 2063 | 5267 | 219 | 92.88 | glotblastn |
| WNU19_H270 | nicotiana_benthamiana\|12v1\|BP748244_P1 | 2064 | 5268 | 219 | 92.8 | globlastp |
| WNU19_H45 | clementine\|11v1\|BE208967_P1 | 2065 | 5269 | 219 | 92.8 | globlastp |
| WNU19_H46 | orange\|11v1\|BE208967_P1 | 2065 | 5269 | 219 | 92.8 | globlastp |
| WNU19_H47 | gossypium_raimondii\|12v1\|BF268145_P1 | 2066 | 5270 | 219 | 92.8 | globlastp |
| WNU19_H48 | sugarcane\|10v1\|BQ535682 | 2067 | 5271 | 219 | 92.8 | globlastp |
| WNU19_H271 | castorbean\|12v1\|T15194_P1 | 2068 | 5272 | 219 | 92.6 | globlastp |
| WNU19_H49 | aquilegia\|10v2\|DT751509_P1 | 2069 | 5273 | 219 | 92.6 | globlastp |
| WNU19_H51 | cotton\|11v1\|BF268145_P1 | 2070 | 5274 | 219 | 92.6 | globlastp |
| WNU19_H52 | kiwi\|gb166\|FG397283_P1 | 2071 | 5275 | 219 | 92.6 | globlastp |
| WNU19_H53 | kiwi\|gb166\|FG404148_P1 | 2072 | 5276 | 219 | 92.6 | globlastp |
| WNU19_H54 | sequoia\|10v1\|SRR065044S0011432XX1 | 2073 | 5277 | 219 | 92.53 | glotblastn |
| WNU19_H55 | blueberry\|12v1\|SRR353282X12615D1_P1 | 2074 | 5278 | 219 | 92.5 | globlastp |
| WNU19_H56 | cacao\|10v1\|CA795785_P1 | 2075 | 5279 | 219 | 92.5 | globlastp |
| WNU19_H57 | tripterygium\|11v1\|SRR098677X100553 | 2076 | 5280 | 219 | 92.5 | globlastp |
| WNU19_H272 | castorbean\|12v1\|EE255306_T1 | 2077 | 5281 | 219 | 92.41 | glotblastn |
| WNU19_H273 | prunus_mume\|13v1\|BU040103_P1 | 2078 | 5282 | 219 | 92.4 | globlastp |
| WNU19_H58 | blueberry\|12v1\|SRR353282X101483D1_P1 | 2079 | 5283 | 219 | 92.4 | globlastp |
| WNU19_H59 | castorbean\|11v1\|EE255306 | 2080 | 5284 | 219 | 92.4 | globlastp |
| WNU19_H60 | cotton\|11v1\|AI726506_P1 | 2081 | 5285 | 219 | 92.4 | globlastp |
| WNU19_H61 | cotton\|11v1\|CO080174_P1 | 2082 | 5286 | 219 | 92.4 | globlastp |
| WNU19_H62 | gossypium_raimondii\|12v1\|AI054588_P1 | 2083 | 5285 | 219 | 92.4 | globlastp |
| WNU19_H63 | tripterygium\|11v1\|SRR098677X100942 | 2084 | 5287 | 219 | 92.4 | globlastp |
| WNU19_H64 | chelidonium\|11v1\|SRR084752X101391_P1 | 2085 | 5288 | 219 | 92.3 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU19_H65 | chestnut|gb170|SRR006295S0000411_P1 | 2086 | 5289 | 219 | 92.3 | globlastp |
| WNU19_H66 | cotton|11v1|BG442749_P1 | 2087 | 5290 | 219 | 92.3 | globlastp |
| WNU19_H67 | cucumber|09v1|DN910064_P1 | 2088 | 5291 | 219 | 92.3 | globlastp |
| WNU19_H68 | eucalyptus|11v2|CD668782_P1 | 2089 | 5292 | 219 | 92.3 | globlastp |
| WNU19_H69 | maritime_pine|10v1|BX250736_P1 | 2090 | 5293 | 219 | 92.3 | globlastp |
| WNU19_H70 | beech|11v1|SRR006293.21436_T1 | 2091 | 5294 | 219 | 92.29 | glotblastn |
| WNU19_H71 | banana|12v1|MAGEN2012002315_P1 | 2092 | 5295 | 219 | 92.2 | globlastp |
| WNU19_H72 | cotton|11v1|AI054588_P1 | 2093 | 5296 | 219 | 92.2 | globlastp |
| WNU19_H73 | medicago|12v1|AW256374_P1 | 2094 | 5297 | 219 | 92.2 | globlastp |
| WNU19_H74 | melon|10v1|DV631712_P1 | 2095 | 5298 | 219 | 92.2 | globlastp |
| WNU19_H75 | oil_palm|11v1|SRR190698.127955_P1 | 2096 | 5299 | 219 | 92.2 | globlastp |
| WNU19_H76 | watermelon|11v1|VMEL00557738492956 | 2097 | 5300 | 219 | 92.2 | globlastp |
| WNU19_H77 | sequoia|10v1|SRR065044S0006876 | 2098 | 5301 | 219 | 92.17 | glotblastn |
| WNU19_H78 | coffea|10v1|DV665586_P1 | 2099 | 5302 | 219 | 92.1 | globlastp |
| WNU19_H79 | gossypium_raimondii|12v1|AI728565_P1 | 2100 | 5303 | 219 | 92.1 | globlastp |
| WNU19_H80 | pepper|12v1|BM063010_P1 | 2101 | 5304 | 219 | 92.1 | globlastp |
| WNU19_H81 | phyla|11v2|SRR099035X100521XX1_P1 | 2102 | 5305 | 219 | 92.1 | globlastp |
| WNU19_H82 | plantago|11v2|SRR066373X1002_P1 | 2103 | 5306 | 219 | 92.1 | globlastp |
| WNU19_H83 | poplar|10v1|AI165397 | 2104 | 5307 | 219 | 92.1 | globlastp |
| WNU19_H83 | poplar|13v1|AI165397_P1 | 2105 | 5308 | 219 | 92.1 | globlastp |
| WNU19_H84 | prunus|10v1|BU040103 | 2106 | 5309 | 219 | 92.1 | globlastp |
| WNU19_H85 | soybean|11v1|GLYMA08G18110 | 2107 | 5310 | 219 | 92.1 | globlastp |
| WNU19_H85 | soybean|12v1|GLYMA08G18110_P1 | 2108 | 5310 | 219 | 92.1 | globlastp |
| WNU19_H86 | spruce|11v1|ES227777 | 2109 | 5311 | 219 | 92.1 | globlastp |
| WNU19_H87 | watermelon|11v1|CK755729 | 2110 | 5312 | 219 | 92.1 | globlastp |
| WNU19_H88 | castorbean|11v1|RCPRD038497 | 2111 | 5313 | 219 | 92.05 | glotblastn |
| WNU19_H89 | euonymus|11v1|SRR070038X103715_T1 | 2112 | 5314 | 219 | 91.93 | glotblastn |
| WNU19_H274 | bean|12v2|CA898094_P1 | 2113 | 5315 | 219 | 91.9 | globlastp |
| WNU19_H90 | banana|12v1|ES433164_P1 | 2114 | 5316 | 219 | 91.9 | globlastp |
| WNU19_H92 | cassava|09v1|CK643184_P1 | 2115 | 5317 | 219 | 91.9 | globlastp |
| WNU19_H93 | maritime_pine|10v1|AL751264_P1 | 2116 | 5318 | 219 | 91.9 | globlastp |
| WNU19_H94 | poplar|10v1|BU822969 | 2117 | 5319 | 219 | 91.9 | globlastp |
| WNU19_H94 | poplar|13v1|BU822969_P1 | 2118 | 5319 | 219 | 91.9 | globlastp |
| WNU19_H95 | potato|10v1|AJ235757_P1 | 2119 | 5320 | 219 | 91.9 | globlastp |
| WNU19_H96 | solanum_phureja|09v1|SPHAJ235757 | 2120 | 5321 | 219 | 91.9 | globlastp |
| WNU19_H97 | soybean|11v1|GLYMA15G40860 | 2121 | 5322 | 219 | 91.9 | globlastp |
| WNU19_H97 | soybean|12v1|GLYMA15G40860_P1 | 2122 | 5322 | 219 | 91.9 | globlastp |
| WNU19_H98 | switchgrass|gb167|DN142408 | 2123 | 5323 | 219 | 91.9 | globlastp |
| WNU19_H105 | poplar|13v1|BI120895_P1 | 2124 | 5324 | 219 | 91.9 | globlastp |
| WNU19_H99 | pine|10v2|BE123819_T1 | 2125 | 5325 | 219 | 91.83 | glotblastn |
| WNU19_H100 | cotton|11v1|EX170767_T1 | 2126 | 5326 | 219 | 91.81 | glotblastn |
| WNU19_H101 | cassava|09v1|CK644865_P1 | 2127 | 5327 | 219 | 91.8 | globlastp |
| WNU19_H102 | cowpea|12v1|FC459752_P1 | 2128 | 5328 | 219 | 91.8 | globlastp |
| WNU19_H103 | oil_palm|11v1|EL682836_P1 | 2129 | 5329 | 219 | 91.8 | globlastp |
| WNU19_H104 | peanut|10v1|ES709584_P1 | 2130 | 5330 | 219 | 91.8 | globlastp |
| WNU19_H105 | poplar|10v1|BI120895 | 2131 | 5331 | 219 | 91.8 | globlastp |
| WNU19_H106 | prunus|10v1|BU040347 | 2132 | 5332 | 219 | 91.8 | globlastp |
| WNU19_H107 | strawberry|11v1|AF041392 | 2133 | 5333 | 219 | 91.8 | globlastp |
| WNU19_H108 | tabernaemontana|11v1|SRR098689X100806 | 2134 | 5334 | 219 | 91.8 | globlastp |
| WNU19_H109 | taxus|10v1|SRR032523S0000905 | 2135 | 5335 | 219 | 91.8 | globlastp |
| WNU19_H275 | olea|13v1|SRR014463X19360D1_P1 | 2136 | 5336 | 219 | 91.7 | globlastp |
| WNU19_H110 | arnica|11v1|SRR099034X100223_P1 | 2137 | 5337 | 219 | 91.7 | globlastp |
| WNU19_H111 | cycas|gb166|CB093374_P1 | 2138 | 5338 | 219 | 91.7 | globlastp |
| WNU19_H112 | eschscholzia|11v1|CD481525_T1 | 2139 | 5339 | 219 | 91.7 | glotblastn |
| WNU19_H113 | lettuce|12v1|DW044734_P1 | 2140 | 5340 | 219 | 91.7 | globlastp |
| WNU19_H114 | medicago|12v1|AW698719_P1 | 2141 | 5341 | 219 | 91.7 | globlastp |
| WNU19_H115 | sciadopitys|10v1|SRR065035S0002676 | 2142 | 5342 | 219 | 91.7 | globlastp |
| WNU19_H116 | tomato|11v1|AJ235757 | 2143 | 5343 | 219 | 91.7 | globlastp |
| WNU19_H276 | chickpea|13v2|FL512382_P1 | 2144 | 5344 | 219 | 91.6 | globlastp |
| WNU19_H277 | zostera|12v1|SRR057351X110689D1_P1 | 2145 | 5345 | 219 | 91.6 | globlastp |
| WNU19_H117 | ambrosia|11v1|SRR346935.101423_P1 | 2146 | 5346 | 219 | 91.6 | globlastp |
| WNU19_H118 | amorphophallus|11v2|SRR089351X109177_P1 | 2147 | 5347 | 219 | 91.6 | globlastp |
| WNU19_H119 | cannabis|12v1|GR220889_P1 | 2148 | 5348 | 219 | 91.6 | globlastp |
| WNU19_H120 | podocarpus|10v1|SRR065014S0000383_P1 | 2149 | 5349 | 219 | 91.6 | globlastp |
| WNU19_H121 | poppy|11v1|SRR030259.101698_P1 | 2150 | 5350 | 219 | 91.6 | globlastp |
| WNU19_H122 | rose|12v1|BQ105854 | 2151 | 5351 | 219 | 91.6 | globlastp |
| WNU19_H123 | sunflower|12v1|DY921242 | 2152 | 5352 | 219 | 91.6 | globlastp |
| WNU19_H124 | vinca|11v1|SRR098690X104327 | 2153 | 5353 | 219 | 91.6 | globlastp |
| WNU19_H125 | zostera|10v1|SRR057351S0005594 | 2154 | 5345 | 219 | 91.6 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU19_H278 | chickpea\|13v2\|FL512400_P1 | 2155 | 5354 | 219 | 91.5 | globlastp |
| WNU19_H279 | chickpea\|13v2\|GR913128_P1 | 2156 | 5354 | 219 | 91.5 | globlastp |
| WNU19_H280 | chickpea\|13v2\|GR915293_P1 | 2157 | 5354 | 219 | 91.5 | globlastp |
| WNU19_H281 | olea\|13v1\|SRR014463X10479D1_P1 | 2158 | 5355 | 219 | 91.5 | globlastp |
| WNU19_H282 | olea\|13v1\|SRR014463X11586D1_P1 | 2159 | 5355 | 219 | 91.5 | globlastp |
| WNU19_H126 | amsonia\|11v1\|SRR098688X106109_P1 | 2160 | 5356 | 219 | 91.5 | globlastp |
| WNU19_H127 | catharanthus\|11v1\|EG555169_P1 | 2161 | 5357 | 219 | 91.5 | globlastp |
| WNU19_H128 | chickpea\|11v1\|GR407290XX1 | 2162 | 5354 | 219 | 91.5 | globlastp |
| WNU19_H128 | chickpea\|13v2\|GR407290_P1 | 2163 | 5354 | 219 | 91.5 | globlastp |
| WNU19_H129 | clementine\|11v1\|CB250306_P1 | 2164 | 5358 | 219 | 91.5 | globlastp |
| WNU19_H130 | distylium\|11v1\|SRR065077X10471_P1 | 2165 | 5359 | 219 | 91.5 | globlastp |
| WNU19_H131 | euphorbia\|11v1\|SRR098678X100925_P1 | 2166 | 5360 | 219 | 91.5 | globlastp |
| WNU19_H132 | orange\|11v1\|CB250306_P1 | 2167 | 5361 | 219 | 91.5 | globlastp |
| WNU19_H133 | poppy\|11v1\|SRR030259.104984XX2_P1 | 2168 | 5362 | 219 | 91.5 | globlastp |
| WNU19_H134 | pseudotsuga\|10v1\|SRR065119S0000457 | 2169 | 5363 | 219 | 91.5 | globlastp |
| WNU19_H135 | sunflower\|12v1\|BU671851 | 2170 | 5364 | 219 | 91.5 | globlastp |
| WNU19_H136 | trigonella\|11v1\|SRR066194X180483 | 2171 | 5365 | 219 | 91.5 | globlastp |
| WNU19_H137 | vinca\|11v1\|SRR098690X101897 | 2172 | 5366 | 219 | 91.5 | globlastp |
| WNU19_H138 | watermelon\|11v1\|CK765820 | 2173 | 5367 | 219 | 91.5 | globlastp |
| WNU19_H139 | artemisia\|10v1\|EY033582_T1 | 2174 | 5368 | 219 | 91.46 | glotblastn |
| WNU19_H140 | cephalotaxus\|11v1\|SRR064395X100945_T1 | 2175 | 5369 | 219 | 91.46 | glotblastn |
| WNU19_H141 | trigonella\|11v1\|SRR066194X100299 | 2176 | 5370 | 219 | 91.46 | glotblastn |
| WNU19_H142 | pigeonpea\|11v1\|GR467899_P1 | 2177 | 5371 | 219 | 91.4 | globlastp |
| WNU19_H283 | chickpea\|13v2\|GR916248_T1 | 2178 | 5372 | 219 | 91.34 | glotblastn |
| WNU19_H284 | chickpea\|13v2\|GR401562_P1 | 2179 | 5373 | 219 | 91.3 | globlastp |
| WNU19_H285 | monkeyflower\|12v1\|DV205820_P1 | 2180 | 5374 | 219 | 91.3 | globlastp |
| WNU19_H143 | euonymus\|11v1\|SRR070038X10546_P1 | 2181 | 5375 | 219 | 91.3 | globlastp |
| WNU19_H144 | grape\|11v1\|GSVIVT01020404001_P1 | 2182 | 5376 | 219 | 91.3 | globlastp |
| WNU19_H145 | monkeyflower\|10v1\|DV205820 | 2183 | 5374 | 219 | 91.3 | globlastp |
| WNU19_H146 | poppy\|11v1\|FE967696_P1 | 2184 | 5377 | 219 | 91.3 | globlastp |
| WNU19_H147 | amorphophallus\|11v2\|SRR089351X105225_T1 | 2185 | 5378 | 219 | 91.22 | glotblastn |
| WNU19_H148 | centaurea\|11v1\|EH762970_T1 | 2186 | 5379 | 219 | 91.22 | glotblastn |
| WNU19_H149 | poppy\|11v1\|SRR030259.104501_T1 | 2187 | 5380 | 219 | 91.22 | glotblastn |
| WNU19_H150 | sunflower\|12v1\|DY907212 | 2188 | 5381 | 219 | 91.22 | glotblastn |
| WNU19_H151 | aquilegia\|10v2\|DR917334_P1 | 2189 | 5382 | 219 | 91.2 | globlastp |
| WNU19_H152 | arabidopsis_lyrata\|09v1\|JGIAL005090_P1 | 2190 | 5383 | 219 | 91.2 | globlastp |
| WNU19_H153 | b_rapa\|11v1\|BG544120_P1 | 2191 | 5384 | 219 | 91.2 | globlastp |
| WNU19_H154 | poppy\|11v1\|FE967193_P1 | 2192 | 5385 | 219 | 91.2 | globlastp |
| WNU19_H155 | poppy\|11v1\|SRR030264.247963_P1 | 2193 | 5386 | 219 | 91.2 | globlastp |
| WNU19_H156 | poppy\|11v1\|SRR030266.52245_P1 | 2194 | 5387 | 219 | 91.2 | globlastp |
| WNU19_H157 | rye\|12v1\|DRR001012.110872 | 2195 | 5388 | 219 | 91.2 | globlastp |
| WNU19_H158 | valeriana\|11v1\|SRR099039X100187 | 2196 | 5389 | 219 | 91.2 | globlastp |
| WNU19_H159 | abies\|11v2\|SRR098676X100456_P1 | 2197 | 5390 | 219 | 91.1 | globlastp |
| WNU19_H160 | canola\|11v1\|EV010917_P1 | 2198 | 5391 | 219 | 91.1 | globlastp |
| WNU19_H161 | cedrus\|11v1\|SRR065007X100657_P1 | 2199 | 5392 | 219 | 91.1 | globlastp |
| WNU19_H162 | oil_palm\|11v1\|SRR190698.167621XX1_P1 | 2200 | 5393 | 219 | 91.1 | globlastp |
| WNU19_H163 | poppy\|11v1\|SRR030259.122349_T1 | 2201 | 5394 | 219 | 91.1 | glotblastn |
| WNU19_H164 | sunflower\|12v1\|DY906203 | 2202 | 5395 | 219 | 91.1 | globlastp |
| WNU19_H165 | canola\|11v1\|CN734558_P1 | 2203 | 5396 | 219 | 91 | globlastp |
| WNU19_H166 | canola\|11v1\|DY010660_P1 | 2204 | 5397 | 219 | 91 | globlastp |
| WNU19_H167 | grape\|11v1\|GSVIVT01020405001_T1 | 2205 | 5398 | 219 | 91 | glotblastn |
| WNU19_H168 | thellungiella_halophilum\|11v1\|DN774158 | 2206 | 5399 | 219 | 91 | globlastp |
| WNU19_H169 | dandelion\|10v1\|DY819449_T1 | 2207 | 5400 | 219 | 90.98 | glotblastn |
| WNU19_H170 | poppy\|11v1\|SRR030259.293113_T1 | 2208 | 5401 | 219 | 90.98 | glotblastn |
| WNU19_H171 | amorphophallus\|11v2\|SRR089351X101426_P1 | 2209 | 5402 | 219 | 90.9 | globlastp |
| WNU19_H172 | canola\|11v1\|DY003089_P1 | 2210 | 5403 | 219 | 90.9 | globlastp |
| WNU19_H173 | gossypium_raimondii\|12v1\|SRR032367.160520_P1 | 2211 | 5404 | 219 | 90.9 | globlastp |
| WNU19_H174 | silene\|11v1\|GH294619 | 2212 | 5405 | 219 | 90.9 | globlastp |
| WNU19_H175 | phalaenopsis\|11v1\|CB033076XX1_T1 | 2213 | 5406 | 219 | 90.87 | glotblastn |
| WNU19_H176 | aquilegia\|10v2\|DR944068_P1 | 2214 | 5407 | 219 | 90.8 | globlastp |
| WNU19_H177 | b_rapa\|11v1\|BG544324_T1 | 2215 | 5408 | 219 | 90.77 | glotblastn |
| WNU19_H178 | b_rapa\|11v1\|CA992361_T1 | 2216 | 5409 | 219 | 90.75 | glotblastn |
| WNU19_H179 | canola\|11v1\|EE451187_T1 | 2217 | 5410 | 219 | 90.75 | glotblastn |
| WNU19_H180 | canola\|11v1\|SRR019559.14594_T1 | 2218 | 5411 | 219 | 90.75 | glotblastn |
| WNU19_H181 | pine\|10v2\|SRR036960S0020056_T1 | 2219 | 5412 | 219 | 90.75 | glotblastn |
| WNU19_H182 | amborella\|12v3\|CK743454_P1 | 2220 | 5413 | 219 | 90.7 | globlastp |
| WNU19_H183 | arabidopsis\|10v1\|AT1G56070_P1 | 2221 | 5414 | 219 | 90.7 | globlastp |
| WNU19_H184 | arnica\|11v1\|SRR099034X10148_P1 | 2222 | 5415 | 219 | 90.7 | globlastp |
| WNU19_H185 | b_rapa\|11v1\|CD816353_P1 | 2223 | 5416 | 219 | 90.7 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU19_H186 | flaveria\|11v1\|SRR149229.209223_P1 | 2224 | 5417 | 219 | 90.7 | globlastp |
| WNU19_H187 | podocarpus\|10v1\|SRR065014S0003736_P1 | 2225 | 5418 | 219 | 90.7 | globlastp |
| WNU19_H188 | ambrosia\|11v1\|SRR346935.102533_T1 | 2226 | 5419 | 219 | 90.63 | glotblastn |
| WNU19_H189 | flaveria\|11v1\|SRR149229.19714_T1 | 2227 | 5420 | 219 | 90.63 | glotblastn |
| WNU19_H190 | beet\|12v1\|AW777202_P1 | 2228 | 5421 | 219 | 90.6 | globlastp |
| WNU19_H191 | pigeonpea\|11v1\|SRR054580X127546_P1 | 2229 | 5422 | 219 | 90.6 | globlastp |
| WNU19_H192 | thellungiella_halophilum\|11v1\|EHPRD038761 | 2230 | 5423 | 219 | 90.53 | glotblastn |
| WNU19_H193 | gnetum\|10v1\|SRR064399S0000663_T1 | 2231 | 5424 | 219 | 90.51 | glotblastn |
| WNU19_H194 | barley\|12v1\|HV12v1PRD005943_P1 | 2232 | 5425 | 219 | 90.5 | globlastp |
| WNU19_H195 | silene\|11v1\|SRR096785X102916 | 2233 | 5426 | 219 | 90.5 | globlastp |
| WNU19_H286 | monkeyflower\|12v1\|GR149027_P1 | 2234 | 5427 | 219 | 90.4 | globlastp |
| WNU19_H196 | amsonia\|11v1\|SRR098688X10119_P1 | 2235 | 5428 | 219 | 90.4 | globlastp |
| WNU19_H197 | eschscholzia\|11v1\|CD478945_P1 | 2236 | 5429 | 219 | 90.4 | globlastp |
| WNU19_H199 | sunflower\|12v1\|DY932904 | 2237 | 5430 | 219 | 90.15 | glotblastn |
| WNU19_H200 | eschscholzia\|11v1\|CD480167_T1 | 2238 | 5431 | 219 | 90.04 | glotblastn |
| WNU19_H201 | lettuce\|12v1\|DW121631_P1 | 2239 | 5432 | 219 | 90 | globlastp |
| WNU19_H202 | thellungiella_parvulum\|11v1\|DN774158 | 2240 | 5433 | 219 | 90 | globlastp |
| WNU19_H203 | rye\|12v1\|DRR001012.232598 | 2241 | 5434 | 219 | 89.9 | globlastp |
| WNU19_H204 | fern\|gb171\|BP911956_P1 | 2242 | 5435 | 219 | 89.8 | globlastp |
| WNU19_H205 | pteridium\|11v1\|SRR043594X100314 | 2243 | 5436 | 219 | 89.68 | glotblastn |
| WNU19_H206 | ceratodon\|10v1\|SRR074890S0032700_P1 | 2244 | 5437 | 219 | 89.4 | globlastp |
| WNU19_H207 | ceratodon\|10v1\|SRR074890S0044795_P1 | 2245 | 5437 | 219 | 89.4 | globlastp |
| WNU19_H208 | ceratodon\|10v1\|SRR074890S0340761_P1 | 2246 | 5437 | 219 | 89.4 | globlastp |
| WNU19_H209 | ceratodon\|10v1\|SRR074890S0581270_P1 | 2247 | 5437 | 219 | 89.4 | globlastp |
| WNU19_H210 | ceratodon\|10v1\|SRR074891S0000040_P1 | 2248 | 5437 | 219 | 89.4 | globlastp |
| WNU19_H211 | phalaenopsis\|11v1\|CB032840_T1 | 2249 | 5438 | 219 | 89.32 | glotblastn |
| WNU19_H212 | apple\|11v1\|MDP0000362791_P1 | 2250 | 5439 | 219 | 89.3 | globlastp |
| WNU19_H213 | rye\|12v1\|DRR001012.192575 | 2251 | 5440 | 219 | 89.3 | globlastp |
| WNU19_H214 | foxtail_millet\|11v3\|EC612436_T1 | 2252 | 5441 | 219 | 89.24 | glotblastn |
| WNU19_H287 | nicotiana_benthamiana\|12v1\|BP747399_P1 | 2253 | 5442 | 219 | 89.2 | globlastp |
| WNU19_H215 | iceplant\|gb164\|BE033655_P1 | 2254 | 5443 | 219 | 89.2 | globlastp |
| WNU19_H216 | physcomitrella\|10v1\|BJ160823_P1 | 2255 | 5444 | 219 | 89.2 | globlastp |
| WNU19_H217 | physcomitrella\|10v1\|BJ170123_P1 | 2256 | 5444 | 219 | 89.2 | globlastp |
| WNU19_H218 | cirsium\|11v1\|SRR346952.108438_P1 | 2257 | 5445 | 219 | 89.1 | globlastp |
| WNU19_H219 | euonymus\|11v1\|SRR070038X105533_P1 | 2258 | 5446 | 219 | 89 | globlastp |
| WNU19_H220 | poppy\|11v1\|SRR030263.471933_T1 | 2259 | 5447 | 219 | 88.61 | glotblastn |
| WNU19_H221 | physcomitrella\|10v1\|AJ225456_P1 | 2260 | 5448 | 219 | 88.6 | globlastp |
| WNU19_H222 | physcomitrella\|10v1\|AW699268_P1 | 2261 | 5448 | 219 | 88.6 | globlastp |
| WNU19_H223 | marchantia\|gb166\|AU081662_P1 | 2262 | 5449 | 219 | 88.5 | globlastp |
| WNU19_H224 | triphysaria\|10v1\|BE574729 | 2263 | 5450 | 219 | 88.5 | globlastp |
| WNU19_H225 | aristolochia\|10v1\|SRR039082S0012185_P1 | 2264 | 5451 | 219 | 88.3 | globlastp |
| WNU19_H226 | thellungiella_parvulum\|11v1\|EPPRD007851 | 2265 | 5452 | 219 | 88.2 | globlastp |
| WNU19_H227 | rye\|12v1\|BE494935 | 2266 | 5453 | 219 | 88.02 | globlastp |
| WNU19_H228 | rice\|11v1\|CA758982 | 2267 | 5454 | 219 | 87.9 | globlastp |
| WNU19_H229 | b_rapa\|11v1\|DN960595_T1 | 2268 | 5455 | 219 | 87.78 | glotblastn |
| WNU19_H230 | poppy\|11v1\|SRR030259.100177_T1 | 2269 | 5456 | 219 | 87.78 | glotblastn |
| WNU19_H231 | arabidopsis\|10v1\|AT3G12915_T1 | 2270 | 5457 | 219 | 87.54 | glotblastn |
| WNU19_H232 | canola\|11v1\|EE482007_T1 | 2271 | 5458 | 219 | 87.29 | glotblastn |
| WNU19_H233 | arabidopsis_lyrata\|09v1\|JGIAL009721_P1 | 2272 | 5459 | 219 | 87.1 | globlastp |
| WNU19_H234 | flaveria\|11v1\|SRR149229.311595_P1 | 2273 | 5460 | 219 | 87 | globlastp |
| WNU19_H235 | rye\|12v1\|DRR001012.112903 | 2274 | 5461 | 219 | 86.95 | glotblastn |
| WNU19_H236 | millet\|10v1\|CD726649_P1 | 2275 | 5462 | 219 | 86.1 | globlastp |
| WNU19_H237 | rye\|12v1\|DRR001012.106277 | 2276 | 5463 | 219 | 86.1 | globlastp |
| WNU19_H238 | poppy\|11v1\|SRR030259.124447_T1 | 2277 | 5464 | 219 | 85.88 | glotblastn |
| WNU19_H239 | rye\|12v1\|DRR001012.190424 | 2278 | 5465 | 219 | 85.53 | glotblastn |
| WNU19_H240 | pine\|10v2\|AL751264_P1 | 2279 | 5466 | 219 | 85.3 | globlastp |
| WNU19_H241 | millet\|10v1\|CD726405_T1 | 2280 | 5467 | 219 | 85.29 | glotblastn |
| WNU19_H242 | poppy\|11v1\|SRR030259.104877_P1 | 2281 | 5468 | 219 | 85.2 | globlastp |
| WNU19_H243 | canola\|11v1\|DY030623_P1 | 2282 | 5469 | 219 | 84.8 | globlastp |
| WNU19_H244 | cirsium\|11v1\|SRR346952.122084_T1 | 2283 | 5470 | 219 | 84.7 | globlastp |
| WNU19_H245 | platanus\|11v1\|SRR096786X102681_P1 | 2284 | 5471 | 219 | 84.7 | globlastp |
| WNU19_H246 | rye\|12v1\|BE495426 | 2285 | 5472 | 219 | 84.7 | glotblastn |
| WNU19_H247 | thellungiella_parvulum\|11v1\|EPCRP021744 | 2286 | 5473 | 219 | 84.7 | globlastp |
| WNU19_H248 | sugarcane\|10v1\|BQ534204 | 2287 | 5474 | 219 | 84.6 | globlastp |
| WNU19_H249 | medicago\|12v1\|AL385115_P1 | 2288 | 5475 | 219 | 84.5 | globlastp |
| WNU19_H250 | rye\|12v1\|DRR001012.119895 | 2289 | 5476 | 219 | 84.4 | globlastp |
| WNU19_H251 | aristolochia\|10v1\|FD748819_P1 | 2290 | 5477 | 219 | 84.3 | globlastp |
| WNU19_H252 | pine\|10v2\|AW290225_T1 | 2291 | 5478 | 219 | 83.87 | glotblastn |
| WNU19_H253 | wheat\|12v3\|CA499280 | 2292 | 5479 | 219 | 83.87 | glotblastn |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU19_H254 | cotton\|11v1\|AI728565_P1 | 2293 | 5480 | 219 | 83.3 | globlastp |
| WNU19_H255 | trigonella\|11v1\|SRR066194X118373 | 2294 | 5481 | 219 | 83.3 | globlastp |
| WNU19_H256 | rye\|12v1\|DRR001012.198013 | 2295 | 5482 | 219 | 83.06 | glotblastn |
| WNU19_H257 | cucumber\|09v1\|CV003974_P1 | 2296 | 5483 | 219 | 82.8 | globlastp |
| WNU19_H258 | rye\|12v1\|BF145953 | 2297 | 5484 | 219 | 82.21 | glotblastn |
| WNU19_H259 | canola\|11v1\|CN731489_T1 | 2298 | 5485 | 219 | 81.97 | glotblastn |
| WNU19_H260 | poppy\|11v1\|SRR030259.106828_P1 | 2299 | 5486 | 219 | 81.7 | globlastp |
| WNU19_H261 | poppy\|11v1\|SRR030259.151268_T1 | 2300 | 5487 | 219 | 81.61 | glotblastn |
| WNU19_H262 | pigeonpea\|11v1\|SRR054580X132043_P1 | 2301 | 5488 | 219 | 81.5 | globlastp |
| WNU19_H263 | rye\|12v1\|BE705036 | 2302 | 5489 | 219 | 80.8 | globlastp |
| WNU19_H288 | bean\|12v2\|SRR090491.1128737_P1 | 2303 | 5490 | 219 | 80.7 | globlastp |
| WNU19_H264 | poppy\|11v1\|SRR030259.110118_T1 | 2304 | 5491 | 219 | 80.43 | glotblastn |
| WNU19_H265 | bean\|12v1\|SRR001335.271437 | 2305 | 5492 | 219 | 80.2 | globlastp |
| WNU19_H266 | pteridium\|11v1\|SRR043594X10372 | 2306 | 5493 | 219 | 80.07 | glotblastn |
| WNU20_H1 | wheat\|12v3\|BE500467 | 2307 | 5494 | 220 | 99.4 | globlastp |
| WNU20_H2 | rye\|12v1\|DRR001012.111146 | 2308 | 5495 | 220 | 98.9 | globlastp |
| WNU20_H3 | wheat\|12v3\|CD902583 | 2309 | 5496 | 220 | 98.9 | globlastp |
| WNU20_H4 | wheat\|12v3\|BE405418 | 2310 | 5497 | 220 | 98.7 | globlastp |
| WNU20_H5 | wheat\|12v3\|CD936120 | 2311 | 5498 | 220 | 98.7 | globlastp |
| WNU20_H6 | brachypodium\|12v1\|BRADI3G42010_P1 | 2312 | 5499 | 220 | 95.5 | globlastp |
| WNU20_H7 | oat\|11v1\|GO590260_P1 | 2313 | 5500 | 220 | 94.5 | globlastp |
| WNU20_H8 | rice\|11v1\|AA749701 | 2314 | 5501 | 220 | 90.9 | globlastp |
| WNU20_H9 | sorghum\|12v1\|SB07G025240 | 2315 | 5502 | 220 | 89.2 | globlastp |
| WNU20_H10 | sorghum\|12v1\|SB02G030270 | 2316 | 5503 | 220 | 88.9 | globlastp |
| WNU20_H11 | sugarcane\|10v1\|BQ533680 | 2317 | 5504 | 220 | 88.9 | globlastp |
| WNU20_H12 | foxtail_millet\|11v3\|PHY7SI029736M_P1 | 2318 | 5505 | 220 | 88.7 | globlastp |
| WNU20_H26 | switchgrass\|12v1\|DN146648_P1 | 2319 | 5506 | 220 | 88.5 | globlastp |
| WNU20_H13 | maize\|10v1\|AI491230_P1 | 2320 | 5507 | 220 | 88.3 | globlastp |
| WNU20_H14 | sugarcane\|10v1\|CA131260 | 2321 | 5508 | 220 | 88.3 | globlastp |
| WNU20_H15 | switchgrass\|gb167\|FL694429 | 2322 | 5509 | 220 | 88.3 | globlastp |
| LYD75_H35 | switchgrass\|12v1\|FE638577_P1 | 2323 | 5510 | 220 | 87.9 | globlastp |
| WNU20_H16 | millet\|10v1\|EVO454PM001616_P1 | 2324 | 5511 | 220 | 87.9 | globlastp |
| WNU20_H17 | cenchrus\|gb166\|EB656001_T1 | 2325 | 5512 | 220 | 87.23 | glotblastn |
| WNU20_H18 | rice\|11v1\|AU082931 | 2326 | 5513 | 220 | 87 | globlastp |
| WNU20_H19 | switchgrass\|gb167\|FE610787 | 2327 | 5514 | 220 | 80.7 | globlastp |
| WNU20_H27 | switchgrass\|12v1\|FE610787_P1 | 2328 | 5515 | 220 | 80.5 | globlastp |
| WNU20_H20 | brachypodium\|12v1\|BRADI1G77290_P1 | 2329 | 5516 | 220 | 80.5 | globlastp |
| WNU20_H21 | foxtail_millet\|11v3\|PHY7SI035565M_P1 | 2330 | 5517 | 220 | 80.5 | globlastp |
| WNU20_H22 | rice\|11v1\|BI796408 | 2331 | 5518 | 220 | 80.3 | globlastp |
| WNU20_H23 | sorghum\|12v1\|SB01G049310 | 2332 | 5519 | 220 | 80.3 | globlastp |
| WNU20_H24 | oil_palm\|11v1\|EL691753_P1 | 2333 | 5520 | 220 | 80.2 | globlastp |
| WNU20_H25 | maize\|10v1\|AW052854_P1 | 2334 | 5521 | 220 | 80 | globlastp |
| WNU22_H2 | rye\|12v1\|DRR001012.160458 | 2335 | 5522 | 222 | 90.8 | globlastp |
| WNU22_H3 | oat\|11v1\|GR353093_P1 | 2336 | 5523 | 222 | 81.5 | globlastp |
| WNU23_H1 | barley\|12v1\|AK367025_P1 | 2337 | 5524 | 223 | 99.8 | globlastp |
| WNU23_H2 | rye\|12v1\|BE586979 | 2338 | 5525 | 223 | 97.8 | globlastp |
| WNU23_H3 | wheat\|12v3\|BE401772 | 2339 | 5526 | 223 | 97.51 | glotblastn |
| WNU23_H4 | pseudoroegneria\|gb167\|FF350262 | 2340 | 5527 | 223 | 97.5 | globlastp |
| WNU23_H5 | brachypodium\|12v1\|BRADI4G27550_P1 | 2341 | 5528 | 223 | 93.3 | globlastp |
| WNU23_H6 | oat\|11v1\|CN814765_P1 | 2342 | 5529 | 223 | 92.8 | globlastp |
| WNU23_H7 | sorghum\|12v1\|SB02G020360 | 2343 | 5530 | 223 | 82.8 | globlastp |
| WNU23_H8 | sugarcane\|10v1\|CA067379 | 2344 | 5531 | 223 | 81.3 | globlastp |
| WNU23_H9 | rice\|11v1\|AA231803 | 2345 | 5532 | 223 | 81.2 | globlastp |
| WNU23_H15 | switchgrass\|12v1\|FE603748_P1 | 2346 | 5533 | 223 | 80.9 | globlastp |
| WNU23_H10 | maize\|10v1\|ZMU66403_P1 | 2347 | 5534 | 223 | 80.9 | globlastp |
| WNU23_H11 | switchgrass\|gb167\|FE603748 | 2348 | 5535 | 223 | 80.4 | globlastp |
| WNU23_H12 | maize\|10v1\|ZMU66404_P1 | 2349 | 5536 | 223 | 80.2 | globlastp |
| WNU23_H13 | millet\|10v1\|EVO454PM003523_P1 | 2350 | 5537 | 223 | 80.2 | globlastp |
| WNU23_H14 | foxtail_millet\|11v3\|EC613874_P1 | 2351 | 5538 | 223 | 80.1 | globlastp |
| WNU25_H1 | wheat\|12v3\|BE399516 | 2352 | 224 | 224 | 100 | globlastp |
| WNU25_H2 | rye\|12v1\|DRR001012.10261 | 2353 | 5539 | 224 | 99.1 | globlastp |
| WNU25_H3 | oat\|11v1\|GO582349_P1 | 2354 | 5540 | 224 | 97.3 | globlastp |
| WNU25_H4 | oat\|11v1\|GO586833_P1 | 2355 | 5541 | 224 | 97.3 | globlastp |
| WNU25_H5 | lolium\|10v1\|AU250680_P1 | 2356 | 5542 | 224 | 96.4 | globlastp |
| WNU25_H6 | oat\|11v1\|GR318164_P1 | 2357 | 5543 | 224 | 96.4 | globlastp |
| WNU25_H7 | brachypodium\|12v1\|BRADI3G60180_P1 | 2358 | 5544 | 224 | 94.6 | globlastp |
| WNU25_H8 | cynodon\|10v1\|ES293470_P1 | 2359 | 5545 | 224 | 91.1 | globlastp |
| WNU25_H9 | cenchrus\|gb166\|EB654878_P1 | 2360 | 5546 | 224 | 90.2 | globlastp |
| WNU25_H10 | foxtail_millet\|11v3\|PHY7SI019343M_P1 | 2361 | 5546 | 224 | 90.2 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU25_H11 | millet\|10v1\|CD726269_P1 | 2362 | 5546 | 224 | 90.2 | globlastp |
| WNU25_H12 | millet\|10v1\|EVO454PM078222_P1 | 2363 | 5546 | 224 | 90.2 | globlastp |
| WNU25_H243 | switchgrass\|12v1\|DN144110_P1 | 2364 | 5547 | 224 | 89.3 | globlastp |
| WNU25_H13 | lovegrass\|gb167\|EH184754_P1 | 2365 | 5548 | 224 | 89.3 | globlastp |
| WNU25_H14 | maize\|10v1\|AI586898_P1 | 2366 | 5549 | 224 | 89.3 | globlastp |
| WNU25_H15 | maize\|10v1\|AI920462_P1 | 2367 | 5550 | 224 | 89.3 | globlastp |
| WNU25_H16 | *sorghum*\|12v1\|SB04G035260 | 2368 | 5551 | 224 | 89.3 | globlastp |
| WNU25_H17 | sugarcane\|10v1\|CA085045 | 2369 | 5551 | 224 | 89.3 | globlastp |
| WNU25_H18 | switchgrass\|gb167\|DN144110 | 2370 | 5547 | 224 | 89.3 | globlastp |
| WNU25_H19 | switchgrass\|gb167\|FE605308 | 2371 | 5552 | 224 | 89.3 | globlastp |
| WNU25_H244 | switchgrass\|12v1\|FE605308_T1 | 2372 | 5553 | 224 | 89.29 | glotblastn |
| WNU25_H20 | barley\|12v1\|BF621135_P1 | 2373 | 5554 | 224 | 88.4 | globlastp |
| WNU25_H21 | foxtail_millet\|11v3\|EC613076_P1 | 2374 | 5555 | 224 | 88.4 | globlastp |
| WNU25_H22 | maize\|10v1\|AI861705_P1 | 2375 | 5555 | 224 | 88.4 | globlastp |
| WNU25_H23 | oat\|11v1\|GO585912_P1 | 2376 | 5556 | 224 | 88.4 | globlastp |
| WNU25_H24 | *sorghum*\|12v1\|SB02G022800 | 2377 | 5555 | 224 | 88.4 | globlastp |
| WNU25_H25 | *sorghum*\|12v1\|SB10G006160 | 2378 | 5555 | 224 | 88.4 | globlastp |
| WNU25_H26 | sugarcane\|10v1\|CA073479 | 2379 | 5555 | 224 | 88.4 | globlastp |
| WNU25_H27 | sugarcane\|10v1\|CA080489 | 2380 | 5555 | 224 | 88.4 | globlastp |
| WNU25_H28 | switchgrass\|gb167\|DN144952 | 2381 | 5555 | 224 | 88.4 | globlastp |
| WNU25_H29 | wheat\|12v3\|CA617426 | 2382 | 5557 | 224 | 88.4 | globlastp |
| WNU25_H245 | switchgrass\|12v1\|DN144952_P1 | 2383 | 5558 | 224 | 87.5 | globlastp |
| WNU25_H30 | *brachypodium*\|12v1\|BRADI1G46840T2_P1 | 2384 | 5559 | 224 | 87.5 | globlastp |
| WNU25_H31 | maize\|10v1\|AI649449_P1 | 2385 | 5560 | 224 | 87.5 | globlastp |
| WNU25_H32 | oat\|11v1\|GO587688_P1 | 2386 | 5561 | 224 | 87.5 | globlastp |
| WNU25_H33 | *pseudoroegneria*\|gb167\|FF340444 | 2387 | 5562 | 224 | 87.5 | globlastp |
| WNU25_H34 | rice\|11v1\|BI798607 | 2388 | 5563 | 224 | 87.5 | globlastp |
| WNU25_H35 | wheat\|12v3\|CA484758 | 2389 | 5564 | 224 | 87.5 | globlastp |
| WNU25_H246 | switchgrass\|12v1\|FE598493_P1 | 2390 | 5565 | 224 | 86.6 | globlastp |
| WNU25_H36 | *brachypodium*\|12v1\|BRADI4G16690T3_P1 | 2391 | 5566 | 224 | 86.6 | globlastp |
| WNU25_H37 | rye\|12v1\|BE587162 | 2392 | 5567 | 224 | 86.6 | globlastp |
| WNU25_H38 | rye\|12v1\|DRR001012.117644 | 2393 | 5567 | 224 | 86.6 | globlastp |
| WNU25_H39 | rye\|12v1\|DRR001012.126188 | 2394 | 5567 | 224 | 86.6 | globlastp |
| WNU25_H40 | rye\|12v1\|DRR001013.116024 | 2395 | 5567 | 224 | 86.6 | globlastp |
| WNU25_H41 | switchgrass\|gb167\|FE598493 | 2396 | 5565 | 224 | 86.6 | globlastp |
| WNU25_H42 | wheat\|12v3\|BE398239 | 2397 | 5568 | 224 | 86.6 | globlastp |
| WNU25_H43 | wheat\|12v3\|BE415850 | 2398 | 5568 | 224 | 86.6 | globlastp |
| WNU25_H247 | switchgrass\|12v1\|FE612122_P1 | 2399 | 5569 | 224 | 84.8 | globlastp |
| WNU25_H248 | switchgrass\|12v1\|FL823395_P1 | 2400 | 5570 | 224 | 84.8 | globlastp |
| WNU25_H44 | millet\|10v1\|EVO454PM026346_P1 | 2401 | 5569 | 224 | 84.8 | globlastp |
| WNU25_H45 | switchgrass\|gb167\|FE612122 | 2402 | 5570 | 224 | 84.8 | globlastp |
| WNU25_H46 | thellungiella_parvulum\|11v1\|EC599854 | 2403 | 5571 | 224 | 83.93 | glotblastn |
| WNU25_H47 | foxtail_millet\|11v3\|PHY7SI023690M_P1 | 2404 | 5572 | 224 | 83.9 | globlastp |
| WNU25_H48 | sugarcane\|10v1\|CA280291 | 2405 | 5573 | 224 | 83.9 | globlastp |
| WNU25_H49 | oil_palm\|11v1\|EL682917_T1 | 2406 | 5574 | 224 | 83.04 | glotblastn |
| WNU25_H50 | *cenchrus*\|gb166\|EB652816_P1 | 2407 | 5575 | 224 | 83 | globlastp |
| WNU25_H51 | oil_palm\|11v1\|EL683598_P1 | 2408 | 5576 | 224 | 83 | globlastp |
| WNU25_H52 | oil_palm\|11v1\|EL693872_P1 | 2409 | 5576 | 224 | 83 | globlastp |
| WNU25_H53 | oil_palm\|11v1\|SRR190698.190267_P1 | 2410 | 5576 | 224 | 83 | globlastp |
| WNU25_H54 | *phalaenopsis*\|11v1\|CK856294_P1 | 2411 | 5577 | 224 | 83 | globlastp |
| WNU25_H55 | pineapple\|10v1\|DT336564_P1 | 2412 | 5578 | 224 | 83 | globlastp |
| WNU25_H56 | *sorghum*\|12v1\|SB09G027930 | 2413 | 5579 | 224 | 83 | globlastp |
| WNU25_H57 | *tripterygium*\|11v1\|SRR098677X101244 | 2414 | 5580 | 224 | 83 | globlastp |
| WNU25_H58 | onion\|12v1\|SRR073446X10568D1_T1 | 2415 | 5581 | 224 | 82.14 | glotblastn |
| WNU25_H59 | *ambrosia*\|11v1\|SRR346943.142368_P1 | 2416 | 5582 | 224 | 82.1 | globlastp |
| WNU25_H60 | *ambrosia*\|11v1\|SRR346943.21771_P1 | 2417 | 5582 | 224 | 82.1 | globlastp |
| WNU25_H61 | *amorphophallus*\|11v2\|SRR089351X101954_P1 | 2418 | 5583 | 224 | 82.1 | globlastp |
| WNU25_H62 | arabidopsis_lyrata\|09v1\|JGIAL007699_P1 | 2419 | 5584 | 224 | 82.1 | globlastp |
| WNU25_H63 | arabidopsis\|10v1\|AT1G74270_P1 | 2420 | 5584 | 224 | 82.1 | globlastp |
| WNU25_H64 | *arnica*\|11v1\|SRR099034X108607_P1 | 2421 | 5585 | 224 | 82.1 | globlastp |
| WNU25_H65 | banana\|12v1\|FL646653_P1 | 2422 | 5586 | 224 | 82.1 | globlastp |
| WNU25_H66 | banana\|12v1\|FL657827_P1 | 2423 | 5587 | 224 | 82.1 | globlastp |
| WNU25_H67 | banana\|12v1\|FL658310_P1 | 2424 | 5588 | 224 | 82.1 | globlastp |
| WNU25_H68 | *brachypodium*\|12v1\|BRADI2G17180_P1 | 2425 | 5589 | 224 | 82.1 | globlastp |
| WNU25_H69 | *epimedium*\|11v1\|SRR013502.11986_P1 | 2426 | 5590 | 224 | 82.1 | globlastp |
| WNU25_H70 | *fagopyrum*\|11v1\|SRR063703X132083_P1 | 2427 | 5591 | 224 | 82.1 | globlastp |
| WNU25_H71 | *flaveria*\|11v1\|SRR149229.210796_P1 | 2428 | 5592 | 224 | 82.1 | globlastp |
| WNU25_H72 | oil_palm\|11v1\|EL681302_P1 | 2429 | 5593 | 224 | 82.1 | globlastp |
| WNU25_H73 | oil_palm\|11v1\|EL690268_P1 | 2430 | 5593 | 224 | 82.1 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU25_H74 | oil_palm|11v1|SRR190698.163775_P1 | 2431 | 5593 | 224 | 82.1 | globlastp |
| WNU25_H75 | oil_palm|11v1|SRR190698.471823_P1 | 2432 | 5593 | 224 | 82.1 | globlastp |
| WNU25_H76 | oil_palm|11v1|SRR190700.314411_P1 | 2433 | 5593 | 224 | 82.1 | globlastp |
| WNU25_H77 | onion|12v1|SRR073446X102051D1_P1 | 2434 | 5594 | 224 | 82.1 | globlastp |
| WNU25_H78 | primula|11v1|SRR098679X100031_P1 | 2435 | 5595 | 224 | 82.1 | globlastp |
| WNU25_H79 | primula|11v1|SRR098679X101714_P1 | 2436 | 5595 | 224 | 82.1 | globlastp |
| WNU25_H80 | primula|11v1|SRR098679X121607_P1 | 2437 | 5595 | 224 | 82.1 | globlastp |
| WNU25_H81 | primula|11v1|SRR098679X131815_P1 | 2438 | 5595 | 224 | 82.1 | globlastp |
| WNU25_H82 | thellungiella_halophilum|11v1|EHJGI11002045 | 2439 | 5596 | 224 | 82.1 | globlastp |
| WNU25_H83 | thellungiella_parvulum|11v1|EPCRP000289 | 2440 | 5597 | 224 | 82.1 | globlastp |
| WNU25_H84 | b_rapa|11v1|BG545012_T1 | 2441 | 5598 | 224 | 81.25 | glotblastn |
| WNU25_H85 | heritiera|10v1|SRR005795S0038179_T1 | 2442 | 5599 | 224 | 81.25 | glotblastn |
| WNU25_H86 | primula|11v1|SRR098679X114257_T1 | 2443 | 5600 | 224 | 81.25 | glotblastn |
| WNU25_H87 | primula|11v1|SRR098679X130378_T1 | 2444 | 5601 | 224 | 81.25 | glotblastn |
| WNU25_H88 | rye|12v1|DRR001013.103374 | 2445 | 5602 | 224 | 81.25 | glotblastn |
| WNU25_H89 | thellungiella_halophilum|11v1|EC599854 | 2446 | 5603 | 224 | 81.25 | glotblastn |
| WNU25_H249 | zostera|12v1|AM766870_P1 | 2447 | 5604 | 224 | 81.2 | globlastp |
| WNU25_H90 | amborella|12v3|FD442449_P1 | 2448 | 5605 | 224 | 81.2 | globlastp |
| WNU25_H91 | ambrosia|11v1|SRR346943.215855_P1 | 2449 | 5606 | 224 | 81.2 | globlastp |
| WNU25_H92 | amorphophallus|11v2|SRR089351X100036_P1 | 2450 | 5607 | 224 | 81.2 | globlastp |
| WNU25_H93 | amsonia|11v1|SRR098688X104552_P1 | 2451 | 5608 | 224 | 81.2 | globlastp |
| WNU25_H94 | antirrhinum|gb166|AJ558790_P1 | 2452 | 5609 | 224 | 81.2 | globlastp |
| WNU25_H95 | antirrhinum|gb166|AJ559611_P1 | 2453 | 5609 | 224 | 81.2 | globlastp |
| WNU25_H96 | aquilegia|10v2|JGIAC007651_P1 | 2454 | 5610 | 224 | 81.2 | globlastp |
| WNU25_H97 | arabidopsis_lyrata|09v1|JGIAL000666_P1 | 2455 | 5611 | 224 | 81.2 | globlastp |
| WNU25_H98 | arabidopsis|10v1|AT1G07070_P1 | 2456 | 5611 | 224 | 81.2 | globlastp |
| WNU25_H99 | b_juncea|12v1|E6ANDIZ01AH3RZ_P1 | 2457 | 5612 | 224 | 81.2 | globlastp |
| WNU25_H100 | b_juncea|12v1|E6ANDIZ01AL5IF_P1 | 2458 | 5612 | 224 | 81.2 | globlastp |
| WNU25_H101 | b_juncea|12v1|E6ANDIZ01AMZL3_P1 | 2459 | 5612 | 224 | 81.2 | globlastp |
| WNU25_H102 | b_juncea|12v1|E6ANDIZ01AZ4GX_P1 | 2460 | 5612 | 224 | 81.2 | globlastp |
| WNU25_H103 | b_juncea|12v1|E6ANDIZ01BFBB2_P1 | 2461 | 5612 | 224 | 81.2 | globlastp |
| WNU25_H104 | b_juncea|12v1|E6ANDIZ01BGXW0_P1 | 2462 | 5613 | 224 | 81.2 | globlastp |
| WNU25_H105 | b_juncea|12v1|E6ANDIZ01C4ROX_P1 | 2463 | 5612 | 224 | 81.2 | globlastp |
| WNU25_H106 | b_oleracea|gb161|DY027311_P1 | 2464 | 5612 | 224 | 81.2 | globlastp |
| WNU25_H107 | b_oleracea|gb161|DY028809_P1 | 2465 | 5612 | 224 | 81.2 | globlastp |
| WNU25_H108 | b_oleracea|gb161|DY029302_P1 | 2466 | 5612 | 224 | 81.2 | globlastp |
| WNU25_H109 | b_rapa|11v1|BG544760_P1 | 2467 | 5612 | 224 | 81.2 | globlastp |
| WNU25_H110 | b_rapa|11v1|CD822482_P1 | 2468 | 5612 | 224 | 81.2 | globlastp |
| WNU25_H111 | banana|12v1|ES432695_P1 | 2469 | 5614 | 224 | 81.2 | globlastp |
| WNU25_H112 | beech|11v1|SRR006293.11373_P1 | 2470 | 5615 | 224 | 81.2 | globlastp |
| WNU25_H113 | beech|11v1|SRR006293.24985_P1 | 2471 | 5616 | 224 | 81.2 | globlastp |
| WNU25_H114 | bruguiera|gb166|BP941824_P1 | 2472 | 5617 | 224 | 81.2 | globlastp |
| WNU25_H115 | canola|11v1|CN725900_P1 | 2473 | 5612 | 224 | 81.2 | globlastp |
| WNU25_H116 | canola|11v1|CN730046_P1 | 2474 | 5612 | 224 | 81.2 | globlastp |
| WNU25_H117 | canola|11v1|CN730557_P1 | 2475 | 5612 | 224 | 81.2 | globlastp |
| WNU25_H118 | canola|11v1|CN731259_P1 | 2476 | 5612 | 224 | 81.2 | globlastp |
| WNU25_H119 | canola|11v1|CN732999_P1 | 2477 | 5612 | 224 | 81.2 | globlastp |
| WNU25_H120 | canola|11v1|SRR019556.44642_P1 | 2478 | 5612 | 224 | 81.2 | globlastp |
| WNU25_H121 | cassava|09v1|CK651690_P1 | 2479 | 5618 | 224 | 81.2 | globlastp |
| WNU25_H122 | chelidonium|11v1|SRR084752X103833_P1 | 2480 | 5619 | 224 | 81.2 | globlastp |
| WNU25_H123 | cleome_spinosa|10v1|GR932649_P1 | 2481 | 5620 | 224 | 81.2 | globlastp |
| WNU25_H124 | cleome_spinosa|10v1|SRR015531S0108810_P1 | 2482 | 5620 | 224 | 81.2 | globlastp |
| WNU25_H125 | fagopyrum|11v1|SRR063689X106014_P1 | 2483 | 5621 | 224 | 81.2 | globlastp |
| WNU25_H126 | fagopyrum|11v1|SRR063689X111531_P1 | 2484 | 5622 | 224 | 81.2 | globlastp |
| WNU25_H127 | flaveria|11v1|SRR149229.179279_P1 | 2485 | 5623 | 224 | 81.2 | globlastp |
| WNU25_H128 | flaveria|11v1|SRR149232.144363_P1 | 2486 | 5623 | 224 | 81.2 | globlastp |
| WNU25_H129 | flaveria|11v1|SRR149232.247406_P1 | 2487 | 5623 | 224 | 81.2 | globlastp |
| WNU25_H130 | ipomoea_nil|10v1|BJ558540_P1 | 2488 | 5624 | 224 | 81.2 | globlastp |
| WNU25_H131 | lettuce|12v1|DW050731_P1 | 2489 | 5625 | 224 | 81.2 | globlastp |
| WNU25_H132 | onion|12v1|BQ579934_P1 | 2490 | 5626 | 224 | 81.2 | globlastp |
| WNU25_H133 | poppy|11v1|SRR096789.144347_P1 | 2491 | 5619 | 224 | 81.2 | globlastp |
| WNU25_H134 | primula|11v1|SRR098679X10523_P1 | 2492 | 5627 | 224 | 81.2 | globlastp |
| WNU25_H135 | primula|11v1|SRR098679X106162_P1 | 2493 | 5627 | 224 | 81.2 | globlastp |
| WNU25_H136 | radish|gb164|EV528423 | 2494 | 5612 | 224 | 81.2 | globlastp |
| WNU25_H137 | radish|gb164|EV535096 | 2495 | 5612 | 224 | 81.2 | globlastp |
| WNU25_H138 | radish|gb164|EV536363 | 2496 | 5612 | 224 | 81.2 | globlastp |
| WNU25_H139 | radish|gb164|EV538123 | 2497 | 5612 | 224 | 81.2 | globlastp |
| WNU25_H140 | radish|gb164|EV566939 | 2498 | 5612 | 224 | 81.2 | globlastp |
| WNU25_H141 | radish|gb164|FD538891 | 2499 | 5612 | 224 | 81.2 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU25_H142 | rice\|11v1\|AU063148 | 2500 | 5628 | 224 | 81.2 | globlastp |
| WNU25_H143 | rice\|11v1\|BE040487 | 2501 | 5628 | 224 | 81.2 | globlastp |
| WNU25_H144 | rye\|12v1\|BE494253 | 2502 | 5629 | 224 | 81.2 | globlastp |
| WNU25_H145 | rye\|12v1\|DRR001012.183966 | 2503 | 5630 | 224 | 81.2 | globlastp |
| WNU25_H146 | rye\|12v1\|DRR001013.308355 | 2504 | 5630 | 224 | 81.2 | globlastp |
| WNU25_H147 | tabernaemontana\|11v1\|SRR098689X128000 | 2505 | 5631 | 224 | 81.2 | globlastp |
| WNU25_H148 | zostera\|10v1\|AM766870 | 2506 | 5604 | 224 | 81.2 | globlastp |
| WNU25_H250 | olea\|13v1\|SRR014463X3883D1_P1 | 2507 | 5632 | 224 | 80.4 | globlastp |
| WNU25_H251 | olea\|13v1\|SRR014464X66765D1_P1 | 2508 | 5633 | 224 | 80.4 | globlastp |
| WNU25_H252 | olea\|13v1\|SRR592583X243645D1_P1 | 2509 | 5632 | 224 | 80.4 | globlastp |
| WNU25_H149 | acacia\|10v1\|FS584555_P1 | 2510 | 5634 | 224 | 80.4 | globlastp |
| WNU25_H150 | ambrosia\|11v1\|GR935755_P1 | 2511 | 5635 | 224 | 80.4 | globlastp |
| WNU25_H151 | ambrosia\|11v1\|SRR346943.114688_P1 | 2512 | 5636 | 224 | 80.4 | globlastp |
| WNU25_H152 | antirrhinum\|gb166\|AJ559172_P1 | 2513 | 5637 | 224 | 80.4 | globlastp |
| WNU25_H153 | bruguiera\|gb166\|BP942309_P1 | 2514 | 5638 | 224 | 80.4 | globlastp |
| WNU25_H154 | bupleurum\|11v1\|FG341999_P1 | 2515 | 5639 | 224 | 80.4 | globlastp |
| WNU25_H155 | cannabis\|12v1\|JK496655_P1 | 2516 | 5640 | 224 | 80.4 | globlastp |
| WNU25_H156 | cannabis\|12v1\|SOLX00016128_P1 | 2517 | 5640 | 224 | 80.4 | globlastp |
| WNU25_H157 | canola\|11v1\|CN730086_P1 | 2518 | 5641 | 224 | 80.4 | globlastp |
| WNU25_H158 | cassava\|09v1\|BM259993_P1 | 2519 | 5642 | 224 | 80.4 | globlastp |
| WNU25_H159 | clementine\|11v1\|BQ622914_P1 | 2520 | 5643 | 224 | 80.4 | globlastp |
| WNU25_H160 | cleome_gynandra\|10v1\|SRR015532S0016650_P1 | 2521 | 5644 | 224 | 80.4 | globlastp |
| WNU25_H161 | cleome_spinosa\|10v1\|SRR015531S0002868_P1 | 2522 | 5645 | 224 | 80.4 | globlastp |
| WNU25_H162 | cleome_spinosa\|10v1\|SRR015531S0012716_P1 | 2523 | 5646 | 224 | 80.4 | globlastp |
| WNU25_H163 | cotton\|11v1\|AI728911_P1 | 2524 | 5642 | 224 | 80.4 | globlastp |
| WNU25_H164 | cotton\|11v1\|BE053043_P1 | 2525 | 5642 | 224 | 80.4 | globlastp |
| WNU25_H165 | cotton\|11v1\|BF275635_P1 | 2526 | 5642 | 224 | 80.4 | globlastp |
| WNU25_H166 | cotton\|11v1\|BG440681_P1 | 2527 | 5642 | 224 | 80.4 | globlastp |
| WNU25_H167 | cotton\|11v1\|CO097269_P1 | 2528 | 5642 | 224 | 80.4 | globlastp |
| WNU25_H168 | cotton\|11v1\|DR452454_P1 | 2529 | 5642 | 224 | 80.4 | globlastp |
| WNU25_H169 | epimedium\|11v2\|SRR013502.14401_P1 | 2530 | 5647 | 224 | 80.4 | globlastp |
| WNU25_H170 | eucalyptus\|11v2\|CT986860_P1 | 2531 | 5648 | 224 | 80.4 | globlastp |
| WNU25_H171 | euonymus\|11v1\|SRR070038X107385_P1 | 2532 | 5649 | 224 | 80.4 | globlastp |
| WNU25_H172 | euphorbia\|11v1\|BP958921_P1 | 2533 | 5650 | 224 | 80.4 | globlastp |
| WNU25_H173 | euphorbia\|11v1\|DV144443_P1 | 2534 | 5651 | 224 | 80.4 | globlastp |
| WNU25_H174 | spurge\|gb161\|DV144443 | 2534 | 5651 | 224 | 80.4 | globlastp |
| WNU25_H175 | fagopyrum\|11v1\|SRR063689X87577_P1 | 2535 | 5652 | 224 | 80.4 | globlastp |
| WNU25_H176 | flaveria\|11v1\|SRR149232.184670XX1_P1 | 2536 | 5653 | 224 | 80.4 | globlastp |
| WNU25_H177 | flaveria\|11v1\|SRR149232.246003_P1 | 2537 | 5653 | 224 | 80.4 | globlastp |
| WNU25_H178 | flaveria\|11v1\|SRR149241.133862_P1 | 2538 | 5654 | 224 | 80.4 | globlastp |
| WNU25_H179 | fraxinus\|11v1\|SRR058827.103553_P1 | 2539 | 5632 | 224 | 80.4 | globlastp |
| WNU25_H180 | fraxinus\|11v1\|SRR058827.11380_P1 | 2540 | 5632 | 224 | 80.4 | globlastp |
| WNU25_H181 | fraxinus\|11v1\|SRR058827.116732_P1 | 2541 | 5655 | 224 | 80.4 | globlastp |
| WNU25_H182 | gossypium_raimondii\|12v1\|AI728911_P1 | 2542 | 5642 | 224 | 80.4 | globlastp |
| WNU25_H183 | gossypium_raimondii\|12v1\|BE053043_P1 | 2543 | 5642 | 224 | 80.4 | globlastp |
| WNU25_H184 | gossypium_raimondii\|12v1\|BF275635_P1 | 2544 | 5642 | 224 | 80.4 | globlastp |
| WNU25_H185 | gossypium_raimondii\|12v1\|BG440681_P1 | 2545 | 5642 | 224 | 80.4 | globlastp |
| WNU25_H186 | heritiera\|10v1\|SRR005794S0005077_P1 | 2546 | 5656 | 224 | 80.4 | globlastp |
| WNU25_H187 | hevea\|10v1\|EC606310_P1 | 2547 | 5642 | 224 | 80.4 | globlastp |
| WNU25_H188 | hornbeam\|12v1\|SRR364455.104699_P1 | 2548 | 5657 | 224 | 80.4 | globlastp |
| WNU25_H189 | humulus\|11v1\|ES655136_P1 | 2549 | 5658 | 224 | 80.4 | globlastp |
| WNU25_H190 | humulus\|11v1\|ES658210_P1 | 2550 | 5659 | 224 | 80.4 | globlastp |
| WNU25_H191 | ipomoea_batatas\|10v1\|BU690618_P1 | 2551 | 5660 | 224 | 80.4 | globlastp |
| WNU25_H192 | ipomoea_nil\|10v1\|BJ562851_P1 | 2552 | 5661 | 224 | 80.4 | globlastp |
| WNU25_H193 | kiwi\|gb166\|FG456793_P1 | 2553 | 5662 | 224 | 80.4 | globlastp |
| WNU25_H194 | kiwi\|gb166\|FG480841_P1 | 2554 | 5663 | 224 | 80.4 | globlastp |
| WNU25_H195 | kiwi\|gb166\|FG499198_P1 | 2555 | 5663 | 224 | 80.4 | globlastp |
| WNU25_H196 | lettuce\|12v1\|DW051774_P1 | 2556 | 5664 | 224 | 80.4 | globlastp |
| WNU25_H197 | liquorice\|gb171\|FS250698_P1 | 2557 | 5665 | 224 | 80.4 | globlastp |
| WNU25_H198 | oak\|10v1\|DN950044_P1 | 2558 | 5666 | 224 | 80.4 | globlastp |
| WNU25_H199 | oak\|10v1\|SRR006307S0004443_P1 | 2559 | 5666 | 224 | 80.4 | globlastp |
| WNU25_H200 | olea\|11v1\|SRR014463.28420 | 2560 | 5632 | 224 | 80.4 | globlastp |
| WNU25_H200 | olea\|13v1\|SRR014463X28420D1_P1 | 2561 | 5632 | 224 | 80.4 | globlastp |
| WNU25_H201 | olea\|11v1\|SRR014463.55804 | 2562 | 5667 | 224 | 80.4 | globlastp |
| WNU25_H201 | olea\|13v1\|SRR014463X55804D1_P1 | 2563 | 5632 | 224 | 80.4 | globlastp |
| WNU25_H202 | olea\|11v1\|SRR014463.6958 | 2564 | 5668 | 224 | 80.4 | globlastp |
| WNU25_H202 | olea\|13v1\|SRR014463X6958D1_P1 | 2565 | 5668 | 224 | 80.4 | globlastp |
| WNU25_H203 | onion\|12v1\|SRR073446X110592D1_P1 | 2566 | 5669 | 224 | 80.4 | globlastp |
| WNU25_H204 | onion\|12v1\|SRR073446X116492D1_P1 | 2567 | 5669 | 224 | 80.4 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU25_H205 | onion\|12v1\|SRR073447X101052D1_P1 | 2568 | 5670 | 224 | 80.4 | globlastp |
| WNU25_H206 | orange\|11v1\|BQ622914_P1 | 2569 | 5643 | 224 | 80.4 | globlastp |
| WNU25_H207 | orobanche\|10v1\|SRR023189S0006021_P1 | 2570 | 5671 | 224 | 80.4 | globlastp |
| WNU25_H208 | orobanche\|10v1\|SRR023189S0033892_P1 | 2571 | 5671 | 224 | 80.4 | globlastp |
| WNU25_H209 | papaya\|gb165\|EX241854_P1 | 2572 | 5672 | 224 | 80.4 | globlastp |
| WNU25_H210 | plantago\|11v2\|SRR066373X102923_P1 | 2573 | 5673 | 224 | 80.4 | globlastp |
| WNU25_H211 | plantago\|11v2\|SRR066373X104364_P1 | 2574 | 5674 | 224 | 80.4 | globlastp |
| WNU25_H212 | plantago\|11v2\|SRR066373X105650_P1 | 2575 | 5673 | 224 | 80.4 | globlastp |
| WNU25_H213 | platanus\|11v1\|SRR096786X100809_P1 | 2576 | 5675 | 224 | 80.4 | globlastp |
| WNU25_H214 | platanus\|11v1\|SRR096786X109435_P1 | 2577 | 5676 | 224 | 80.4 | globlastp |
| WNU25_H215 | poplar\|10v1\|AI166233 | 2578 | 5677 | 224 | 80.4 | globlastp |
| WNU25_H215 | poplar\|13v1\|AI166233_P1 | 2579 | 5677 | 224 | 80.4 | globlastp |
| WNU25_H216 | poplar\|10v1\|BU814801 | 2580 | 5678 | 224 | 80.4 | globlastp |
| WNU25_H216 | poplar\|13v1\|AI161628_P1 | 2581 | 5678 | 224 | 80.4 | globlastp |
| WNU25_H217 | poppy\|11v1\|SRR030259.179909_P1 | 2582 | 5679 | 224 | 80.4 | globlastp |
| WNU25_H218 | potato\|10v1\|AJ489116_P1 | 2583 | 5680 | 224 | 80.4 | globlastp |
| WNU25_H219 | rose\|12v1\|BI977765 | 2584 | 5681 | 224 | 80.4 | globlastp |
| WNU25_H220 | scabiosa\|11v1\|SRR063723X10401 | 2585 | 5682 | 224 | 80.4 | globlastp |
| WNU25_H221 | scabiosa\|11v1\|SRR063723X104236 | 2586 | 5682 | 224 | 80.4 | globlastp |
| WNU25_H222 | scabiosa\|11v1\|SRR063723X104248 | 2587 | 5682 | 224 | 80.4 | globlastp |
| WNU25_H223 | sesame\|12v1\|BU669934 | 2588 | 5683 | 224 | 80.4 | globlastp |
| WNU25_H224 | solanum_phureja\|09v1\|SPHBG126911 | 2589 | 5680 | 224 | 80.4 | globlastp |
| WNU25_H225 | strawberry\|11v1\|CO379975 | 2590 | 5684 | 224 | 80.4 | globlastp |
| WNU25_H226 | sunflower\|12v1\|CD852047 | 2591 | 5685 | 224 | 80.4 | globlastp |
| WNU25_H227 | sunflower\|12v1\|DY930840 | 2592 | 5685 | 224 | 80.4 | globlastp |
| WNU25_H228 | sunflower\|12v1\|EE654475 | 2593 | 5685 | 224 | 80.4 | globlastp |
| WNU25_H229 | sunflower\|12v1\|EL487963 | 2594 | 5685 | 224 | 80.4 | globlastp |
| WNU25_H230 | tamarix\|gb166\|CN605565 | 2595 | 5686 | 224 | 80.4 | globlastp |
| WNU25_H231 | thellungiella_parvulum\|11v1\|BY823299 | 2596 | 5687 | 224 | 80.4 | globlastp |
| WNU25_H232 | tobacco\|gb162\|CV016860 | 2597 | 5688 | 224 | 80.4 | globlastp |
| WNU25_H233 | tripterygium\|11v1\|SRR098677X101214 | 2598 | 5689 | 224 | 80.4 | globlastp |
| WNU25_H234 | valeriana\|11v1\|SRR099039X139272 | 2599 | 5690 | 224 | 80.4 | globlastp |
| WNU25_H235 | watermelon\|11v1\|AM726796 | 2600 | 5651 | 224 | 80.4 | globlastp |
| WNU25_H156 | cannabis\|12v1\|SOLX00016128 | 2601 | — | 224 | 80.4 | globlastp |
| WNU25_H236 | amborella\|12v3\|SRR038635.86906_T1 | 2602 | 5691 | 224 | 80.36 | glotblastn |
| WNU25_H237 | chelidonium\|11v1\|SRR084752X110041XX1_T1 | 2603 | 5692 | 224 | 80.36 | glotblastn |
| WNU25_H238 | fraxinus\|11v1\|SRR058827.112628XX1_T1 | 2604 | 5693 | 224 | 80.36 | glotblastn |
| WNU25_H239 | onion\|12v1\|SRR073446X323707D1_T1 | 2605 | 5694 | 224 | 80.36 | glotblastn |
| WNU25_H240 | orobanche\|10v1\|SRR023189S0011510_T1 | 2606 | 5695 | 224 | 80.36 | glotblastn |
| WNU25_H241 | tamarix\|gb166\|EH054247 | 2607 | 5696 | 224 | 80.36 | glotblastn |
| WNU25_H242 | tomato\|11v1\|AF014810 | 2608 | 5697 | 224 | 80.36 | glotblastn |
| WNU26_H1 | wheat\|12v3\|BE406211 | 2609 | 5698 | 225 | 98.4 | globlastp |
| WNU26_H2 | rye\|12v1\|DRR001012.126564 | 2610 | 5699 | 225 | 96.8 | globlastp |
| WNU26_H3 | wheat\|12v3\|BE400479 | 2611 | 5700 | 225 | 96.8 | globlastp |
| WNU26_H4 | brachypodium\|12v1\|BRADI1G14290_P1 | 2612 | 5701 | 225 | 96 | globlastp |
| WNU26_H5 | wheat\|12v3\|BF484088 | 2613 | 5702 | 225 | 94.4 | globlastp |
| WNU26_H24 | switchgrass\|12v1\|FL933393_P1 | 2614 | 5703 | 225 | 93.7 | globlastp |
| WNU26_H6 | switchgrass\|gb167\|DN140893 | 2615 | 5703 | 225 | 93.7 | globlastp |
| WNU26_H7 | switchgrass\|gb167\|FL933393 | 2616 | 5703 | 225 | 93.7 | globlastp |
| WNU26_H25 | switchgrass\|12v1\|DN140893_P1 | 2617 | 5704 | 225 | 92.9 | globlastp |
| WNU26_H8 | maize\|10v1\|AI714588_P1 | 2618 | 5705 | 225 | 92.9 | globlastp |
| WNU26_H9 | oat\|11v1\|CN814979_P1 | 2619 | 5706 | 225 | 92.9 | globlastp |
| WNU26_H10 | sorghum\|12v1\|SB01G014170 | 2620 | 5705 | 225 | 92.9 | globlastp |
| WNU26_H11 | sugarcane\|10v1\|BQ531137 | 2621 | 5705 | 225 | 92.9 | globlastp |
| WNU26_H12 | cenchrus\|gb166\|EB654230_P1 | 2622 | 5707 | 225 | 92.1 | globlastp |
| WNU26_H13 | cynodon\|10v1\|ES292027_P1 | 2623 | 5708 | 225 | 91.3 | globlastp |
| WNU26_H14 | foxtail_millet\|11v3\|PHY7SI038038M_P1 | 2624 | 5709 | 225 | 91.3 | globlastp |
| WNU26_H15 | maize\|10v1\|BG841652_P1 | 2625 | 5710 | 225 | 91.3 | globlastp |
| WNU26_H16 | millet\|10v1\|EVO454PM036675_P1 | 2626 | 5711 | 225 | 91.3 | globlastp |
| WNU26_H17 | rice\|11v1\|AU029299 | 2627 | 5712 | 225 | 91.3 | globlastp |
| WNU26_H18 | banana\|12v1\|BBS2223T3_P1 | 2628 | 5713 | 225 | 81.7 | globlastp |
| WNU26_H19 | amorphophallus\|11v2\|SRR089351X107417_P1 | 2629 | 5714 | 225 | 81 | globlastp |
| WNU26_H20 | oil_palm\|11v1\|EL930593_P1 | 2630 | 5715 | 225 | 81 | globlastp |
| WNU26_H21 | aristolochia\|10v1\|SRR039082S0000924_P1 | 2631 | 5716 | 225 | 80.2 | globlastp |
| WNU26_H22 | fescue\|gb161\|DT702314_P1 | 2632 | 5717 | 225 | 80.2 | globlastp |
| WNU26_H23 | ginger\|gb164\|DY353684_P1 | 2633 | 5718 | 225 | 80.2 | globlastp |
| WNU27_H10 | rice\|11v1\|D45954 | 2634 | 5719 | 226 | 80.5 | globlastp |
| WNU28_H10 | rye\|12v1\|BE587449 | 2635 | 5720 | 227 | 82.84 | glotblastn |
| WNU28_H11 | rye\|12v1\|DRR001012.309192 | 2636 | 5721 | 227 | 82.84 | glotblastn |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU28_H14 | wheat\|12v3\|CA602648 | 2637 | 5722 | 227 | 82.09 | glotblastn |
| WNU28_H18 | wheat\|12v3\|BE445687 | 2638 | 5723 | 227 | 81 | globlastp |
| WNU28_H19 | wheat\|12v3\|BE406147 | 2639 | 5724 | 227 | 80.9 | globlastp |
| WNU28_H20 | rye\|12v1\|DRR001013.219293 | 2640 | 5725 | 227 | 80.3 | globlastp |
| WNU29_H1 | wheat\|12v3\|BE406488 | 2641 | 5726 | 228 | 93 | globlastp |
| WNU29_H2 | wheat\|12v3\|BE403792 | 2642 | 5727 | 228 | 91.8 | globlastp |
| WNU29_H3 | leymus\|gb166\|EG397801_P1 | 2643 | 5728 | 228 | 91.4 | globlastp |
| WNU29_H4 | pseudoroegneria\|gb167\|FF342698 | 2644 | 5729 | 228 | 91.4 | globlastp |
| WNU29_H5 | rye\|12v1\|BF145411 | 2645 | 5730 | 228 | 90.7 | globlastp |
| WNU29_H6 | rye\|12v1\|BF145631 | 2646 | 5731 | 228 | 90.7 | globlastp |
| WNU29_H7 | rye\|12v1\|DRR001012.113133 | 2647 | 5732 | 228 | 90.7 | globlastp |
| WNU29_H8 | rye\|12v1\|DRR001012.152886 | 2648 | 5732 | 228 | 90.7 | globlastp |
| WNU29_H9 | rye\|12v1\|BF146193 | 2649 | 5733 | 228 | 89.9 | globlastp |
| WNU29_H10 | rye\|12v1\|CD453333 | 2650 | 5734 | 228 | 87.94 | glotblastn |
| WNU29_H11 | lolium\|10v1\|DT671714_P1 | 2651 | 5735 | 228 | 86 | globlastp |
| WNU29_H12 | oat\|11v1\|CN820724_P1 | 2652 | 5736 | 228 | 86 | globlastp |
| WNU29_H13 | oat\|11v1\|GO591470_P1 | 2653 | 5736 | 228 | 86 | globlastp |
| WNU29_H14 | brachypodium\|12v1\|BRADI2G19230_P1 | 2654 | 5737 | 228 | 85.2 | globlastp |
| WNU29_H15 | rye\|12v1\|BE438598 | 2655 | 5738 | 228 | 84.44 | glotblastn |
| WNU29_H16 | switchgrass\|gb167\|FE646280 | 2656 | 5739 | 228 | 81.5 | globlastp |
| WNU29_H17 | cenchrus\|gb166\|EB652567_P1 | 2657 | 5740 | 228 | 81.4 | globlastp |
| WNU29_H18 | foxtail_millet\|11v3\|PHY7SI022465M_P1 | 2658 | 5741 | 228 | 81.2 | globlastp |
| WNU29_H22 | switchgrass\|12v1\|DN152053_P1 | 2659 | 5742 | 228 | 81.1 | globlastp |
| WNU29_H19 | switchgrass\|gb167\|DN152053 | 2660 | 5742 | 228 | 81.1 | globlastp |
| WNU29_H20 | sugarcane\|10v1\|CA072716 | 2661 | 5743 | 228 | 80.8 | globlastp |
| WNU29_H21 | millet\|10v1\|EVO454PM032994_P1 | 2662 | 5744 | 228 | 80.1 | globlastp |
| WNU30_H1 | wheat\|12v3\|BE418237 | 2663 | 5745 | 229 | 96.1 | globlastp |
| WNU30_H2 | rye\|12v1\|DRR001012.105664 | 2664 | 5746 | 229 | 95.7 | globlastp |
| WNU30_H3 | wheat\|12v3\|BE591687 | 2665 | 5747 | 229 | 94.7 | globlastp |
| WNU30_H4 | brachypodium\|12v1\|BRADI3G29797_P1 | 2666 | 5748 | 229 | 88.2 | globlastp |
| WNU30_H5 | oat\|11v1\|GR320126_P1 | 2667 | 5749 | 229 | 87.5 | globlastp |
| WNU30_H6 | millet\|10v1\|PMSLX0005022D1_P1 | 2668 | 5750 | 229 | 82.1 | globlastp |
| WNU30_H7 | foxtail_millet\|11v3\|PHY7SI035904M_P1 | 2669 | 5751 | 229 | 81.7 | globlastp |
| WNU30_H8 | maize\|10v1\|AI920364_P1 | 2670 | 5752 | 229 | 81.7 | globlastp |
| WNU30_H9 | rice\|11v1\|CA757830 | 2671 | 5753 | 229 | 80.6 | globlastp |
| WNU30_H10 | sorghum\|12v1\|SB01G018410 | 2672 | 5754 | 229 | 80.4 | globlastp |
| WNU31_H1 | rye\|12v1\|DRR001012.813021 | 2673 | 5755 | 230 | 93.3 | globlastp |
| WNU31_H2 | rye\|12v1\|DRR001012.207578 | 2674 | 5756 | 230 | 92.7 | globlastp |
| WNU31_H3 | brachypodium\|12v1\|BRADI1G18130_P1 | 2675 | 5757 | 230 | 82.6 | globlastp |
| WNU32_H1 | rye\|12v1\|DRR001012.118312 | 2676 | 5758 | 231 | 94 | globlastp |
| WNU32_H2 | wheat\|12v3\|BE516348 | 2677 | 5759 | 231 | 94 | globlastp |
| WNU32_H3 | oat\|11v1\|AF140553_T1 | 2678 | 5760 | 231 | 85.57 | glotblastn |
| WNU32_H4 | brachypodium\|12v1\|BRADI1G71570_P1 | 2679 | 5761 | 231 | 83.4 | globlastp |
| WNU33_H1 | wheat\|12v3\|BE637743 | 2680 | 5762 | 232 | 95.7 | globlastp |
| WNU33_H2 | rye\|12v1\|DRR001012.113659 | 2681 | 5763 | 232 | 94.2 | globlastp |
| WNU33_H3 | rye\|12v1\|DRR001012.7421 | 2682 | 5764 | 232 | 94.2 | globlastp |
| WNU33_H4 | brachypodium\|12v1\|BRADI4G44832_P1 | 2683 | 5765 | 232 | 91.3 | globlastp |
| WNU33_H19 | switchgrass\|12v1\|FL897048_P1 | 2684 | 5766 | 232 | 87 | globlastp |
| WNU33_H20 | switchgrass\|12v1\|GD035382_P1 | 2685 | 5766 | 232 | 87 | globlastp |
| WNU33_H5 | foxtail_millet\|11v3\|PHY7SI012551M_P1 | 2686 | 5766 | 232 | 87 | globlastp |
| WNU33_H6 | switchgrass\|gb167\|FL897048 | 2687 | 5766 | 232 | 87 | globlastp |
| WNU33_H7 | rice\|11v1\|CF325265 | 2688 | 5767 | 232 | 86.96 | glotblastn |
| WNU33_H8 | fescue\|gb161\|DT705155_T1 | 2689 | 5768 | 232 | 85.92 | glotblastn |
| WNU33_H9 | rice\|11v1\|AU166875 | 2690 | 5769 | 232 | 85.51 | glotblastn |
| WNU33_H10 | foxtail_millet\|11v3\|SOLX00022948_P1 | 2691 | 5770 | 232 | 85.5 | globlastp |
| WNU33_H11 | sorghum\|12v1\|SB08G000650 | 2692 | 5771 | 232 | 85.5 | globlastp |
| WNU33_H12 | maize\|10v1\|DW530314_P1 | 2693 | 5772 | 232 | 84.5 | globlastp |
| WNU33_H13 | maize\|10v1\|BE225167_P1 | 2694 | 5773 | 232 | 84.3 | globlastp |
| WNU33_H14 | sorghum\|12v1\|SB05G000620 | 2695 | 5774 | 232 | 84.1 | globlastp |
| WNU33_H15 | switchgrass\|gb167\|FL886195 | 2696 | 5775 | 232 | 84.1 | globlastp |
| WNU33_H16 | maize\|10v1\|DW898426_T1 | 2697 | 5776 | 232 | 84.06 | glotblastn |
| WNU33_H17 | sugarcane\|10v1\|CF575834 | 2698 | 5777 | 232 | 83.1 | globlastp |
| WNU33_H18 | millet\|10v1\|PMSLX0075855D2_P1 | 2699 | 5778 | 232 | 81.2 | globlastp |
| WNU34_H1 | wheat\|12v3\|BU101180 | 2700 | 5779 | 233 | 91.8 | globlastp |
| WNU35_H1 | wheat\|12v3\|BG605144 | 2701 | 5780 | 234 | 95.1 | globlastp |
| WNU35_H2 | wheat\|12v3\|CJ587392 | 2702 | 5781 | 234 | 92.3 | globlastp |
| WNU35_H3 | rye\|12v1\|DRR001012.119573 | 2703 | 5782 | 234 | 92 | globlastp |
| WNU35_H4 | barley\|12v1\|EX583178_P1 | 2704 | 5783 | 234 | 91.4 | globlastp |
| WNU35_H5 | wheat\|12v3\|BF202649 | 2705 | 5784 | 234 | 90.7 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU35_H6 | wheat\|12v3\|CA599142 | 2706 | 5785 | 234 | 90.6 | globlastp |
| WNU35_H7 | rye\|12v1\|DRR001012.166983 | 2707 | 5786 | 234 | 90.1 | globlastp |
| WNU35_H8 | rye\|12v1\|DRR001012.123100 | 2708 | 5787 | 234 | 89.7 | globlastp |
| WNU35_H9 | wheat\|12v3\|BE401525 | 2709 | 5788 | 234 | 88.3 | globlastp |
| WNU35_H10 | oat\|11v1\|GR316665_P1 | 2710 | 5789 | 234 | 87.7 | globlastp |
| WNU35_H11 | *brachypodium*\|12v1\|BRADI2G07160_P1 | 2711 | 5790 | 234 | 87.4 | globlastp |
| WNU35_H12 | sugarcane\|10v1\|CA119713 | 2712 | 5791 | 234 | 85.07 | glotblastn |
| WNU35_H13 | rice\|11v1\|AA753081 | 2713 | 5792 | 234 | 83.7 | globlastp |
| WNU35_H14 | foxtail_millet\|11v3\|EC612259_P1 | 2714 | 5793 | 234 | 83.3 | globlastp |
| WNU35_H15 | foxtail_millet\|11v3\|PHY7SI036563M_P1 | 2715 | 5794 | 234 | 83.3 | globlastp |
| WNU35_H21 | switchgrass\|12v1\|DN145422_P1 | 2716 | 5795 | 234 | 82.9 | globlastp |
| WNU35_H16 | millet\|10v1\|EVO454PM030513_P1 | 2717 | 5796 | 234 | 82.6 | globlastp |
| WNU35_H22 | switchgrass\|12v1\|DN145373_P1 | 2718 | 5797 | 234 | 82.4 | globlastp |
| WNU35_H17 | maize\|10v1\|AI964587_P1 | 2719 | 5798 | 234 | 82.4 | globlastp |
| WNU35_H18 | *sorghum*\|12v1\|SB03G001550 | 2720 | 5799 | 234 | 82.4 | globlastp |
| WNU35_H19 | switchgrass\|gb167\|DN145373 | 2721 | 5800 | 234 | 82.1 | globlastp |
| WNU35_H20 | maize\|10v1\|CF244168_P1 | 2722 | 5801 | 234 | 81.5 | globlastp |
| WNU36_H1 | wheat\|12v3\|BE443031 | 2723 | 5802 | 235 | 95.6 | globlastp |
| WNU36_H5 | wheat\|12v3\|BQ789293 | 2724 | 5803 | 235 | 95.14 | glotblastn |
| WNU36_H3 | rye\|12v1\|BE586716 | 2725 | 5804 | 235 | 95.1 | globlastp |
| WNU36_H4 | wheat\|12v3\|BE517286 | 2726 | 5805 | 235 | 95.1 | globlastp |
| WNU36_H6 | wheat\|12v3\|BF202371 | 2727 | 5806 | 235 | 93.69 | glotblastn |
| WNU36_H8 | *brachypodium*\|12v1\|BRADI3G53420_P1 | 2728 | 5807 | 235 | 85.7 | globlastp |
| WNU37_H1 | wheat\|12v3\|BE606832 | 2729 | 5808 | 236 | 97.9 | globlastp |
| WNU37_H2 | wheat\|12v3\|BF483879 | 2730 | 5809 | 236 | 97.8 | globlastp |
| WNU37_H3 | wheat\|12v3\|BG262647 | 2731 | 5810 | 236 | 97.8 | globlastp |
| WNU37_H4 | rye\|12v1\|DRR001012.103169 | 2732 | 5811 | 236 | 97.5 | globlastp |
| WNU37_H5 | wheat\|12v3\|BE606184 | 2733 | 5812 | 236 | 97.19 | glotblastn |
| WNU37_H7 | foxtail_millet\|11v3\|PHY7SI021351M_P1 | 2734 | 5813 | 236 | 92.4 | globlastp |
| WNU37_H8 | rice\|11v1\|BI811423 | 2735 | 5814 | 236 | 92.3 | globlastp |
| WNU37_H25 | switchgrass\|12v1\|DN142304_T1 | 2736 | 5815 | 236 | 92.15 | globlastp |
| WNU37_H9 | switchgrass\|gb167\|DN142304 | 2737 | 5816 | 236 | 92.15 | glotblastn |
| WNU37_H26 | switchgrass\|12v1\|FE628118_P1 | 2738 | 5817 | 236 | 92 | globlastp |
| WNU37_H10 | millet\|10v1\|EVO454PM014456_P1 | 2739 | 5818 | 236 | 92 | globlastp |
| WNU37_H11 | *sorghum*\|12v1\|SB08G018440 | 2740 | 5819 | 236 | 92 | globlastp |
| WNU37_H12 | sugarcane\|10v1\|CA068434 | 2741 | 5820 | 236 | 92 | globlastp |
| WNU37_H13 | maize\|10v1\|AW330878_P1 | 2742 | 5821 | 236 | 91 | globlastp |
| WNU37_H14 | maize\|10v1\|AI615160_P1 | 2743 | 5822 | 236 | 89.9 | globlastp |
| WNU37_H15 | banana\|12v1\|FL649484_P1 | 2744 | 5823 | 236 | 83.8 | globlastp |
| WNU37_H19 | oak\|10v1\|FP034259_P1 | 2745 | 5824 | 236 | 81.4 | globlastp |
| WNU37_H21 | amorphophallus\|11v2\|SRR089351X160169_P1 | 2746 | 5825 | 236 | 80.5 | globlastp |
| WNU37_H22 | *amborella*\|12v3\|FD432214_P1 | 2747 | 5826 | 236 | 80.2 | globlastp |
| WNU37_H23 | *aquilegia*\|10v2\|DR927606_P1 | 2748 | 5827 | 236 | 80.1 | globlastp |
| WNU38_H1 | rye\|12v1\|BE704959 | 2749 | 5828 | 237 | 98.8 | globlastp |
| WNU38_H2 | wheat\|12v3\|CA607240 | 2750 | 5829 | 237 | 98.5 | globlastp |
| WNU38_H3 | wheat\|12v3\|BF484914 | 2751 | 5830 | 237 | 98.4 | globlastp |
| WNU38_H4 | wheat\|12v3\|DR732969 | 2752 | 5830 | 237 | 98.4 | globlastp |
| WNU38_H5 | *brachypodium*\|12v1\|BRADI3G32210T2_P1 | 2753 | 5831 | 237 | 95 | globlastp |
| WNU38_H6 | oat\|11v1\|CN815630_P1 | 2754 | 5832 | 237 | 94.6 | globlastp |
| WNU38_H7 | rice\|11v1\|U38167 | 2755 | 5833 | 237 | 89.9 | globlastp |
| WNU38_H8 | *sorghum*\|12v1\|SB01G030430 | 2756 | 5834 | 237 | 89.5 | globlastp |
| WNU38_H9 | switchgrass\|gb167\|DN143112 | 2757 | 5835 | 237 | 88.9 | globlastp |
| WNU38_H10 | foxtail_millet\|11v3\|PHY7SI034411M_P1 | 2758 | 5836 | 237 | 88.7 | globlastp |
| WNU38_H11 | maize\|10v1\|AW267461_P1 | 2759 | 5837 | 237 | 86.2 | globlastp |
| WNU38_H12 | rye\|12v1\|DRR001012.507695 | 2760 | 5838 | 237 | 85.08 | glotblastn |
| WNU38_H13 | barley\|12v1\|AJ534446_T1 | 2761 | 5839 | 237 | 81.58 | glotblastn |
| WNU39_H1 | rye\|12v1\|DRR001012.179118 | 2762 | 5840 | 238 | 98 | globlastp |
| WNU39_H2 | rye\|12v1\|BQ160098 | 2763 | 5841 | 238 | 96.97 | glotblastn |
| WNU39_H3 | wheat\|12v3\|AL826350 | 2764 | 5842 | 238 | 96.8 | globlastp |
| WNU39_H4 | *brachypodium*\|12v1\|BRADI1G01140_P1 | 2765 | 5843 | 238 | 94.2 | globlastp |
| WNU39_H5 | barley\|12v1\|BU988855_P1 | 2766 | 5844 | 238 | 93.8 | globlastp |
| WNU39_H6 | *brachypodium*\|12v1\|BRADI1G01200_P1 | 2767 | 5845 | 238 | 93.7 | globlastp |
| WNU39_H7 | wheat\|12v3\|CA688079 | 2768 | 5846 | 238 | 93.4 | globlastp |
| WNU39_H8 | wheat\|12v3\|CN011782 | 2769 | 5847 | 238 | 91.6 | globlastp |
| WNU39_H9 | rye\|12v1\|DRR001012.265039 | 2770 | 5848 | 238 | 90.91 | glotblastn |
| WNU39_H10 | wheat\|12v3\|SRR073322X113490D1 | 2771 | 5849 | 238 | 90.8 | globlastp |
| WNU39_H11 | maize\|10v1\|AI612324_P1 | 2772 | 5850 | 238 | 90.5 | globlastp |
| WNU39_H12 | rice\|11v1\|BI798293 | 2773 | 5851 | 238 | 90.1 | globlastp |
| WNU39_H13 | *sorghum*\|12v1\|SB01G000850 | 2774 | 5852 | 238 | 89.8 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU39_H24 | switchgrass\|12v1\|FE639701_P1 | 2775 | 5853 | 238 | 89.1 | globlastp |
| WNU39_H14 | foxtail_millet\|11v3\|PHY7SI034495M_P1 | 2776 | 5854 | 238 | 88.9 | globlastp |
| WNU39_H25 | switchgrass\|12v1\|FL833868_P1 | 2777 | 5855 | 238 | 88.8 | globlastp |
| WNU39_H26 | switchgrass\|12v1\|FL719668_P1 | 2778 | 5856 | 238 | 88.5 | globlastp |
| WNU39_H15 | millet\|10v1\|EVO454PM002688_P1 | 2779 | 5857 | 238 | 88.3 | globlastp |
| WNU39_H16 | maize\|10v1\|AI947725_P1 | 2780 | 5858 | 238 | 88.2 | globlastp |
| WNU39_H17 | switchgrass\|gb167\|FE639701 | 2781 | 5859 | 238 | 88.2 | glotblastn |
| WNU39_H18 | oil_palm\|11v1\|EL683203_P1 | 2782 | 5860 | 238 | 84.9 | globlastp |
| WNU39_H19 | wheat\|12v3\|SRR400820X1035870D1 | 2783 | 5861 | 238 | 83.98 | glotblastn |
| WNU39_H20 | rye\|12v1\|BE438514 | 2784 | 5862 | 238 | 83.2 | globlastp |
| WNU39_H21 | banana\|12v1\|BBS2636T3_P1 | 2785 | 5863 | 238 | 82.2 | globlastp |
| WNU39_H22 | phalaenopsis\|11v1\|SRR125771.1017165_T1 | 2786 | 5864 | 238 | 81.29 | glotblastn |
| WNU39_H23 | grape\|11v1\|GSVIVT01023351001_P1 | 2787 | 5865 | 238 | 80.6 | globlastp |
| WNU40_H1 | rye\|12v1\|DRR001012.93341 | 2788 | 5866 | 239 | 91.1 | globlastp |
| WNU40_H2 | rye\|12v1\|DRR001012.297746 | 2789 | 5867 | 239 | 90.5 | globlastp |
| WNU41_H2 | wheat\|12v3\|BQ804367 | 2790 | 5868 | 240 | 89.6 | globlastp |
| WNU42_H1 | rye\|12v1\|DRR001012.112433 | 2791 | 5869 | 241 | 96.1 | globlastp |
| WNU42_H2 | wheat\|12v3\|CA728904 | 2792 | 5870 | 241 | 96.1 | globlastp |
| WNU42_H3 | wheat\|12v3\|BE400749 | 2793 | 5871 | 241 | 93.1 | globlastp |
| WNU42_H4 | brachypodium\|12v1\|BRADI5G13120_P1 | 2794 | 5872 | 241 | 88.1 | globlastp |
| WNU42_H5 | rice\|11v1\|CA765423 | 2795 | 5873 | 241 | 82.8 | globlastp |
| WNU43_H1 | wheat\|12v3\|BQ744365 | 2796 | 5874 | 242 | 87.6 | globlastp |
| WNU43_H2 | rye\|12v1\|GFXEU194240X1 | 2797 | 5875 | 242 | 85.78 | glotblastn |
| WNU43_H3 | rice\|11v1\|AY114110 | 2798 | 5876 | 242 | 82.2 | globlastp |
| WNU44_H1 | rye\|12v1\|DRR001012.32802 | 2799 | 5877 | 243 | 94 | globlastp |
| WNU44_H2 | wheat\|12v3\|BF483666 | 2800 | 5878 | 243 | 94 | globlastp |
| WNU46_H1 | leymus\|gb166\|EG400893_P1 | 2801 | 5879 | 245 | 92.8 | globlastp |
| WNU46_H2 | wheat\|12v3\|BE446543 | 2802 | 5880 | 245 | 92.2 | globlastp |
| WNU46_H3 | wheat\|12v3\|BE404251 | 2803 | 5881 | 245 | 91.6 | globlastp |
| WNU46_H4 | rye\|12v1\|BE495560 | 2804 | 5882 | 245 | 91.2 | globlastp |
| WNU46_H5 | rye\|12v1\|DRR001012.276818 | 2805 | 5883 | 245 | 90.9 | globlastp |
| WNU46_H6 | barley\|12v1\|BG366599_P1 | 2806 | 5884 | 245 | 89.6 | globlastp |
| WNU46_H7 | rice\|11v1\|BI806398 | 2807 | 5885 | 245 | 85.9 | globlastp |
| WNU46_H8 | maize\|10v1\|AW055419_P1 | 2808 | 5886 | 245 | 82.9 | globlastp |
| WNU46_H9 | maize\|10v1\|AI964620_P1 | 2809 | 5887 | 245 | 82.2 | globlastp |
| WNU46_H10 | sorghum\|12v1\|SB02G000400 | 2810 | 5888 | 245 | 82.2 | globlastp |
| WNU46_H11 | sugarcane\|10v1\|CA090267 | 2811 | 5889 | 245 | 82.2 | globlastp |
| WNU46_H15 | switchgrass\|12v1\|DN144132_P1 | 2812 | 5890 | 245 | 81.7 | globlastp |
| WNU46_H12 | foxtail_millet\|11v3\|EC612167_P1 | 2813 | 5891 | 245 | 81.7 | globlastp |
| WNU46_H13 | switchgrass\|gb167\|DN144132 | 2814 | 5890 | 245 | 81.7 | globlastp |
| WNU46_H14 | switchgrass\|gb167\|FE599308 | 2815 | 5892 | 245 | 80.7 | globlastp |
| WNU47_H1 | barley\|12v1\|AV833350_P1 | 2816 | 5893 | 246 | 84.6 | globlastp |
| WNU47_H2 | rye\|12v1\|DRR001012.111891 | 2817 | 5894 | 246 | 83.7 | globlastp |
| WNU47_H3 | wheat\|12v3\|BE516917 | 2818 | 5895 | 246 | 83.7 | globlastp |
| WNU51_H1 | wheat\|12v3\|BQ903841 | 2819 | 5896 | 249 | 86.7 | globlastp |
| WNU51_H5 | switchgrass\|12v1\|FE619109_P1 | 2820 | 5897 | 249 | 82.7 | globlastp |
| WNU51_H2 | foxtail_millet\|11v3\|PHY7SI000637M_P1 | 2821 | 5898 | 249 | 82.3 | globlastp |
| WNU51_H3 | rice\|11v1\|AA753089 | 2822 | 5899 | 249 | 81.9 | globlastp |
| WNU51_H4 | sorghum\|12v1\|SB03G029870 | 2823 | 5900 | 249 | 81.9 | globlastp |
| WNU53_H2 | switchgrass\|12v1\|FE620835_T1 | 2824 | 5901 | 251 | 87.04 | glotblastn |
| WNU53_H1 | sorghum\|12v1\|SB02G030160 | 2825 | 5902 | 251 | 80.64 | glotblastn |
| WNU54_H1 | switchgrass\|gb167\|DN143732 | 2826 | 5903 | 252 | 89.9 | globlastp |
| WNU54_H5 | switchgrass\|12v1\|DN143732_P1 | 2827 | 5904 | 252 | 89.6 | globlastp |
| WNU54_H2 | switchgrass\|gb167\|FE621086 | 2828 | 5905 | 252 | 87.9 | globlastp |
| WNU54_H3 | millet\|10v1\|EVO454PM077732_P1 | 2829 | 5906 | 252 | 81.3 | globlastp |
| WNU54_H4 | sugarcane\|10v1\|BQ535885 | 2830 | 5907 | 252 | 80.2 | globlastp |
| WNU55_H1 | cenchrus\|gb166\|BM084440_P1 | 2831 | 5908 | 253 | 97.6 | globlastp |
| WNU55_H17 | switchgrass\|12v1\|FE626008_P1 | 2832 | 5909 | 253 | 92.4 | globlastp |
| WNU55_H18 | switchgrass\|12v1\|FL733655_P1 | 2833 | 5910 | 253 | 91.7 | globlastp |
| WNU55_H2 | switchgrass\|gb167\|FE626008 | 2834 | 5911 | 253 | 91.7 | globlastp |
| WNU55_H3 | millet\|10v1\|EVO454PM020798_P1 | 2835 | 5912 | 253 | 91.4 | globlastp |
| WNU55_H4 | maize\|10v1\|AW052935_P1 | 2836 | 5913 | 253 | 89.3 | globlastp |
| WNU55_H5 | sugarcane\|10v1\|AI105581 | 2837 | 5914 | 253 | 88.7 | globlastp |
| WNU55_H6 | oat\|11v1\|CN819661_P1 | 2838 | 5915 | 253 | 87.9 | globlastp |
| WNU55_H7 | wheat\|12v3\|BE398870 | 2839 | 5916 | 253 | 87.6 | globlastp |
| WNU55_H8 | rye\|12v1\|DRR001012.112998 | 2840 | 5917 | 253 | 86.9 | globlastp |
| WNU55_H9 | sorghum\|12v1\|SB03G045400 | 2841 | 5918 | 253 | 86.9 | globlastp |
| WNU55_H10 | fescue\|gb161\|DT674680_P1 | 2842 | 5919 | 253 | 86.6 | globlastp |
| WNU55_H11 | leymus\|gb166\|EG384989_P1 | 2843 | 5920 | 253 | 86.6 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU55_H12 | pseudoroegneria\|gb167\|FF349242 | 2844 | 5921 | 253 | 86.6 | globlastp |
| WNU55_H13 | brachypodium\|12v1\|BRADI2G60400_P1 | 2845 | 5922 | 253 | 86.3 | globlastp |
| WNU55_H14 | rye\|12v1\|BQ160176 | 2846 | 5923 | 253 | 85.5 | globlastp |
| WNU55_H15 | rye\|12v1\|DRR001012.136908 | 2847 | 5924 | 253 | 83.6 | globlastp |
| WNU55_H16 | rye\|12v1\|DRR001012.10881 | 2848 | 5925 | 253 | 82.1 | globlastp |
| WNU56_H1 | millet\|10v1\|EVO454PM009410_P1 | 2849 | 5926 | 254 | 97.5 | globlastp |
| WNU56_H19 | switchgrass\|12v1\|FL822962_P1 | 2850 | 5927 | 254 | 95.4 | globlastp |
| WNU56_H2 | sorghum\|12v1\|SB06G000370 | 2851 | 5928 | 254 | 92.3 | globlastp |
| WNU56_H3 | maize\|10v1\|AI615164_P1 | 2852 | 5929 | 254 | 89.1 | globlastp |
| WNU56_H4 | maize\|10v1\|AW054516_P1 | 2853 | 5930 | 254 | 88.4 | globlastp |
| WNU56_H5 | wheat\|12v3\|BE414924 | 2854 | 5931 | 254 | 85.9 | globlastp |
| WNU56_H6 | barley\|12v1\|BE420715_P1 | 2855 | 5932 | 254 | 85.6 | globlastp |
| WNU56_H7 | brachypodium\|12v1\|BRADI5G02400T3_P1 | 2856 | 5933 | 254 | 85.6 | globlastp |
| WNU56_H8 | rye\|12v1\|DRR001012.14123 | 2857 | 5934 | 254 | 84.2 | globlastp |
| WNU56_H9 | rye\|12v1\|DRR001013.248475 | 2858 | 5935 | 254 | 84.2 | globlastp |
| WNU56_H10 | wheat\|12v3\|BE418367 | 2859 | 5936 | 254 | 84.2 | globlastp |
| WNU56_H11 | wheat\|12v3\|BE400635 | 2860 | 5937 | 254 | 83.8 | globlastp |
| WNU56_H12 | rye\|12v1\|DRR001012.126292 | 2861 | 5938 | 254 | 83.5 | globlastp |
| WNU56_H13 | rye\|12v1\|DRR001012.131238 | 2862 | 5939 | 254 | 83.5 | globlastp |
| WNU56_H14 | rice\|11v1\|BI798616 | 2863 | 5940 | 254 | 82.9 | globlastp |
| WNU56_H15 | switchgrass\|gb167\|FE610544 | 2864 | 5941 | 254 | 82 | globlastp |
| WNU56_H16 | wheat\|12v3\|CA678232 | 2865 | 5942 | 254 | 82 | globlastp |
| WNU56_H20 | switchgrass\|12v1\|FE600029_T1 | 2866 | 5943 | 254 | 80.7 | glotblastn |
| WNU56_H17 | switchgrass\|gb167\|FE600029 | 2867 | 5943 | 254 | 80.7 | glotblastn |
| WNU56_H18 | sugarcane\|10v1\|BU102873 | 2868 | 5944 | 254 | 80.3 | globlastp |
| WNU57_H1 | millet\|10v1\|EVO454PM018435_P1 | 2869 | 5945 | 255 | 96.2 | globlastp |
| WNU57_H13 | switchgrass\|12v1\|DN141209_P1 | 2870 | 5946 | 255 | 95.1 | globlastp |
| WNU57_H2 | switchgrass\|gb167\|DN151901 | 2871 | 5947 | 255 | 95.1 | globlastp |
| WNU57_H3 | maize\|10v1\|AI600883_P1 | 2872 | 5948 | 255 | 92 | globlastp |
| WNU57_H4 | maize\|10v1\|AI855375_P1 | 2873 | 5949 | 255 | 91.1 | globlastp |
| WNU57_H5 | sorghum\|12v1\|SB04G006620 | 2874 | 5950 | 255 | 90.7 | globlastp |
| WNU57_H6 | sugarcane\|10v1\|BQ533748 | 2875 | 5951 | 255 | 90.5 | globlastp |
| WNU57_H7 | rice\|11v1\|BI305818 | 2876 | 5952 | 255 | 88.1 | globlastp |
| WNU57_H8 | barley\|12v1\|BE437885_P1 | 2877 | 5953 | 255 | 86.9 | globlastp |
| WNU57_H9 | rye\|12v1\|BE493839 | 2878 | 5954 | 255 | 86.9 | globlastp |
| WNU57_H10 | wheat\|12v3\|BE403012 | 2879 | 5955 | 255 | 86.9 | globlastp |
| WNU57_H11 | oat\|11v1\|CN820052_P1 | 2880 | 5956 | 255 | 86.4 | globlastp |
| WNU57_H12 | brachypodium\|12v1\|BRADI3G07130_P1 | 2881 | 5957 | 255 | 85.9 | globlastp |
| WNU58_H1 | millet\|10v1\|PMSLX0007469D1_P1 | 2882 | 5958 | 256 | 93.1 | globlastp |
| WNU58_H3 | switchgrass\|12v1\|FL798481_P1 | 2883 | 5959 | 256 | 91.9 | globlastp |
| WNU58_H2 | switchgrass\|gb167\|FL798481 | 2884 | 5960 | 256 | 91.5 | globlastp |
| WNU60_H3 | switchgrass\|12v1\|FE618777_P1 | 2885 | 5961 | 257 | 95.1 | globlastp |
| WNU60_H4 | switchgrass\|12v1\|FL848693_P1 | 2886 | 5962 | 257 | 93.9 | globlastp |
| WNU60_H1 | sorghum\|12v1\|SB03G035380 | 2887 | 5963 | 257 | 91.1 | globlastp |
| WNU60_H2 | maize\|10v1\|CD947094_P1 | 2888 | 5964 | 257 | 89.5 | globlastp |
| WNU65_H4 | switchgrass\|12v1\|DN151191_T1 | 2889 | 5965 | 260 | 94.16 | glotblastn |
| WNU65_H1 | maize\|10v1\|EC882969_P1 | 2890 | 5966 | 260 | 90.6 | globlastp |
| WNU65_H2 | rice\|11v1\|AU101102 | 2891 | 5967 | 260 | 86.1 | globlastp |
| WNU65_H3 | sorghum\|12v1\|SB06G019660 | 2892 | 5968 | 260 | 82 | globlastp |
| WNU65_H5 | switchgrass\|12v1\|FE648952_P1 | 2893 | 5969 | 260 | 81.4 | globlastp |
| WNU66_H1 | millet\|10v1\|EVO454PM003908_P1 | 2894 | 5970 | 261 | 97.4 | globlastp |
| WNU66_H2 | foxtail_millet\|11v3\|PHY7SI034876M_P1 | 2895 | 5971 | 261 | 96.7 | globlastp |
| WNU66_H14 | switchgrass\|12v1\|FE624920_P1 | 2896 | 5972 | 261 | 95 | globlastp |
| WNU66_H15 | switchgrass\|12v1\|FL743094_P1 | 2897 | 5973 | 261 | 94.8 | globlastp |
| WNU66_H3 | sorghum\|12v1\|SB08G004950 | 2898 | 5974 | 261 | 92.8 | globlastp |
| WNU66_H4 | maize\|10v1\|AI667773_P1 | 2899 | 5975 | 261 | 92.4 | globlastp |
| WNU66_H5 | rice\|11v1\|D40964 | 2900 | — | 261 | 90.31 | glotblastn |
| WNU66_H6 | brachypodium\|12v1\|BRADI2G31260_T1 | 2901 | 5976 | 261 | 88.24 | glotblastn |
| WNU66_H7 | barley\|12v1\|BI953051_P1 | 2902 | 5977 | 261 | 87.7 | globlastp |
| WNU66_H8 | brachypodium\|12v1\|BRADI1G76820_P1 | 2903 | 5978 | 261 | 87.7 | globlastp |
| WNU66_H9 | rye\|12v1\|DRR001012.101674 | 2904 | 5979 | 261 | 87.02 | glotblastn |
| WNU66_H10 | wheat\|12v3\|BE515409 | 2905 | 5980 | 261 | 86.5 | globlastp |
| WNU66_H11 | wheat\|12v3\|BF484306 | 2906 | 5981 | 261 | 86 | globlastp |
| WNU66_H12 | sugarcane\|10v1\|CA084686 | 2907 | 5982 | 261 | 83.2 | globlastp |
| WNU66_H13 | wheat\|12v3\|BI750854 | 2908 | 5983 | 261 | 82 | globlastp |
| WNU67_H11 | switchgrass\|12v1\|FL749950_P1 | 2909 | 5984 | 262 | 98.8 | globlastp |
| WNU67_H1 | switchgrass\|gb167\|DN141403 | 2910 | 5985 | 262 | 98.2 | globlastp |
| WNU67_H12 | switchgrass\|12v1\|DN141403_P1 | 2911 | 5986 | 262 | 97.8 | globlastp |
| WNU67_H2 | sorghum\|12v1\|SB04G036240 | 2912 | 5987 | 262 | 95.8 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU67_H3 | sugarcane\|10v1\|BU102542 | 2913 | 5988 | 262 | 95.2 | globlastp |
| WNU67_H4 | maize\|10v1\|AW562559_P1 | 2914 | 5989 | 262 | 94.6 | globlastp |
| WNU67_H5 | millet\|10v1\|EVO454PM095165_T1 | 2915 | 5990 | 262 | 93.31 | glotblastn |
| WNU67_H6 | rice\|11v1\|BI306271 | 2916 | 5991 | 262 | 93.3 | globlastp |
| WNU67_H7 | *brachypodium*\|12v1\|BRADI3G54387_P1 | 2917 | 5992 | 262 | 91.5 | globlastp |
| WNU67_H8 | barley\|12v1\|BF621231_P1 | 2918 | 5993 | 262 | 89.7 | globlastp |
| WNU67_H9 | rye\|12v1\|DRR001012.125551 | 2919 | 5994 | 262 | 88.93 | glotblastn |
| WNU67_H10 | wheat\|12v3\|BE424759 | 2920 | 5995 | 262 | 85.1 | globlastp |
| WNU68_H5 | switchgrass\|12v1\|FE605833_P1 | 2921 | 5996 | 263 | 87.9 | globlastp |
| WNU68_H1 | switchgrass\|gb167\|FE605833 | 2922 | 5997 | 263 | 87.8 | globlastp |
| WNU68_H2 | rice\|11v1\|AU033236 | 2923 | 5998 | 263 | 83.4 | globlastp |
| WNU68_H3 | millet\|10v1\|PMSLX0015205D1_P1 | 2924 | 5999 | 263 | 83.2 | globlastp |
| WNU68_H4 | *sorghum*\|12v1\|SB04G027630 | 2925 | 6000 | 263 | 82.6 | globlastp |
| WNU69_H1 | *brachypodium*\|12v1\|BRADI2G33487_P1 | 2926 | 6001 | 264 | 83.1 | globlastp |
| WNU69_H2 | rice\|11v1\|AA753248 | 2927 | 6002 | 264 | 83.1 | globlastp |
| WNU69_H3 | *sorghum*\|12v1\|SB09G005780 | 2928 | 6003 | 264 | 80.8 | globlastp |
| WNU70_H1 | switchgrass\|12v1\|FL702936_P1 | 2929 | 6004 | 265 | 89.1 | globlastp |
| WNU70_H2 | switchgrass\|12v1\|FL714970_P1 | 2930 | 6005 | 265 | 84.9 | globlastp |
| WNU71_H26 | switchgrass\|12v1\|FL855287_P1 | 2931 | 6006 | 266 | 97.1 | globlastp |
| WNU71_H1 | switchgrass\|gb167\|FL745977 | 2932 | 6007 | 266 | 96.36 | glotblastn |
| WNU71_H2 | *sorghum*\|12v1\|SB02G033430 | 2933 | 6008 | 266 | 95.6 | globlastp |
| WNU71_H27 | switchgrass\|12v1\|FL745977_P1 | 2934 | 6009 | 266 | 94.9 | globlastp |
| WNU71_H3 | sugarcane\|10v1\|CA107770 | 2935 | 6010 | 266 | 94.9 | globlastp |
| WNU71_H4 | *pseudoroegneria*\|gb167\|FF34574 | 2936 | 6011 | 266 | 93 | globlastp |
| WNU71_H5 | rye\|12v1\|DRR001012.120492 | 2937 | 6012 | 266 | 92.5 | globlastp |
| WNU71_H6 | rye\|12v1\|BE494187 | 2938 | 6013 | 266 | 91.8 | globlastp |
| WNU71_H7 | rye\|12v1\|DRR001012.301737 | 2939 | 6014 | 266 | 91.8 | globlastp |
| WNU71_H8 | millet\|10v1\|EVO454PM016198_P1 | 2940 | 6015 | 266 | 91.7 | globlastp |
| WNU71_H9 | barley\|12v1\|BE413186_P1 | 2941 | 6016 | 266 | 91.5 | globlastp |
| WNU71_H10 | wheat\|12v3\|BE414569 | 2942 | 6017 | 266 | 91.5 | globlastp |
| WNU71_H11 | *leymus*\|gb166\|EG385262_P1 | 2943 | 6018 | 266 | 91.3 | globlastp |
| WNU71_H12 | *fescue*\|gb161\|DT674288_P1 | 2944 | 6019 | 266 | 90.6 | globlastp |
| WNU71_H13 | rice\|11v1\|BI797791 | 2945 | 6020 | 266 | 90.3 | globlastp |
| WNU71_H14 | *brachypodium*\|12v1\|BRADI1G27460_P1 | 2946 | 6021 | 266 | 89.9 | globlastp |
| WNU71_H15 | oat\|11v1\|AA231752_P1 | 2947 | 6022 | 266 | 89.6 | globlastp |
| WNU71_H16 | banana\|12v1\|FF557606_T1 | 2948 | 6023 | 266 | 81.19 | glotblastn |
| WNU71_H17 | hornbeam\|12v1\|SRR364455.110930_T1 | 2949 | 6024 | 266 | 81.07 | glotblastn |
| WNU71_H18 | maize\|10v1\|AI920419_T1 | 2950 | 6025 | 266 | 80.83 | glotblastn |
| WNU71_H19 | cacao\|10v1\|CU471506_P1 | 2951 | 6026 | 266 | 80.5 | globlastp |
| WNU71_H20 | cotton\|11v1\|CO089937_T1 | 2952 | 6027 | 266 | 80.34 | glotblastn |
| WNU71_H21 | ipomoea_nil\|10v1\|BJ565253_T1 | 2953 | 6028 | 266 | 80.34 | glotblastn |
| WNU71_H22 | banana\|12v1\|BBS184T3_P1 | 2954 | 6029 | 266 | 80.1 | globlastp |
| WNU71_H23 | cotton\|11v1\|BE055094_T1 | 2955 | 6030 | 266 | 80.1 | globlastp |
| WNU71_H24 | *flaveria*\|11v1\|SRR149229.123410_T1 | 2956 | 6031 | 266 | 80.1 | glotblastn |
| WNU71_H25 | strawberry\|11v1\|GT151387 | 2957 | 6032 | 266 | 80.1 | globlastp |
| WNU72_H1 | millet\|10v1\|EVO454PM004850_P1 | 2958 | 6033 | 267 | 94.3 | globlastp |
| WNU72_H14 | switchgrass\|12v1\|FE609299_P1 | 2959 | 6034 | 267 | 93.3 | globlastp |
| WNU72_H2 | switchgrass\|gb167\|FE609299 | 2960 | 6035 | 267 | 93.1 | globlastp |
| WNU72_H3 | maize\|10v1\|AI943960_P1 | 2961 | 6036 | 267 | 90.1 | globlastp |
| WNU72_H4 | *sorghum*\|12v1\|SB01G000600 | 2962 | 6037 | 267 | 89.9 | globlastp |
| WNU72_H5 | maize\|10v1\|W49430_P1 | 2963 | 6038 | 267 | 88.9 | globlastp |
| WNU72_H6 | *brachypodium*\|12v1\|BRADI1G00990_P1 | 2964 | 6039 | 267 | 85.1 | globlastp |
| WNU72_H7 | rice\|11v1\|BE229715 | 2965 | 6040 | 267 | 83.7 | globlastp |
| WNU72_H8 | wheat\|12v3\|BE498573 | 2966 | 6041 | 267 | 83.2 | globlastp |
| WNU72_H9 | wheat\|12v3\|BE591785 | 2967 | 6042 | 267 | 83 | globlastp |
| WNU72_H10 | rye\|12v1\|BE587577 | 2968 | 6043 | 267 | 82.97 | glotblastn |
| WNU72_H11 | rye\|12v1\|BF145793 | 2969 | 6044 | 267 | 82.8 | globlastp |
| WNU72_H12 | barley\|12v1\|BF625365_P1 | 2970 | 6045 | 267 | 82.6 | globlastp |
| WNU72_H13 | wheat\|12v3\|SRR073321X116449D1 | 2971 | 6046 | 267 | 81.2 | globlastp |
| WNU73_H1 | millet\|10v1\|EB411032_P1 | 2972 | 6047 | 268 | 92.2 | globlastp |
| WNU73_H2 | switchgrass\|gb167\|DN143721 | 2973 | 6048 | 268 | 91.2 | globlastp |
| WNU73_H3 | *sorghum*\|12v1\|SB01G038500 | 2974 | 6049 | 268 | 89.4 | globlastp |
| WNU73_H4 | maize\|10v1\|AI943624_P1 | 2975 | 6050 | 268 | 88.1 | globlastp |
| WNU73_H9 | switchgrass\|12v1\|FE628623_P1 | 2976 | 6051 | 268 | 83 | globlastp |
| WNU73_H5 | rice\|11v1\|BE230020 | 2977 | 6052 | 268 | 81.8 | globlastp |
| WNU73_H10 | switchgrass\|12v1\|DN143721_P1 | 2978 | 6053 | 268 | 81.6 | globlastp |
| WNU73_H6 | *brachypodium*\|12v1\|BRADI1G65580_P1 | 2979 | 6054 | 268 | 80.4 | globlastp |
| WNU73_H7 | barley\|12v1\|BE216681_P1 | 2980 | 6055 | 268 | 80.2 | globlastp |
| WNU73_H8 | wheat\|12v3\|BF478638 | 2981 | 6056 | 268 | 80 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU74_H11 | switchgrass\|12v1\|FE597705_P1 | 2982 | 6057 | 269 | 96.8 | globlastp |
| WNU74_H1 | switchgrass\|gb167\|DN143125 | 2983 | 6058 | 269 | 96.8 | globlastp |
| WNU74_H2 | sorghum\|12v1\|SB01G026590 | 2984 | 6059 | 269 | 94.1 | globlastp |
| WNU74_H3 | maize\|10v1\|AI941583_P1 | 2985 | 6060 | 269 | 92.9 | globlastp |
| WNU74_H4 | rice\|11v1\|CA998124 | 2986 | 6061 | 269 | 89.2 | globlastp |
| WNU74_H5 | brachypodium\|12v1\|BRADI3G21180_P1 | 2987 | 6062 | 269 | 85.9 | globlastp |
| WNU74_H6 | rye\|12v1\|BE587915 | 2988 | 6063 | 269 | 84.1 | globlastp |
| WNU74_H7 | sugarcane\|10v1\|CA066393XX2 | 2989 | 6064 | 269 | 84.1 | globlastp |
| WNU74_H8 | wheat\|12v3\|BQ161332 | 2990 | 6065 | 269 | 84.1 | globlastp |
| WNU74_H9 | wheat\|12v3\|BE443378 | 2991 | 6066 | 269 | 83.5 | globlastp |
| WNU74_H10 | barley\|12v1\|AV836614_P1 | 2992 | 6067 | 269 | 82.6 | globlastp |
| WNU75_H1 | sorghum\|12v1\|SB06G030330 | 2993 | 6068 | 270 | 97.1 | globlastp |
| WNU75_H2 | sugarcane\|10v1\|CA087831 | 2994 | 6069 | 270 | 96.3 | globlastp |
| WNU75_H3 | maize\|10v1\|T18425_P1 | 2995 | 6070 | 270 | 93 | globlastp |
| WNU75_H4 | switchgrass\|gb167\|FL741557 | 2996 | 6071 | 270 | 87.3 | globlastp |
| WNU75_H8 | switchgrass\|12v1\|FE603022_P1 | 2997 | 6072 | 270 | 86.5 | globlastp |
| WNU75_H5 | foxtail_millet\|11v3\|PHY7SI010909M_P1 | 2998 | 6073 | 270 | 86.5 | globlastp |
| WNU75_H6 | switchgrass\|gb167\|FE603022 | 2999 | 6074 | 270 | 85.7 | globlastp |
| WNU75_H7 | millet\|10v1\|EVO454PM000097_P1 | 3000 | 6075 | 270 | 85.3 | globlastp |
| WNU76_H1 | sorghum\|12v1\|SB02G042930 | 3001 | 6076 | 271 | 93.1 | globlastp |
| WNU76_H2 | foxtail_millet\|11v3\|PHY7SI02882M_P1 | 3002 | 6077 | 271 | 90 | globlastp |
| WNU76_H3 | switchgrass\|gb167\|FE629549 | 3003 | 6078 | 271 | 89.45 | glotblastn |
| WNU76_H4 | rice\|11v1\|BI798105 | 3004 | — | 271 | 84.05 | glotblastn |
| WNU76_H5 | barley\|12v1\|BI952099_P1 | 3005 | 6079 | 271 | 81.4 | globlastp |
| WNU76_H6 | wheat\|12v3\|BG604709 | 3006 | 6080 | 271 | 81.4 | globlastp |
| WNU76_H7 | rye\|12v1\|BE705594 | 3007 | 6081 | 271 | 81 | globlastp |
| WNU77_H1 | sugarcane\|10v1\|CA082006 | 3008 | 6082 | 272 | 86 | globlastp |
| WNU77_H2 | switchgrass\|gb167\|DN145582 | 3009 | 6083 | 272 | 81 | globlastp |
| WNU77_H3 | switchgrass\|12v1\|DN143279_P1 | 3010 | 6084 | 272 | 80.8 | globlastp |
| WNU82_H3 | maize\|10v1\|EY952669_P1 | 3011 | 6085 | 276 | 83.9 | globlastp |
| WNU85_H1 | foxtail_millet\|11v3\|EC613694_P1 | 3012 | 6086 | 278 | 86.4 | globlastp |
| WNU85_H2 | leymus\|gb166\|EG386550_P1 | 3013 | 6087 | 278 | 84.1 | globlastp |
| WNU85_H3 | maize\|10v1\|BI273418_P1 | 3014 | 6088 | 278 | 83.7 | globlastp |
| WNU85_H4 | brachypodium\|12v1\|BRADI2G07510_P1 | 3015 | 6089 | 278 | 83.6 | globlastp |
| WNU85_H5 | sorghum\|12v1\|SB03G001140 | 3016 | 6090 | 278 | 83.6 | globlastp |
| WNU85_H6 | maize\|10v1\|AI622003_P1 | 3017 | 6091 | 278 | 83 | globlastp |
| WNU85_H7 | sugarcane\|10v1\|CA077199 | 3018 | 6092 | 278 | 82.9 | globlastp |
| WNU85_H8 | wheat\|12v3\|BE407080 | 3019 | 6093 | 278 | 82.2 | globlastp |
| WNU85_H9 | pseudoroegneria\|gb167\|FF346440 | 3020 | 6094 | 278 | 81.5 | globlastp |
| WNU91_H1 | sugarcane\|10v1\|BQ529697 | 3021 | 6095 | 281 | 95.1 | globlastp |
| WNU91_H2 | maize\|10v1\|AI714451_P1 | 3022 | 6096 | 281 | 91.9 | globlastp |
| WNU91_H3 | cenchrus\|gb166\|EB659537_P1 | 3023 | 6097 | 281 | 87 | globlastp |
| WNU91_H4 | foxtail_millet\|11v3\|PHY7SI036279M_P1 | 3024 | 6098 | 281 | 86.5 | globlastp |
| WNU91_H5 | millet\|10v1\|EVO454PM061725_P1 | 3025 | 6099 | 281 | 86.5 | globlastp |
| WNU91_H6 | switchgrass\|gb167\|FL718671 | 3026 | 6100 | 281 | 86.5 | globlastp |
| WNU91_H7 | switchgrass\|gb167\|DN146028 | 3027 | 6101 | 281 | 86.2 | globlastp |
| WNU91_H8 | maize\|10v1\|BG841044_P1 | 3028 | 6102 | 281 | 85.6 | globlastp |
| WNU91_H9 | switchgrass\|12v1\|DN146028_P1 | 3029 | 6103 | 281 | 85.4 | globlastp |
| WNU92_H1 | sugarcane\|10v1\|CA115395 | 3030 | 6104 | 282 | 98.7 | globlastp |
| WNU92_H2 | maize\|10v1\|BG842702_P1 | 3031 | 6105 | 282 | 94.8 | globlastp |
| WNU92_H3 | foxtail_millet\|11v3\|PHY7SI036735M_P1 | 3032 | 6106 | 282 | 91.3 | globlastp |
| WNU92_H11 | switchgrass\|12v1\|FL787392_P1 | 3033 | 6107 | 282 | 90.6 | globlastp |
| WNU92_H4 | switchgrass\|gb167\|FL787392 | 3034 | 6108 | 282 | 90.6 | globlastp |
| WNU96_H17 | fescue\|gb161\|DT685989_P1 | 3065 | 6135 | 285 | 89.7 | globlastp |
| WNU96_H18 | oat\|11v1\|GO586704_P1 | 3066 | 6135 | 285 | 89.7 | globlastp |
| WNU96_H19 | oat\|11v1\|GO586971_P1 | 3067 | 6135 | 285 | 89.7 | globlastp |
| WNU96_H20 | oat\|11v1\|GR342940_P1 | 3068 | 6135 | 285 | 89.7 | globlastp |
| WNU96_H21 | oat\|11v1\|GR356048_P1 | 3069 | 6135 | 285 | 89.7 | globlastp |
| WNU96_H22 | rice\|11v1\|BE039823 | 3070 | 6136 | 285 | 89.1 | globlastp |
| WNU96_H23 | barley\|12v1\|BF625537_P1 | 3071 | 6137 | 285 | 89 | globlastp |
| WNU96_H24 | oat\|11v1\|GO588962_P1 | 3072 | 6138 | 285 | 88.5 | globlastp |
| WNU96_H25 | cynodon\|10v1\|BQ825915_T1 | 3073 | 6139 | 285 | 88.44 | glotblastn |
| WNU96_H26 | cenchrus\|gb166\|EB658948_P1 | 3074 | 6140 | 285 | 88.4 | globlastp |
| WNU96_H27 | rye\|12v1\|DRR001012.102215 | 3075 | 6141 | 285 | 88.4 | globlastp |
| WNU96_H28 | rye\|12v1\|DRR001012.24513 | 3076 | 6142 | 285 | 88.4 | globlastp |
| WNU96_H29 | pseudoroegneria\|gb167\|FF348077 | 3077 | 6143 | 285 | 88.36 | glotblastn |
| WNU96_H30 | wheat\|12v3\|BE419409 | 3078 | 6144 | 285 | 87.7 | globlastp |
| WNU96_H31 | lolium\|10v1\|AU249100_P1 | 3079 | 6145 | 285 | 87.2 | globlastp |
| WNU96_H32 | switchgrass\|gb167\|FE628032 | 3080 | 6146 | 285 | 87.07 | glotblastn |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU96_H33 | fescue\|gb161\|DT694422_P1 | 3081 | 6147 | 285 | 86.5 | globlastp |
| WNU96_H383 | switchgrass\|12v1\|SRR187765.118162_P1 | 3082 | 6148 | 285 | 86.4 | globlastp |
| WNU96_H34 | rice\|11v1\|AF074733 | 3083 | 6149 | 285 | 86.4 | globlastp |
| WNU96_H35 | rice\|11v1\|AU101070 | 3084 | 6150 | 285 | 86.39 | glotblastn |
| WNU96_H36 | catharanthus\|11v1\|EG557678XX1_P1 | 3085 | 6151 | 285 | 85.7 | globlastp |
| WNU96_H37 | chelidonium\|11v1\|SRR084752X100509_P1 | 3086 | 6152 | 285 | 85.7 | globlastp |
| WNU96_H38 | periwinkle\|gb164\|EG557678_P1 | 3087 | 6151 | 285 | 85.7 | globlastp |
| WNU96_H39 | lovegrass\|gb167\|EH195517_T1 | 3088 | 6153 | 285 | 85.62 | glotblastn |
| WNU96_H40 | wheat\|12v3\|CA485730 | 3089 | 6154 | 285 | 85.6 | globlastp |
| WNU96_H41 | oil_palm\|11v1\|EL682473_P1 | 3090 | 6155 | 285 | 85.2 | globlastp |
| WNU96_H42 | phalaenopsis\|11v1\|CB032680_P1 | 3091 | 6156 | 285 | 85.2 | globlastp |
| WNU96_H43 | artemisia\|10v1\|EY032469_P1 | 3092 | 6157 | 285 | 85 | globlastp |
| WNU96_H44 | artemisia\|10v1\|SRR019254S0089735_P1 | 3093 | 6157 | 285 | 85 | globlastp |
| WNU96_H45 | eschscholzia\|11v1\|CD481334XX1_P1 | 3094 | 6158 | 285 | 85 | globlastp |
| WNU96_H46 | eschscholzia\|11v1\|SRR014116.106420_P1 | 3095 | 6158 | 285 | 85 | globlastp |
| WNU96_H47 | flaveria\|11v1\|SRR149229.106105_P1 | 3096 | 6159 | 285 | 85 | globlastp |
| WNU96_H48 | lettuce\|12v1\|DW056578_P1 | 3097 | 6160 | 285 | 85 | globlastp |
| WNU96_H49 | plantago\|11v2\|SRR066373X112538_P1 | 3098 | 6161 | 285 | 84.9 | globlastp |
| WNU96_H50 | banana\|12v1\|ES433157_P1 | 3099 | 6162 | 285 | 84.6 | globlastp |
| WNU96_H51 | oil_palm\|11v1\|EL682536_P1 | 3100 | 6163 | 285 | 84.6 | globlastp |
| WNU96_H52 | amorphophallus\|11v2\|SRR089351X111826_P1 | 3101 | 6164 | 285 | 84.5 | globlastp |
| WNU96_H53 | basilicum\|10v1\|DY331064_P1 | 3102 | 6165 | 285 | 84.4 | globlastp |
| WNU96_H54 | cirsium\|11v1\|SRR346952.143114_P1 | 3103 | 6166 | 285 | 84.4 | globlastp |
| WNU96_H55 | cirsium\|11v1\|SRR349641.671786_P1 | 3104 | 6167 | 285 | 84.4 | globlastp |
| WNU96_H56 | eschscholzia\|11v1\|CK746606_P1 | 3105 | 6168 | 285 | 84.4 | globlastp |
| WNU96_H57 | eschscholzia\|11v1\|SRR014116.121035_P1 | 3106 | 6169 | 285 | 84.4 | globlastp |
| WNU96_H58 | eucalyptus\|11v2\|CU399079_P1 | 3107 | 6170 | 285 | 84.4 | globlastp |
| WNU96_H59 | fagopyrum\|11v1\|SRR063689X103613_P1 | 3108 | 6171 | 285 | 84.4 | globlastp |
| WNU96_H60 | fagopyrum\|11v1\|SRR063703X112774XX1_P1 | 3109 | 6172 | 285 | 84.4 | globlastp |
| WNU96_H61 | flaveria\|11v1\|SRR149229.130605_P1 | 3110 | 6173 | 285 | 84.4 | globlastp |
| WNU96_H62 | flaveria\|11v1\|SRR149229.192862_P1 | 3111 | 6174 | 285 | 84.4 | globlastp |
| WNU96_H63 | flaveria\|11v1\|SRR149232.10738_P1 | 3112 | 6175 | 285 | 84.4 | globlastp |
| WNU96_H64 | flaveria\|11v1\|SRR149232.178235_P1 | 3113 | 6176 | 285 | 84.4 | globlastp |
| WNU96_H65 | flaveria\|11v1\|SRR149241.111155_P1 | 3114 | 6175 | 285 | 84.4 | globlastp |
| WNU96_H66 | gerbera\|09v1\|AJ750765_P1 | 3115 | 6177 | 285 | 84.4 | globlastp |
| WNU96_H67 | grape\|11v1\|GSVIVT01032405001_P1 | 3116 | 6178 | 285 | 84.4 | globlastp |
| WNU96_H68 | poplar\|10v1\|BI131568 | 3117 | 6179 | 285 | 84.4 | globlastp |
| WNU96_H68 | poplar\|13v1\|BI131568_P1 | 3118 | 6179 | 285 | 84.4 | globlastp |
| WNU96_H69 | poplar\|10v1\|BU824189 | 3119 | 6180 | 285 | 84.4 | globlastp |
| WNU96_H69 | poplar\|13v1\|BU824189_P1 | 3120 | 6180 | 285 | 84.4 | globlastp |
| WNU96_H70 | poppy\|11v1\|SRR030259.101588_P1 | 3121 | 6181 | 285 | 84.4 | globlastp |
| WNU96_H71 | utricularia\|11v1\|SRR094438.113490 | 3122 | 6182 | 285 | 84.35 | glotblastn |
| WNU96_H384 | prunus_mume\|13v1\|CB820134_P1 | 3123 | 6183 | 285 | 84 | globlastp |
| WNU96_H72 | prunus\|10v1\|CB820134 | 3124 | 6184 | 285 | 84 | globlastp |
| WNU96_H73 | banana\|12v1\|ES433372_P1 | 3125 | 6185 | 285 | 83.9 | globlastp |
| WNU96_H74 | banana\|12v1\|ES437435_P1 | 3126 | 6186 | 285 | 83.9 | globlastp |
| WNU96_H75 | banana\|12v1\|FL664940_P1 | 3127 | 6187 | 285 | 83.9 | globlastp |
| WNU96_H76 | oil_palm\|11v1\|EY403792_P1 | 3128 | 6188 | 285 | 83.9 | globlastp |
| WNU96_H385 | castorbean\|12v1\|EV521260_P1 | 3129 | 6189 | 285 | 83.7 | globlastp |
| WNU96_H77 | amsonia\|11v1\|SRR098688X103253_P1 | 3130 | 6190 | 285 | 83.7 | globlastp |
| WNU96_H78 | arnica\|11v1\|SRR099034X100196_P1 | 3131 | 6191 | 285 | 83.7 | globlastp |
| WNU96_H79 | arnica\|11v1\|SRR099034X109795_P1 | 3132 | 6192 | 285 | 83.7 | globlastp |
| WNU96_H80 | cannabis\|12v1\|EW701714_P1 | 3133 | 6193 | 285 | 83.7 | globlastp |
| WNU96_H81 | castorbean\|11v1\|EV521260 | 3134 | 6189 | 285 | 83.7 | globlastp |
| WNU96_H82 | catharanthus\|11v1\|EG557805XX1_P1 | 3135 | 6194 | 285 | 83.7 | globlastp |
| WNU96_H83 | cleome_gynandra\|10v1\|SRR015532S0032808_P1 | 3136 | 6195 | 285 | 83.7 | globlastp |
| WNU96_H84 | cucurbita\|11v1\|SRR091276X130567_P1 | 3137 | 6196 | 285 | 83.7 | globlastp |
| WNU96_H85 | euphorbia\|11v1\|DV112950_P1 | 3138 | 6197 | 285 | 83.7 | globlastp |
| WNU96_H86 | flaveria\|11v1\|SRR149232.108657_P1 | 3139 | 6198 | 285 | 83.7 | globlastp |
| WNU96_H87 | flaveria\|11v1\|SRR149241.101479_P1 | 3140 | 6199 | 285 | 83.7 | globlastp |
| WNU96_H88 | flaveria\|11v1\|SRR149241.116281_P1 | 3141 | 6200 | 285 | 83.7 | globlastp |
| WNU96_H89 | flaveria\|11v1\|SRR149241.163891_P1 | 3142 | 6200 | 285 | 83.7 | globlastp |
| WNU96_H90 | hornbeam\|12v1\|SRR364455.10182_P1 | 3143 | 6201 | 285 | 83.7 | globlastp |
| WNU96_H91 | phyla\|11v2\|SRR099035X102200_P1 | 3144 | 6202 | 285 | 83.7 | globlastp |
| WNU96_H92 | plantago\|11v2\|SRR066373X103518_P1 | 3145 | 6203 | 285 | 83.7 | globlastp |
| WNU96_H93 | poplar\|10v1\|AI162838 | 3146 | 6204 | 285 | 83.7 | globlastp |
| WNU96_H93 | poplar\|13v1\|AI162838_P1 | 3147 | 6204 | 285 | 83.7 | globlastp |
| WNU96_H94 | poppy\|11v1\|FE964351_P1 | 3148 | 6205 | 285 | 83.7 | globlastp |
| WNU96_H95 | sarracenia\|11v1\|SRR192669.161055 | 3149 | 6206 | 285 | 83.7 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU96_H96 | sunflower\|12v1\|CD848611XX1 | 3150 | 6207 | 285 | 83.7 | globlastp |
| WNU96_H97 | sunflower\|12v1\|EL432812 | 3151 | 6207 | 285 | 83.7 | globlastp |
| WNU96_H98 | tragopogon\|10v1\|SRR020205S0003341 | 3152 | 6208 | 285 | 83.7 | globlastp |
| WNU96_H99 | utricularia\|11v1\|SRR094438.101639 | 3153 | 6209 | 285 | 83.7 | globlastp |
| WNU96_H100 | pseudotsuga\|10v1\|SRR065119S0009880 | 3154 | 6210 | 285 | 83.6 | globlastp |
| WNU96_H101 | rye\|12v1\|DRR001012.3832 | 3155 | 6211 | 285 | 83.6 | globlastp |
| WNU96_H102 | cedrus\|11v1\|SRR065007X100354_T1 | 3156 | 6212 | 285 | 83.56 | glotblastn |
| WNU96_H103 | apple\|11v1\|CN489950_P1 | 3157 | 6213 | 285 | 83.2 | globlastp |
| WNU96_H104 | pepper\|12v1\|SRR203275X41866D1_P1 | 3158 | 6213 | 285 | 83.2 | globlastp |
| WNU96_H386 | bean\|12v2\|CA897774_P1 | 3159 | 6214 | 285 | 83 | globlastp |
| WNU96_H387 | monkeyflower\|12v1\|DV206951_P1 | 3160 | 6215 | 285 | 83 | globlastp |
| WNU96_H388 | monkeyflower\|12v1\|DV211975_P1 | 3161 | 6216 | 285 | 83 | globlastp |
| WNU96_H389 | prunus_mume\|13v1\|BU039430_P1 | 3162 | 6217 | 285 | 83 | globlastp |
| WNU96_H105 | ambrosia\|11v1\|FG943037XX1_P1 | 3163 | 6218 | 285 | 83 | globlastp |
| WNU96_H106 | ambrosia\|11v1\|SRR346935.334229_P1 | 3164 | 6218 | 285 | 83 | globlastp |
| WNU96_H107 | ambrosia\|11v1\|SRR346943.122513XX1_P1 | 3165 | 6219 | 285 | 83 | globlastp |
| WNU96_H108 | aquilegia\|10v2\|JGIAC006234_P1 | 3166 | 6220 | 285 | 83 | globlastp |
| WNU96_H109 | b_juncea\|12v1\|E6ANDIZ01A5B9Z_P1 | 3167 | 6221 | 285 | 83 | globlastp |
| WNU96_H110 | b_juncea\|12v1\|E6ANDIZ01AU7ID_P1 | 3168 | 6222 | 285 | 83 | globlastp |
| WNU96_H111 | b_juncea\|12v1\|E6ANDIZ01C4NDD_P1 | 3169 | 6223 | 285 | 83 | globlastp |
| WNU96_H112 | b_oleracea\|gb161\|DY026186_P1 | 3170 | 6224 | 285 | 83 | globlastp |
| WNU96_H113 | b_rapa\|11v1\|BG544961_P1 | 3171 | 6224 | 285 | 83 | globlastp |
| WNU96_H114 | b_rapa\|11v1\|CD812537_P1 | 3172 | 6221 | 285 | 83 | globlastp |
| WNU96_H115 | b_rapa\|11v1\|CD816901_P1 | 3173 | 6225 | 285 | 83 | globlastp |
| WNU96_H116 | b_rapa\|11v1\|L33536_P1 | 3174 | 6223 | 285 | 83 | globlastp |
| WNU96_H118 | canola\|11v1\|CN728700XX1_P1 | 3175 | 6223 | 285 | 83 | globlastp |
| WNU96_H119 | canola\|11v1\|CN731386XX1_P1 | 3176 | 6223 | 285 | 83 | globlastp |
| WNU96_H120 | canola\|11v1\|CN731668XX1_P1 | 3177 | 6223 | 285 | 83 | globlastp |
| WNU96_H121 | canola\|11v1\|CN732454XX1_P1 | 3178 | 6224 | 285 | 83 | globlastp |
| WNU96_H122 | canola\|11v1\|DW997477_P1 | 3179 | 6224 | 285 | 83 | globlastp |
| WNU96_H123 | chelidonium\|11v1\|SRR084752X110318_P1 | 3180 | 6226 | 285 | 83 | globlastp |
| WNU96_H124 | cleome_spinosa\|10v1\|GR934804XX1_P1 | 3181 | 6227 | 285 | 83 | globlastp |
| WNU96_H125 | cleome_spinosa\|10v1\|SRR015531S0005856_P1 | 3182 | 6228 | 285 | 83 | globlastp |
| WNU96_H126 | cotton\|11v1\|BE052151_P1 | 3183 | 6229 | 285 | 83 | globlastp |
| WNU96_H127 | cucumber\|09v1\|CK085637_P1 | 3184 | 6230 | 285 | 83 | globlastp |
| WNU96_H128 | euonymus\|11v1\|SRR070038X122109_P1 | 3185 | 6231 | 285 | 83 | globlastp |
| WNU96_H129 | euonymus\|11v1\|SRR070038X188652_P1 | 3186 | 6232 | 285 | 83 | globlastp |
| WNU96_H130 | flaveria\|11v1\|SRR149232.112624_P1 | 3187 | 6233 | 285 | 83 | globlastp |
| WNU96_H131 | gossypium_raimondii\|12v1\|BE052151_P1 | 3188 | 6229 | 285 | 83 | globlastp |
| WNU96_H132 | grape\|11v1\|GSVIVT01007667001_P1 | 3189 | 6234 | 285 | 83 | globlastp |
| WNU96_H133 | kiwi\|gb166\|FG425898_P1 | 3190 | 6235 | 285 | 83 | globlastp |
| WNU96_H134 | lettuce\|12v1\|DW044410_P1 | 3191 | 6236 | 285 | 83 | globlastp |
| WNU96_H135 | lettuce\|12v1\|DW047896_P1 | 3192 | 6237 | 285 | 83 | globlastp |
| WNU96_H136 | monkeyflower\|10v1\|DV206951 | 3193 | 6215 | 285 | 83 | globlastp |
| WNU96_H137 | monkeyflower\|10v1\|DV211975 | 3194 | 6216 | 285 | 83 | globlastp |
| WNU96_H138 | parthenium\|10v1\|GW779132_P1 | 3195 | 6238 | 285 | 83 | globlastp |
| WNU96_H139 | platanus\|11v1\|SRR096786X10437_P1 | 3196 | 6239 | 285 | 83 | globlastp |
| WNU96_H140 | poplar\|10v1\|AI164349 | 3197 | 6240 | 285 | 83 | globlastp |
| WNU96_H140 | poplar\|13v1\|AI164349_P1 | 3198 | 6240 | 285 | 83 | globlastp |
| WNU96_H141 | prunus\|10v1\|BU039430 | 3199 | 6217 | 285 | 83 | globlastp |
| WNU96_H142 | rose\|12v1\|SRR397984.100042 | 3200 | 6241 | 285 | 83 | globlastp |
| WNU96_H143 | senecio\|gb170\|DY661161 | 3201 | 6242 | 285 | 83 | globlastp |
| WNU96_H144 | silene\|11v1\|SRR096785X100751 | 3202 | 6243 | 285 | 83 | globlastp |
| WNU96_H145 | spurge\|gb161\|DV112950 | 3203 | 6244 | 285 | 83 | globlastp |
| WNU96_H146 | spurge\|gb161\|DV113682 | 3204 | 6245 | 285 | 83 | globlastp |
| WNU96_H147 | tragopogon\|10v1\|SRR020205S0012356 | 3205 | 6246 | 285 | 83 | globlastp |
| WNU96_H148 | tragopogon\|10v1\|SRR020205S0135148 | 3206 | 6247 | 285 | 83 | globlastp |
| WNU96_H149 | tripterygium\|11v1\|SRR098677X107685XX1 | 3207 | 6248 | 285 | 83 | globlastp |
| WNU96_H150 | euphorbia\|11v1\|DV113682XX1_T1 | 3208 | 6249 | 285 | 82.99 | glotblastn |
| WNU96_H151 | flaveria\|11v1\|SRR149241.184143_T1 | 3209 | 6250 | 285 | 82.99 | glotblastn |
| WNU96_H152 | strawberry\|11v1\|EX672486 | 3210 | 6251 | 285 | 82.99 | glotblastn |
| WNU96_H153 | cedrus\|11v1\|SRR065007X133095_P1 | 3211 | 6252 | 285 | 82.9 | globlastp |
| WNU96_H154 | cycas\|gb166\|CB092905_P1 | 3212 | 6253 | 285 | 82.9 | globlastp |
| WNU96_H155 | spruce\|11v1\|AF051252 | 3213 | 6254 | 285 | 82.9 | globlastp |
| WNU96_H156 | spruce\|11v1\|ES252863 | 3214 | 6254 | 285 | 82.9 | globlastp |
| WNU96_H157 | spruce\|11v1\|ES259552XX2 | 3215 | 6254 | 285 | 82.9 | globlastp |
| WNU96_H158 | spruce\|11v1\|EX331635XX1 | 3216 | 6254 | 285 | 82.9 | globlastp |
| WNU96_H159 | spruce\|11v1\|SRR064180X149006 | 3217 | 6254 | 285 | 82.9 | globlastp |
| WNU96_H160 | spruce\|11v1\|SRR064180X162014 | 3218 | 6255 | 285 | 82.88 | glotblastn |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU96_H390 | zostera\|12v1\|SRR057351X104422D1_P1 | 3219 | 6256 | 285 | 82.7 | globlastp |
| WNU96_H161 | zostera\|10v1\|SRR057351S0016869 | 3220 | 6256 | 285 | 82.7 | globlastp |
| WNU96_H391 | zostera\|12v1\|AM770335_P1 | 3221 | 6257 | 285 | 82.6 | globlastp |
| WNU96_H162 | zostera\|10v1\|AM770335 | 3222 | 6257 | 285 | 82.6 | globlastp |
| WNU96_H163 | amorphophallus\|11v2\|SRR089351X101338_P1 | 3223 | 6258 | 285 | 82.4 | globlastp |
| WNU96_H164 | cacao\|10v1\|CU473578_P1 | 3224 | 6259 | 285 | 82.4 | globlastp |
| WNU96_H165 | canola\|11v1\|CN726672XX1_T1 | 3225 | 6260 | 285 | 82.31 | glotblastn |
| WNU96_H166 | cirsium\|11v1\|SRR346952.1008646_T1 | 3226 | 6261 | 285 | 82.31 | glotblastn |
| WNU96_H167 | fagopyrum\|11v1\|SRR063689X117854_T1 | 3227 | 6262 | 285 | 82.31 | glotblastn |
| WNU96_H168 | thalictrum\|11v1\|SRR096787X102875 | 3228 | 6263 | 285 | 82.31 | glotblastn |
| WNU96_H169 | thalictrum\|11v1\|SRR096787X115641 | 3229 | 6264 | 285 | 82.31 | glotblastn |
| WNU96_H392 | castorbean\|12v1\|T15058_P1 | 3230 | 6265 | 285 | 82.3 | globlastp |
| WNU96_H393 | monkeyflower\|12v1\|DV206555_P1 | 3231 | 6266 | 285 | 82.3 | globlastp |
| WNU96_H170 | ambrosia\|11v1\|SRR346935.101575_P1 | 3232 | 6267 | 285 | 82.3 | globlastp |
| WNU96_H171 | ambrosia\|11v1\|SRR346935.105796_P1 | 3233 | 6268 | 285 | 82.3 | globlastp |
| WNU96_H172 | aquilegia\|10v2\|JGIAC009870_P1 | 3234 | 6269 | 285 | 82.3 | globlastp |
| WNU96_H173 | b_juncea\|12v1\|E6ANDIZ01A3634_P1 | 3235 | 6270 | 285 | 82.3 | globlastp |
| WNU96_H174 | b_juncea\|12v1\|E6ANDIZ01A4ELM_P1 | 3236 | 6271 | 285 | 82.3 | globlastp |
| WNU96_H175 | b_juncea\|12v1\|EF165000_P1 | 3237 | 6272 | 285 | 82.3 | globlastp |
| WNU96_H176 | b_oleracea\|gb161\|DY025832_P1 | 3238 | 6273 | 285 | 82.3 | globlastp |
| WNU96_H177 | b_oleracea\|gb161\|DY026153_P1 | 3239 | 6274 | 285 | 82.3 | globlastp |
| WNU96_H178 | basilicum\|10v1\|DY337098_P1 | 3240 | 6275 | 285 | 82.3 | globlastp |
| WNU96_H179 | cacao\|10v1\|EH057746_P1 | 3241 | 6276 | 285 | 82.3 | globlastp |
| WNU96_H180 | canola\|11v1\|CN725957XX1_P1 | 3242 | 6273 | 285 | 82.3 | globlastp |
| WNU96_H181 | canola\|11v1\|CN730422_P1 | 3243 | 6274 | 285 | 82.3 | globlastp |
| WNU96_H182 | canola\|11v1\|CN732102_P1 | 3244 | 6277 | 285 | 82.3 | globlastp |
| WNU96_H183 | cassava\|09v1\|CK641581_P1 | 3245 | 6278 | 285 | 82.3 | globlastp |
| WNU96_H185 | chestnut\|gb170\|SRR006295S0003019_P1 | 3246 | 6279 | 285 | 82.3 | globlastp |
| WNU96_H186 | cleome_gynandra\|10v1\|SRR015532S0002168_P1 | 3247 | 6280 | 285 | 82.3 | globlastp |
| WNU96_H187 | cleome_spinosa\|10v1\|GR932217XX1_P1 | 3248 | 6280 | 285 | 82.3 | globlastp |
| WNU96_H188 | cotton\|11v1\|BG443711_P1 | 3249 | 6281 | 285 | 82.3 | globlastp |
| WNU96_H189 | eucalyptus\|11v2\|SRR001659X129057_P1 | 3250 | 6282 | 285 | 82.3 | globlastp |
| WNU96_H190 | fagopyrum\|11v1\|SRR063689X5808_P1 | 3251 | 6283 | 285 | 82.3 | globlastp |
| WNU96_H191 | gossypium_raimondii\|12v1\|BG443711_P1 | 3252 | 6281 | 285 | 82.3 | globlastp |
| WNU96_H192 | humulus\|11v1\|EX519727XX1_P1 | 3253 | 6284 | 285 | 82.3 | globlastp |
| WNU96_H193 | humulus\|11v1\|EX519727XX2_P1 | 3254 | 6284 | 285 | 82.3 | globlastp |
| WNU96_H194 | ipomoea_nil\|10v1\|CJ740287_P1 | 3255 | 6285 | 285 | 82.3 | globlastp |
| WNU96_H196 | nasturtium\|11v1\|SRR032558.125661_P1 | 3256 | 6286 | 285 | 82.3 | globlastp |
| WNU96_H197 | oak\|10v1\|FP024996_P1 | 3257 | 6279 | 285 | 82.3 | globlastp |
| WNU96_H198 | pigeonpea\|11v1\|GR465377_P1 | 3258 | 6287 | 285 | 82.3 | globlastp |
| WNU96_H199 | platanus\|11v1\|SRR096786X100140_P1 | 3259 | 6288 | 285 | 82.3 | globlastp |
| WNU96_H200 | radish\|gb164\|EV525531 | 3260 | 6289 | 285 | 82.3 | globlastp |
| WNU96_H201 | radish\|gb164\|EV527006 | 3261 | 6290 | 285 | 82.3 | globlastp |
| WNU96_H202 | radish\|gb164\|EV538492 | 3262 | 6291 | 285 | 82.3 | globlastp |
| WNU96_H203 | radish\|gb164\|EV542487 | 3263 | 6292 | 285 | 82.3 | globlastp |
| WNU96_H204 | radish\|gb164\|FD950409 | 3264 | 6293 | 285 | 82.3 | globlastp |
| WNU96_H205 | senecio\|gb170\|SRR006592S0001217 | 3265 | 6294 | 285 | 82.3 | globlastp |
| WNU96_H206 | sunflower\|12v1\|CD851129XX1 | 3266 | 6295 | 285 | 82.3 | globlastp |
| WNU96_H207 | sunflower\|12v1\|CD853270XX1 | 3267 | 6268 | 285 | 82.3 | globlastp |
| WNU96_H208 | sunflower\|12v1\|CF076631 | 3268 | 6295 | 285 | 82.3 | globlastp |
| WNU96_H209 | sunflower\|12v1\|DY928155 | 3269 | 6295 | 285 | 82.3 | globlastp |
| WNU96_H210 | sunflower\|12v1\|DY930550 | 3270 | 6295 | 285 | 82.3 | globlastp |
| WNU96_H211 | sunflower\|12v1\|DY955104 | 3271 | 6268 | 285 | 82.3 | globlastp |
| WNU96_H212 | sunflower\|12v1\|DY958350 | 3272 | 6268 | 285 | 82.3 | globlastp |
| WNU96_H213 | sunflower\|12v1\|DY958886 | 3273 | 6295 | 285 | 82.3 | globlastp |
| WNU96_H214 | sunflower\|12v1\|EE656653 | 3274 | 6295 | 285 | 82.3 | globlastp |
| WNU96_H215 | tabernaemontana\|11v1\|SRR098689X104457 | 3275 | 6296 | 285 | 82.3 | globlastp |
| WNU96_H216 | thalictrum\|11v1\|SRR096787X104709 | 3276 | 6297 | 285 | 82.3 | globlastp |
| WNU96_H217 | triphysaria\|10v1\|CB815236 | 3277 | 6298 | 285 | 82.3 | globlastp |
| WNU96_H218 | watermelon\|11v1\|AM719795 | 3278 | 6299 | 285 | 82.3 | globlastp |
| WNU96_H219 | abies\|11v2\|SRR098676X111808_P1 | 3279 | 6300 | 285 | 82.2 | globlastp |
| WNU96_H220 | abies\|11v2\|SRR098676X13377_P1 | 3280 | 6301 | 285 | 82.2 | globlastp |
| WNU96_H221 | cycas\|gb166\|EX920982_P1 | 3281 | 6302 | 285 | 82.2 | globlastp |
| WNU96_H222 | maritime_pine\|10v1\|AL750653_P1 | 3282 | 6303 | 285 | 82.2 | globlastp |
| WNU96_H223 | nasturtium\|11v1\|GH161772_P1 | 3283 | 6304 | 285 | 82.2 | globlastp |
| WNU96_H224 | pine\|10v2\|AA556393_P1 | 3284 | 6305 | 285 | 82.2 | globlastp |
| WNU96_H225 | spruce\|11v1\|ES248525XX1 | 3285 | 6306 | 285 | 82.2 | globlastp |
| WNU96_H226 | pine\|10v2\|AI812874XX1_T1 | 3286 | 6307 | 285 | 82.19 | glotblastn |
| WNU96_H227 | pine\|10v2\|AW985265_T1 | 3287 | 6307 | 285 | 82.19 | glotblastn |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU96_H228 | spruce\|11v1\|FD734799XX1 | 3288 | 6308 | 285 | 82.19 | glotblastn |
| WNU96_H229 | petunia\|gb171\|AF088913_P1 | 3289 | 6309 | 285 | 82 | globlastp |
| WNU96_H230 | euonymus\|11v1\|SRR070038X218801_P1 | 3290 | 6310 | 285 | 81.9 | globlastp |
| WNU96_H231 | liquorice\|gb171\|FS241298_P1 | 3291 | 6311 | 285 | 81.9 | globlastp |
| WNU96_H232 | liquorice\|gb171\|FS251321_P1 | 3292 | 6312 | 285 | 81.9 | globlastp |
| WNU96_H233 | peanut\|10v1\|CO897522XX1_P1 | 3293 | 6313 | 285 | 81.8 | globlastp |
| WNU96_H234 | pepper\|12v1\|BM063049XX1_P1 | 3294 | 6314 | 285 | 81.8 | globlastp |
| WNU96_H235 | soybean\|11v1\|GLYMA02G04400 | 3295 | 6315 | 285 | 81.8 | globlastp |
| WNU96_H235 | soybean\|12v1\|GLYMA02G04400_P1 | 3296 | 6315 | 285 | 81.8 | globlastp |
| WNU96_H236 | gerbera\|09v1\|AJ754494_T1 | 3297 | 6316 | 285 | 81.63 | glotblastn |
| WNU96_H237 | vinca\|11v1\|SRR098690X138305XX1 | 3298 | 6317 | 285 | 81.63 | glotblastn |
| WNU96_H394 | prunus_mume\|13v1\|CV051773_P1 | 3299 | 6318 | 285 | 81.6 | globlastp |
| WNU96_H238 | acacia\|10v1\|FS585541_P1 | 3300 | 6319 | 285 | 81.6 | globlastp |
| WNU96_H239 | amsonia\|11v1\|SRR098688X113310_P1 | 3301 | 6320 | 285 | 81.6 | globlastp |
| WNU96_H240 | antirrhinum\|gb166\|AJ786850_P1 | 3302 | 6321 | 285 | 81.6 | globlastp |
| WNU96_H241 | apple\|11v1\|CN581999_P1 | 3303 | 6322 | 285 | 81.6 | globlastp |
| WNU96_H242 | artemisia\|10v1\|EY031879_P1 | 3304 | 6323 | 285 | 81.6 | globlastp |
| WNU96_H243 | b_juncea\|12v1\|E6ANDIZ01A83XD_P1 | 3305 | 6324 | 285 | 81.6 | globlastp |
| WNU96_H244 | b_juncea\|12v1\|E6ANDIZ01AJ5DD_P1 | 3306 | 6325 | 285 | 81.6 | globlastp |
| WNU96_H245 | b_juncea\|12v1\|E6ANDIZ01AL3QQ_P1 | 3307 | 6326 | 285 | 81.6 | globlastp |
| WNU96_H246 | b_juncea\|12v1\|E6ANDIZ01D73PK_P1 | 3308 | 6327 | 285 | 81.6 | globlastp |
| WNU96_H247 | b_oleracea\|gb161\|DY027359_P1 | 3309 | 6328 | 285 | 81.6 | globlastp |
| WNU96_H248 | b_oleracea\|gb161\|DY028923_P1 | 3310 | 6329 | 285 | 81.6 | globlastp |
| WNU96_H249 | canola\|11v1\|CN726337XX1_P1 | 3311 | 6324 | 285 | 81.6 | globlastp |
| WNU96_H250 | centaurea\|11v1\|EH737154XX1_P1 | 3312 | 6330 | 285 | 81.6 | globlastp |
| WNU96_H251 | centaurea\|11v1\|EH745871_P1 | 3313 | 6331 | 285 | 81.6 | globlastp |
| WNU96_H252 | cirsium\|11v1\|SRR346952.110585_P1 | 3314 | 6332 | 285 | 81.6 | globlastp |
| WNU96_H253 | clementine\|11v1\|CB291758_P1 | 3315 | 6333 | 285 | 81.6 | globlastp |
| WNU96_H254 | clementine\|11v1\|CV886204_P1 | 3316 | 6334 | 285 | 81.6 | globlastp |
| WNU96_H255 | cleome_gynandra\|10v1\|SRR015532S0041884_P1 | 3317 | 6335 | 285 | 81.6 | globlastp |
| WNU96_H256 | cotton\|11v1\|BE052292XX1_P1 | 3318 | 6336 | 285 | 81.6 | globlastp |
| WNU96_H257 | cucumber\|09v1\|CF674910_P1 | 3319 | 6337 | 285 | 81.6 | globlastp |
| WNU96_H258 | cucurbita\|11v1\|SRR091276X104293_P1 | 3320 | 6337 | 285 | 81.6 | globlastp |
| WNU96_H259 | cucurbita\|11v1\|SRR091276X107888_P1 | 3321 | 6338 | 285 | 81.6 | globlastp |
| WNU96_H260 | cucurbita\|11v1\|SRR091276X108131_P1 | 3322 | 6337 | 285 | 81.6 | globlastp |
| WNU96_H261 | cynara\|gb167\|GE586291_P1 | 3323 | 6332 | 285 | 81.6 | globlastp |
| WNU96_H262 | euonymus\|11v1\|SRR070038X112272_P1 | 3324 | 6339 | 285 | 81.6 | globlastp |
| WNU96_H263 | euonymus\|11v1\|SRR070038X322834_P1 | 3325 | 6339 | 285 | 81.6 | globlastp |
| WNU96_H264 | flaveria\|11v1\|SRR149232.127853_P1 | 3326 | 6340 | 285 | 81.6 | globlastp |
| WNU96_H265 | gossypium_raimondii\|12v1\|BE052292_P1 | 3327 | 6336 | 285 | 81.6 | globlastp |
| WNU96_H266 | guizotia\|10v1\|GE559073_P1 | 3328 | 6341 | 285 | 81.6 | globlastp |
| WNU96_H267 | hornbeam\|12v1\|SRR364455.11856_P1 | 3329 | 6342 | 285 | 81.6 | globlastp |
| WNU96_H268 | melon\|10v1\|CF674910_P1 | 3330 | 6337 | 285 | 81.6 | globlastp |
| WNU96_H269 | orobanche\|10v1\|SRR023189S0001498_P1 | 3331 | 6343 | 285 | 81.6 | globlastp |
| WNU96_H270 | orobanche\|10v1\|SRR023189S0080494_P1 | 3332 | 6343 | 285 | 81.6 | globlastp |
| WNU96_H271 | papaya\|gb165\|EX291945_P1 | 3333 | 6344 | 285 | 81.6 | globlastp |
| WNU96_H272 | peanut\|10v1\|CD038392_P1 | 3334 | 6345 | 285 | 81.6 | globlastp |
| WNU96_H273 | physcomitrella\|10v1\|BJ161027_P1 | 3335 | 6346 | 285 | 81.6 | globlastp |
| WNU96_H274 | radish\|gb164\|EV545037 | 3336 | 6347 | 285 | 81.6 | globlastp |
| WNU96_H275 | radish\|gb164\|EW725335 | 3337 | 6348 | 285 | 81.6 | globlastp |
| WNU96_H276 | radish\|gb164\|FD529248 | 3338 | 6349 | 285 | 81.6 | globlastp |
| WNU96_H277 | rose\|12v1\|BQ106054XX1 | 3339 | 6350 | 285 | 81.6 | globlastp |
| WNU96_H278 | soybean\|11v1\|GLYMA05G02570 | 3340 | 6351 | 285 | 81.6 | globlastp |
| WNU96_H278 | soybean\|12v1\|GLYMA05G02570_P1 | 3341 | 6351 | 285 | 81.6 | globlastp |
| WNU96_H279 | strawberry\|11v1\|DV438988 | 3342 | 6352 | 285 | 81.6 | globlastp |
| WNU96_H280 | strawberry\|11v1\|EX657357 | 3343 | 6353 | 285 | 81.6 | globlastp |
| WNU96_H281 | tabernaemontana\|11v1\|SRR098689X104588 | 3344 | 6354 | 285 | 81.6 | globlastp |
| WNU96_H282 | triphysaria\|10v1\|EX984214 | 3345 | 6355 | 285 | 81.6 | globlastp |
| WNU96_H283 | triphysaria\|10v1\|EY008346 | 3346 | 6355 | 285 | 81.6 | globlastp |
| WNU96_H284 | walnuts\|gb166\|CV195836 | 3347 | 6356 | 285 | 81.6 | globlastp |
| WNU96_H285 | watermelon\|11v1\|DV632841 | 3348 | 6337 | 285 | 81.6 | globlastp |
| WNU96_H286 | gnetum\|10v1\|DN955837_P1 | 3349 | 6357 | 285 | 81.5 | globlastp |
| WNU96_H287 | rye\|12v1\|DRR001012.12244 | 3350 | 6358 | 285 | 81.5 | globlastp |
| WNU96_H288 | tamarix\|gb166\|CF200068 | 3351 | 6359 | 285 | 81.5 | globlastp |
| WNU96_H289 | euonymus\|11v1\|SRR070038X11633_P1 | 3352 | 6360 | 285 | 81.3 | globlastp |
| WNU96_H290 | euonymus\|11v1\|SRR070038X139772_P1 | 3353 | 6361 | 285 | 81.3 | globlastp |
| WNU96_H291 | pepper\|12v1\|AA840728_P1 | 3354 | 6362 | 285 | 81.3 | globlastp |
| WNU96_H292 | tripterygium\|11v1\|SRR098677X105260 | 3355 | 6363 | 285 | 81.3 | globlastp |
| WNU96_H293 | chickpea\|11v1\|GR402447XX1 | 3356 | 6364 | 285 | 81.2 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU96_H293 | chickpea\|13v2\|ES560331_P1 | 3357 | 6364 | 285 | 81.2 | globlastp |
| WNU96_H294 | oil_palm\|11v1\|EL684166_P1 | 3358 | 6365 | 285 | 81.2 | globlastp |
| WNU96_H295 | ipomoea_nil\|10v1\|BJ564015_P1 | 3359 | 6366 | 285 | 81.1 | globlastp |
| WNU96_H296 | soybean\|11v1\|GLYMA01G03180 | 3360 | 6367 | 285 | 81.1 | globlastp |
| WNU96_H296 | soybean\|12v1\|GLYMA01G03180_P1 | 3361 | 6367 | 285 | 81.1 | globlastp |
| WNU96_H395 | soybean\|12v1\|GLYMA17G09280_P1 | 3362 | 6368 | 285 | 81 | globlastp |
| WNU96_H297 | ambrosia\|11v1\|SRR346943.104466_P1 | 3363 | 6369 | 285 | 81 | globlastp |
| WNU96_H298 | arabidopsis_lyrata\|09v1\|BQ834538_P1 | 3364 | 6370 | 285 | 81 | globlastp |
| WNU96_H299 | arabidopsis_lyrata\|09v1\|JGIAL007298_P1 | 3365 | 6371 | 285 | 81 | globlastp |
| WNU96_H300 | arabidopsis\|10v1\|AT1G23290_P1 | 3366 | 6372 | 285 | 81 | globlastp |
| WNU96_H301 | arabidopsis\|10v1\|AT1G70600_P1 | 3367 | 6371 | 285 | 81 | globlastp |
| WNU96_H302 | aristolochia\|10v1\|SRR039082S0197812_P1 | 3368 | 6373 | 285 | 81 | globlastp |
| WNU96_H303 | aristolochia\|10v1\|SRR039082S0498980_P1 | 3369 | 6374 | 285 | 81 | globlastp |
| WNU96_H304 | arnica\|11v1\|SRR099034X170873_P1 | 3370 | 6375 | 285 | 81 | globlastp |
| WNU96_H305 | b_juncea\|12v1\|E6ANDIZ01ASPS4_P1 | 3371 | 6376 | 285 | 81 | globlastp |
| WNU96_H306 | b_rapa\|11v1\|BQ791115_P1 | 3372 | 6377 | 285 | 81 | globlastp |
| WNU96_H307 | b_rapa\|11v1\|CD812260_P1 | 3373 | 6378 | 285 | 81 | globlastp |
| WNU96_H308 | beech\|11v1\|SRR006294.10896_P1 | 3374 | 6379 | 285 | 81 | globlastp |
| WNU96_H309 | blueberry\|12v1\|SRR353282X15999D1_P1 | 3375 | 6380 | 285 | 81 | globlastp |
| WNU96_H310 | cannabis\|12v1\|GR221832_P1 | 3376 | 6381 | 285 | 81 | globlastp |
| WNU96_H311 | cassava\|09v1\|DV441380_P1 | 3377 | 6382 | 285 | 81 | globlastp |
| WNU96_H312 | centaurea\|11v1\|EH751538_P1 | 3378 | 6383 | 285 | 81 | globlastp |
| WNU96_H313 | cirsium\|11v1\|SRR346952.1023744_P1 | 3379 | 6383 | 285 | 81 | globlastp |
| WNU96_H314 | cirsium\|11v1\|SRR349641.457773_P1 | 3380 | 6383 | 285 | 81 | globlastp |
| WNU96_H315 | flaveria\|11v1\|SRR149241.191636_P1 | 3381 | 6384 | 285 | 81 | globlastp |
| WNU96_H316 | grape\|11v1\|GSVIVT01004075001_P1 | 3382 | 6385 | 285 | 81 | globlastp |
| WNU96_H317 | kiwi\|gb166\|FG432617_P1 | 3383 | 6386 | 285 | 81 | globlastp |
| WNU96_H318 | orange\|11v1\|CB291758_P1 | 3384 | 6387 | 285 | 81 | globlastp |
| WNU96_H319 | orobanche\|10v1\|SRR023189S0028718_P1 | 3385 | 6388 | 285 | 81 | globlastp |
| WNU96_H320 | peanut\|10v1\|EG373102XX1_P1 | 3386 | 6389 | 285 | 81 | globlastp |
| WNU96_H321 | peanut\|10v1\|ES717832_P1 | 3387 | 6390 | 285 | 81 | globlastp |
| WNU96_H322 | prunus\|10v1\|CN445705 | 3388 | 6391 | 285 | 81 | globlastp |
| WNU96_H323 | soybean\|11v1\|GLYMA17G09280 | 3389 | 6368 | 285 | 81 | globlastp |
| WNU96_H323 | soybean\|12v1\|GLYMA17G09280T2_P1 | 3390 | 6368 | 285 | 81 | globlastp |
| WNU96_H324 | sunflower\|12v1\|EL430773 | 3391 | 6392 | 285 | 81 | globlastp |
| WNU96_H325 | thellungiella_halophilum\|11v1\|DN773413 | 3392 | 6371 | 285 | 81 | globlastp |
| WNU96_H326 | thellungiella_halophilum\|11v1\|DN773986 | 3393 | 6393 | 285 | 81 | globlastp |
| WNU96_H327 | thellungiella_parvulum\|11v1\|DN773413 | 3394 | 6394 | 285 | 81 | globlastp |
| WNU96_H328 | thellungiella_parvulum\|11v1\|DN773986 | 3395 | 6395 | 285 | 81 | globlastp |
| WNU96_H329 | triphysaria\|10v1\|BE574800 | 3396 | 6396 | 285 | 81 | globlastp |
| WNU96_H330 | valeriana\|11v1\|SRR099039X109958 | 3397 | 6397 | 285 | 81 | globlastp |
| WNU96_H331 | radish\|gb164\|EX772405 | 3398 | 6398 | 285 | 80.95 | glotblastn |
| WNU96_H332 | spruce\|11v1\|SRR064180X118440 | 3399 | 6399 | 285 | 80.82 | glotblastn |
| WNU96_H333 | fagopyrum\|11v1\|SRR063703X102046_P1 | 3400 | 6400 | 285 | 80.8 | globlastp |
| WNU96_H334 | fern\|gb171\|BP916009_P1 | 3401 | 6401 | 285 | 80.8 | globlastp |
| WNU96_H335 | marchantia\|gb166\|BJ843643_P1 | 3402 | 6402 | 285 | 80.8 | globlastp |
| WNU96_H336 | marchantia\|gb166\|C95754_P1 | 3403 | 6403 | 285 | 80.8 | globlastp |
| WNU96_H337 | taxus\|10v1\|SRR032523S0004042 | 3404 | 6404 | 285 | 80.8 | globlastp |
| WNU96_H338 | curcuma\|10v1\|DY383806_P1 | 3405 | 6405 | 285 | 80.7 | globlastp |
| WNU96_H339 | ginger\|gb164\|DY348420_P1 | 3406 | 6405 | 285 | 80.7 | globlastp |
| WNU96_H340 | clover\|gb162\|BB931377_P1 | 3407 | 6406 | 285 | 80.5 | globlastp |
| WNU96_H341 | blueberry\|12v1\|SRR353282X40202D1_P1 | 3408 | 6407 | 285 | 80.4 | globlastp |
| WNU96_H342 | eggplant\|10v1\|FS001347_P1 | 3409 | 6408 | 285 | 80.4 | globlastp |
| WNU96_H343 | ipomoea_batatas\|10v1\|BU690148_P1 | 3410 | 6409 | 285 | 80.4 | globlastp |
| WNU96_H344 | pigeonpea\|11v1\|GW354286_P1 | 3411 | 6410 | 285 | 80.4 | globlastp |
| WNU96_H345 | pigeonpea\|11v1\|SRR054580X108215_P1 | 3412 | 6411 | 285 | 80.4 | globlastp |
| WNU96_H346 | tomato\|11v1\|BG126263 | 3413 | 6408 | 285 | 80.4 | globlastp |
| WNU96_H396 | olea\|13v1\|SRR014463X26593D1_P1 | 3414 | 6412 | 285 | 80.3 | globlastp |
| WNU96_H347 | arnica\|11v1\|SRR099034X110845_P1 | 3415 | 6413 | 285 | 80.3 | globlastp |
| WNU96_H348 | beech\|11v1\|SRR006293.11638_P1 | 3416 | 6414 | 285 | 80.3 | globlastp |
| WNU96_H349 | cassava\|09v1\|CK641743_P1 | 3417 | 6415 | 285 | 80.3 | globlastp |
| WNU96_H350 | ceratodon\|10v1\|SRR074890S0020449_P1 | 3418 | 6416 | 285 | 80.3 | globlastp |
| WNU96_H351 | ceratodon\|10v1\|SRR074890S0029921_P1 | 3419 | 6417 | 285 | 80.3 | globlastp |
| WNU96_H352 | ceratodon\|10v1\|SRR074890S0064914_P1 | 3420 | 6416 | 285 | 80.3 | globlastp |
| WNU96_H353 | cleome_spinosa\|10v1\|GR934531_P1 | 3421 | 6418 | 285 | 80.3 | globlastp |
| WNU96_H354 | cotton\|11v1\|AI731642_P1 | 3422 | 6419 | 285 | 80.3 | globlastp |
| WNU96_H355 | cotton\|11v1\|CO087199XX1_P1 | 3423 | 6419 | 285 | 80.3 | globlastp |
| WNU96_H356 | gossypium_raimondii\|12v1\|AI731642_P1 | 3424 | 6419 | 285 | 80.3 | globlastp |
| WNU96_H357 | hevea\|10v1\|EC600120_P1 | 3425 | 6420 | 285 | 80.3 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU96_H358 | humulus\|11v1\|ES654425_P1 | 3426 | 6421 | 285 | 80.3 | globlastp |
| WNU96_H359 | lotus\|09v1\|AW428898_P1 | 3427 | 6422 | 285 | 80.3 | globlastp |
| WNU96_H360 | physcomitrella\|10v1\|AW126626_P1 | 3428 | 6423 | 285 | 80.3 | globlastp |
| WNU96_H361 | physcomitrella\|10v1\|AW126763_P1 | 3429 | 6424 | 285 | 80.3 | globlastp |
| WNU96_H362 | physcomitrella\|10v1\|AW145241_P1 | 3430 | 6425 | 285 | 80.3 | globlastp |
| WNU96_H363 | physcomitrella\|10v1\|AW561507_P1 | 3431 | 6426 | 285 | 80.3 | globlastp |
| WNU96_H364 | soybean\|11v1\|GLYMA04G36140 | 3432 | 6427 | 285 | 80.3 | globlastp |
| WNU96_H364 | soybean\|12v1\|GLYMA04G36140_P1 | 3433 | 6427 | 285 | 80.3 | globlastp |
| WNU96_H365 | soybean\|11v1\|GLYMA06G18800 | 3434 | 6427 | 285 | 80.3 | globlastp |
| WNU96_H365 | soybean\|12v1\|GLYMA06G18800_P1 | 3435 | 6427 | 285 | 80.3 | globlastp |
| WNU96_H366 | tea\|10v1\|FE861453 | 3436 | 6428 | 285 | 80.3 | globlastp |
| WNU96_H367 | triphysaria\|10v1\|EY132075 | 3437 | 6429 | 285 | 80.3 | globlastp |
| WNU96_H368 | valeriana\|11v1\|SRR099039X100712 | 3438 | 6430 | 285 | 80.3 | globlastp |
| WNU96_H369 | nasturtium\|11v1\|GH168713XX1_T1 | 3439 | 6431 | 285 | 80.27 | glotblastn |
| WNU96_H370 | thalictrum\|11v1\|SRR096787X100084 | 3440 | 6432 | 285 | 80.27 | glotblastn |
| WNU96_H371 | wheat\|12v3\|ERR125558X344920D1 | 3441 | 6433 | 285 | 80.27 | glotblastn |
| WNU96_H372 | amborella\|12v3\|SRR038635.54053_P1 | 3442 | 6434 | 285 | 80.1 | globlastp |
| WNU96_H373 | coffea\|10v1\|DV664105_P1 | 3443 | 6435 | 285 | 80.1 | globlastp |
| WNU96_H374 | fagopyrum\|11v1\|SRR063689X1162_P1 | 3444 | 6436 | 285 | 80.1 | globlastp |
| WNU96_H375 | fern\|gb171\|BP911784_P1 | 3445 | 6437 | 285 | 80.1 | globlastp |
| WNU96_H376 | zamia\|gb166\|FD767255 | 3446 | 6438 | 285 | 80.1 | globlastp |
| WNU96_H377 | lotus\|09v1\|BE122486_P1 | 3447 | 6439 | 285 | 80 | globlastp |
| WNU97_H23 | switchgrass\|12v1\|DN141383_P1 | 3448 | 6440 | 286 | 93.9 | globlastp |
| WNU97_H1 | switchgrass\|gb167\|DN141383 | 3449 | 6441 | 286 | 93.9 | globlastp |
| WNU97_H2 | sorghum\|12v1\|SB04G030840 | 3450 | 6442 | 286 | 93.5 | globlastp |
| WNU97_H24 | switchgrass\|12v1\|FL700367_P1 | 3451 | 6443 | 286 | 93.1 | globlastp |
| WNU97_H3 | foxtail_millet\|11v3\|PHY7SI017105M_P1 | 3452 | 6444 | 286 | 93.1 | globlastp |
| WNU97_H4 | foxtail_millet\|11v3\|PHY7SI017100M_P1 | 3453 | 6445 | 286 | 92.9 | globlastp |
| WNU97_H5 | millet\|10v1\|EVO454PM029707_P1 | 3454 | 6446 | 286 | 92.9 | globlastp |
| WNU97_H6 | sugarcane\|10v1\|BQ537415 | 3455 | 6447 | 286 | 92.2 | globlastp |
| WNU97_H7 | rice\|11v1\|AU030834 | 3456 | 6448 | 286 | 91.8 | globlastp |
| WNU97_H8 | maize\|10v1\|AI619236_P1 | 3457 | 6449 | 286 | 91.2 | globlastp |
| WNU97_H9 | maize\|10v1\|AI395902_P1 | 3458 | 6450 | 286 | 90.4 | globlastp |
| WNU97_H10 | brachypodium\|12v1\|BRADI3G52490_P1 | 3459 | 6451 | 286 | 88.5 | globlastp |
| WNU97_H11 | brachypodium\|12v1\|BRADI3G52480_T1 | 3460 | 6452 | 286 | 88.05 | glotblastn |
| WNU97_H12 | rye\|12v1\|DRR001012.374006 | 3461 | 6453 | 286 | 87.42 | glotblastn |
| WNU97_H13 | brachypodium\|12v1\|BRADI4G20910_P1 | 3462 | 6454 | 286 | 87.4 | globlastp |
| WNU97_H14 | wheat\|12v3\|BE398510 | 3463 | 6455 | 286 | 87.4 | globlastp |
| WNU97_H15 | wheat\|12v3\|BE637843 | 3464 | 6456 | 286 | 87.4 | globlastp |
| WNU97_H16 | barley\|12v1\|BI949877_P1 | 3465 | 6457 | 286 | 87.3 | globlastp |
| WNU97_H17 | foxtail_millet\|11v3\|EC613380_P1 | 3466 | 6458 | 286 | 86.2 | globlastp |
| WNU97_H25 | switchgrass\|12v1\|FE610507_P1 | 3467 | 6459 | 286 | 86 | globlastp |
| WNU97_H18 | switchgrass\|gb167\|FE610507 | 3468 | 6459 | 286 | 86 | globlastp |
| WNU97_H19 | rice\|11v1\|BE039832 | 3469 | 6460 | 286 | 85.6 | globlastp |
| WNU97_H20 | barley\|12v1\|CB870420_P1 | 3470 | 6461 | 286 | 85.5 | globlastp |
| WNU97_H21 | brachypodium\|12v1\|BRADI5G20500_P1 | 3471 | 6462 | 286 | 84.3 | globlastp |
| WNU97_H26 | switchgrass\|12v1\|HO302712_P1 | 3472 | 6463 | 286 | 81.5 | globlastp |
| WNU97_H22 | oil_palm\|11v1\|SRR190698.333_P1 | 3473 | 6464 | 286 | 81.5 | globlastp |
| WNU98_H1 | sorghum\|12v1\|SB12V2PRD003639 | 3474 | 6465 | 287 | 97.7 | globlastp |
| WNU98_H3 | maize\|10v1\|AI834458_P1 | 3475 | 6466 | 287 | 90.4 | globlastp |
| WNU98_H21 | switchgrass\|12v1\|FL696742_P1 | 3476 | 6467 | 287 | 86.5 | globlastp |
| WNU98_H9 | switchgrass\|gb167\|FL696742 | 3477 | 6468 | 287 | 86.5 | globlastp |
| WNU98_H11 | brachypodium\|12v1\|BRADI3G36420T2_P1 | 3478 | 6469 | 287 | 83 | globlastp |
| WNU98_H17 | millet\|10v1\|CD725866_P1 | 3479 | 6470 | 287 | 80.5 | globlastp |
| WNU98_H18 | brachypodium\|12v1\|BRADI3G15400_P1 | 3480 | 6471 | 287 | 80.3 | globlastp |
| WNU100_H1 | sugarcane\|10v1\|CA080221 | 3481 | 6472 | 289 | 97.3 | globlastp |
| WNU100_H2 | maize\|10v1\|AI920330_P1 | 3482 | 6473 | 289 | 95.3 | globlastp |
| WNU100_H3 | maize\|10v1\|AI372343_P1 | 3483 | 6474 | 289 | 92.4 | globlastp |
| WNU100_H21 | switchgrass\|12v1\|DN145760_P1 | 3484 | 6475 | 289 | 92.2 | globlastp |
| WNU100_H4 | foxtail_millet\|11v3\|PHY7SI022041M_P1 | 3485 | 6476 | 289 | 91.6 | globlastp |
| WNU100_H22 | switchgrass\|12v1\|DN143054_P1 | 3486 | 6477 | 289 | 91.3 | globlastp |
| WNU100_H5 | millet\|10v1\|EVO454PM004855_P1 | 3487 | 6478 | 289 | 89.5 | globlastp |
| WNU100_H6 | rice\|11v1\|BE039691 | 3488 | 6479 | 289 | 85 | globlastp |
| WNU100_H7 | brachypodium\|12v1\|BRADI2G27870T2_P1 | 3489 | 6480 | 289 | 84.8 | globlastp |
| WNU100_H8 | switchgrass\|gb167\|FE607111 | 3490 | 6481 | 289 | 84.4 | globlastp |
| WNU100_H9 | rye\|12v1\|BE438576 | 3491 | 6482 | 289 | 83.3 | globlastp |
| WNU100_H10 | rye\|12v1\|BE587236 | 3492 | 6483 | 289 | 83 | globlastp |
| WNU100_H11 | wheat\|12v3\|BE425285 | 3493 | 6484 | 289 | 82.4 | globlastp |
| WNU100_H12 | oat\|11v1\|GO590964_P1 | 3494 | 6485 | 289 | 82 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU100_H13 | sugarcane\|10v1\|BU103330 | 3495 | 6486 | 289 | 81.4 | globlastp |
| WNU100_H14 | sorghum\|12v1\|SB03G012980P1 | 3496 | 6487 | 289 | 81.2 | globlastp |
| WNU100_H15 | rice\|11v1\|AF251077 | 3497 | 6488 | 289 | 80.9 | globlastp |
| WNU100_H16 | maize\|10v1\|AW330985_P1 | 3498 | 6489 | 289 | 80.8 | globlastp |
| WNU100_H17 | switchgrass\|gb167\|DN145169 | 3499 | 6490 | 289 | 80.5 | globlastp |
| WNU100_H23 | switchgrass\|12v1\|FE614478_P1 | 3500 | 6491 | 289 | 80.3 | globlastp |
| WNU100_H18 | brachypodium\|12v1\|BRADI2G11960_P1 | 3501 | 6492 | 289 | 80.2 | globlastp |
| WNU100_H19 | foxtail_millet\|11v3\|EC613315_P1 | 3502 | 6493 | 289 | 80 | globlastp |
| WNU100_H20 | switchgrass\|gb167\|FE614478 | 3503 | 6494 | 289 | 80 | globlastp |
| WNU101_H293 | switchgrass\|12v1\|FL890785_P1 | 3504 | 290 | 290 | 100 | globlastp |
| WNU101_H1 | foxtail_millet\|11v3\|PHY7SI037950M_P1 | 3505 | 290 | 290 | 100 | globlastp |
| WNU101_H2 | maize\|10v1\|AI947327_P1 | 3506 | 290 | 290 | 100 | globlastp |
| WNU101_H3 | rice\|11v1\|AA751811 | 3507 | 290 | 290 | 100 | globlastp |
| WNU101_H4 | rice\|11v1\|BM422117 | 3508 | 290 | 290 | 100 | globlastp |
| WNU101_H5 | sugarcane\|10v1\|CA078742 | 3509 | 290 | 290 | 100 | globlastp |
| WNU101_H6 | sugarcane\|10v1\|CA094200 | 3510 | 290 | 290 | 100 | globlastp |
| WNU101_H7 | switchgrass\|gb167\|FE627194 | 3511 | 290 | 290 | 100 | globlastp |
| WNU101_H8 | switchgrass\|gb167\|FL890785 | 3512 | 290 | 290 | 100 | globlastp |
| WNU101_H294 | prunus_mume\|13v1\|CV048453_P1 | 3513 | 6495 | 290 | 99.3 | globlastp |
| WNU101_H295 | switchgrass\|12v1\|FE599229_P1 | 3514 | 6496 | 290 | 99.3 | globlastp |
| WNU101_H296 | switchgrass\|12v1\|FE627193_P1 | 3515 | 6497 | 290 | 99.3 | globlastp |
| WNU101_H297 | switchgrass\|12v1\|PVJGIV8034532_P1 | 3516 | 6496 | 290 | 99.3 | globlastp |
| WNU101_H9 | cannabis\|12v1\|SOLX00003945_P1 | 3517 | 6498 | 290 | 99.3 | globlastp |
| WNU101_H10 | cannabis\|12v1\|SOLX00046973_P1 | 3518 | 6498 | 290 | 99.3 | globlastp |
| WNU101_H11 | cowpea\|12v1\|FC457960_P1 | 3519 | 6498 | 290 | 99.3 | globlastp |
| WNU101_H12 | cynodon\|10v1\|ES299130_P1 | 3520 | 6499 | 290 | 99.3 | globlastp |
| WNU101_H13 | foxtail_millet\|11v3\|PHY7SI015422M_P1 | 3521 | 6500 | 290 | 99.3 | globlastp |
| WNU101_H14 | humulus\|11v1\|ES652347_P1 | 3522 | 6498 | 290 | 99.3 | globlastp |
| WNU101_H15 | millet\|10v1\|EVO454PM082379_P1 | 3523 | 6501 | 290 | 99.3 | globlastp |
| WNU101_H16 | millet\|10v1\|EVO454PM092592_P1 | 3524 | 6502 | 290 | 99.3 | globlastp |
| WNU101_H17 | oil_palm\|11v1\|EL563746_T1 | 3525 | 6503 | 290 | 99.3 | globtblastn |
| WNU101_H18 | prunus\|10v1\|CB821190 | 3526 | 6495 | 290 | 99.3 | globlastp |
| WNU101_H19 | switchgrass\|gb167\|FE599229 | 3527 | 6496 | 290 | 99.3 | globlastp |
| WNU101_H20 | switchgrass\|gb167\|FE627193 | 3528 | 6497 | 290 | 99.3 | globlastp |
| WNU101_H298 | bean\|12v2\|SRR001334.110465_P1 | 3529 | 6504 | 290 | 98.6 | globlastp |
| WNU101_H299 | castorbean\|12v1\|AM267346_P1 | 3530 | 6505 | 290 | 98.6 | globlastp |
| WNU101_H300 | olea\|13v1\|SRR596004X17743D1_P1 | 3531 | 6506 | 290 | 98.6 | globlastp |
| WNU101_H301 | soybean\|12v1\|FG996914_P1 | 3532 | 6505 | 290 | 98.6 | globlastp |
| WNU101_H21 | amborella\|12v3\|CV001469_P1 | 3533 | 6505 | 290 | 98.6 | globlastp |
| WNU101_H22 | amsonia\|11v1\|SRR098688X107015_P1 | 3534 | 6507 | 290 | 98.6 | globlastp |
| WNU101_H23 | banana\|12v1\|BBS767T3_P1 | 3535 | 6505 | 290 | 98.6 | globlastp |
| WNU101_H24 | banana\|12v1\|GFXAC186753X5_P1 | 3536 | 6505 | 290 | 98.6 | globlastp |
| WNU101_H25 | basilicum\|10v1\|DY323195XX1_P1 | 3537 | 6508 | 290 | 98.6 | globlastp |
| WNU101_H26 | basilicum\|10v1\|DY323761_P1 | 3538 | 6508 | 290 | 98.6 | globlastp |
| WNU101_H27 | bean\|12v1\|SRR001334.110465 | 3539 | 6504 | 290 | 98.6 | globlastp |
| WNU101_H28 | beet\|12v1\|DN911504_P1 | 3540 | 6509 | 290 | 98.6 | globlastp |
| WNU101_H29 | cacao\|10v1\|CF973092_P1 | 3541 | 6505 | 290 | 98.6 | globlastp |
| WNU101_H30 | cannabis\|12v1\|SOLX00000646_P1 | 3542 | 6510 | 290 | 98.6 | globlastp |
| WNU101_H32 | catharanthus\|11v1\|EG556080_P1 | 3543 | 6509 | 290 | 98.6 | globlastp |
| WNU101_H33 | cleome_gynandra\|10v1\|SRR015532S0005602_P1 | 3544 | 6505 | 290 | 98.6 | globlastp |
| WNU101_H34 | cyamopsis\|10v1\|EG975384_P1 | 3545 | 6505 | 290 | 98.6 | globlastp |
| WNU101_H35 | cynodon\|10v1\|ES301623_P1 | 3546 | 6511 | 290 | 98.6 | globlastp |
| WNU101_H36 | eggplant\|10v1\|FS036156_P1 | 3547 | 6506 | 290 | 98.6 | globlastp |
| WNU101_H37 | eucalyptus\|11v2\|CD668709_P1 | 3548 | 6505 | 290 | 98.6 | globlastp |
| WNU101_H38 | euphorbia\|11v1\|BG409394_P1 | 3549 | 6505 | 290 | 98.6 | globlastp |
| WNU101_H39 | fagopyrum\|11v1\|SRR063689X10256_P1 | 3550 | 6512 | 290 | 98.6 | globlastp |
| WNU101_H40 | fagopyrum\|11v1\|SRR063703X114483_P1 | 3551 | 6512 | 290 | 98.6 | globlastp |
| WNU101_H41 | grape\|11v1\|GSVIVT01018060001_P1 | 3552 | 6505 | 290 | 98.6 | globlastp |
| WNU101_H42 | iceplant\|gb164\|BE577228_P1 | 3553 | 6513 | 290 | 98.6 | globlastp |
| WNU101_H43 | ipomoea_nil\|10v1\|BJ555713_P1 | 3554 | 6504 | 290 | 98.6 | globlastp |
| WNU101_H44 | kiwi\|gb166\|FG410882_P1 | 3555 | 6514 | 290 | 98.6 | globlastp |
| WNU101_H45 | periwinkle\|gb164\|EG556080_P1 | 3556 | 6509 | 290 | 98.6 | globlastp |
| WNU101_H46 | phyla\|11v2\|SRR099035X135285_P1 | 3557 | 6514 | 290 | 98.6 | globlastp |
| WNU101_H47 | pigeonpea\|11v1\|GR471946_P1 | 3558 | 6505 | 290 | 98.6 | globlastp |
| WNU101_H48 | plantago\|11v2\|SRR066373X108968_P1 | 3559 | 6512 | 290 | 98.6 | globlastp |
| WNU101_H49 | platanus\|11v1\|SRR096786X100429_P1 | 3560 | 6509 | 290 | 98.6 | globlastp |
| WNU101_H50 | platanus\|11v1\|SRR096786X132286_P1 | 3561 | 6509 | 290 | 98.6 | globlastp |
| WNU101_H51 | poplar\|10v1\|AI162529 | 3562 | 6505 | 290 | 98.6 | globlastp |
| WNU101_H51 | poplar\|13v1\|AI162529_P1 | 3563 | 6505 | 290 | 98.6 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU101_H52 | silene\|11v1\|SRR096785X10232 | 3564 | 6515 | 290 | 98.6 | globlastp |
| WNU101_H53 | silene\|11v1\|SRR096785X137191 | 3565 | 6515 | 290 | 98.6 | globlastp |
| WNU101_H54 | soybean\|11v1\|GLYMA09G42010 | 3566 | 6505 | 290 | 98.6 | globlastp |
| WNU101_H54 | soybean\|12v1\|GLYMA09G42010_P1 | 3567 | 6505 | 290 | 98.6 | globlastp |
| WNU101_H55 | soybean\|11v1\|GLYMA19G28850 | 3568 | 6505 | 290 | 98.6 | globlastp |
| WNU101_H55 | soybean\|12v1\|GLYMA19G28850_P1 | 3569 | 6505 | 290 | 98.6 | globlastp |
| WNU101_H56 | spurge\|gb161\|BG409394 | 3570 | 6505 | 290 | 98.6 | globlastp |
| WNU101_H57 | tabernaemontana\|11v1\|SRR098689X110144 | 3571 | 6509 | 290 | 98.6 | globlastp |
| WNU101_H58 | utricularia\|11v1\|SRR094438.112676 | 3572 | 6516 | 290 | 98.6 | globlastp |
| WNU101_H302 | monkeyflower\|12v1\|DV206684_P1 | 3573 | 6517 | 290 | 97.9 | globlastp |
| WNU101_H303 | monkeyflower\|12v1\|MGJGI003701_P1 | 3574 | 6518 | 290 | 97.9 | globlastp |
| WNU101_H304 | prunus_mume\|13v1\|CB821190_P1 | 3575 | 6519 | 290 | 97.9 | globlastp |
| WNU101_H59 | ambrosia\|11v1\|SRR346935.498332_P1 | 3576 | 6520 | 290 | 97.9 | globlastp |
| WNU101_H60 | avocado\|10v1\|CO996154_P1 | 3577 | 6521 | 290 | 97.9 | globlastp |
| WNU101_H61 | blueberry\|12v1\|CV191461_P1 | 3578 | 6522 | 290 | 97.9 | globlastp |
| WNU101_H62 | blueberry\|12v1\|SRR353282X26281D1_P1 | 3579 | 6522 | 290 | 97.9 | globlastp |
| WNU101_H63 | cassava\|09v1\|CK641842_P1 | 3580 | 6521 | 290 | 97.9 | globlastp |
| WNU101_H64 | chestnut\|gb170\|SRR006295S0005679_P1 | 3581 | 6523 | 290 | 97.9 | globlastp |
| WNU101_H65 | chickpea\|11v1\|FE669803 | 3582 | 6521 | 290 | 97.9 | globlastp |
| WNU101_H65 | chickpea\|13v2\|FE669803_P1 | 3583 | 6521 | 290 | 97.9 | globlastp |
| WNU101_H66 | cichorium\|gb171\|EH696302_P1 | 3584 | 6524 | 290 | 97.9 | globlastp |
| WNU101_H67 | cleome_spinosa\|10v1\|SRR015531S0000807_P1 | 3585 | 6521 | 290 | 97.9 | globlastp |
| WNU101_H68 | cotton\|11v1\|BE055159_P1 | 3586 | 6521 | 290 | 97.9 | globlastp |
| WNU101_H69 | cotton\|11v1\|CO098243_P1 | 3587 | 6521 | 290 | 97.9 | globlastp |
| WNU101_H70 | dandelion\|10v1\|DR399422_P1 | 3588 | 6524 | 290 | 97.9 | globlastp |
| WNU101_H71 | eschscholzia\|11v1\|SRR014116.103261_P1 | 3589 | 6521 | 290 | 97.9 | globlastp |
| WNU101_H72 | euphorbia\|11v1\|SRR098678X147242_P1 | 3590 | 6525 | 290 | 97.9 | globlastp |
| WNU101_H73 | flaveria\|11v1\|SRR149229.1128_P1 | 3591 | 6524 | 290 | 97.9 | globlastp |
| WNU101_H74 | flaveria\|11v1\|SRR149232.114130_P1 | 3592 | 6524 | 290 | 97.9 | globlastp |
| WNU101_H75 | flaveria\|11v1\|SRR149232.175301_P1 | 3593 | 6524 | 290 | 97.9 | globlastp |
| WNU101_H76 | flaveria\|11v1\|SRR149232.193194_P1 | 3594 | 6524 | 290 | 97.9 | globlastp |
| WNU101_H77 | flaveria\|11v1\|SRR149238.143076_P1 | 3595 | 6524 | 290 | 97.9 | globlastp |
| WNU101_H78 | flaveria\|11v1\|SRR149244.127484_P1 | 3596 | 6524 | 290 | 97.9 | globlastp |
| WNU101_H79 | gerbera\|09v1\|AJ751817_P1 | 3597 | 6524 | 290 | 97.9 | globlastp |
| WNU101_H80 | gossypium_raimondii\|12v1\|BE055159_P1 | 3598 | 6521 | 290 | 97.9 | globlastp |
| WNU101_H81 | hevea\|10v1\|EC605962_P1 | 3599 | 6521 | 290 | 97.9 | globlastp |
| WNU101_H82 | jatropha\|09v1\|GT229106_P1 | 3600 | 6526 | 290 | 97.9 | globlastp |
| WNU101_H83 | lettuce\|12v1\|DW062812_P1 | 3601 | 6524 | 290 | 97.9 | globlastp |
| WNU101_H84 | liquorice\|gb171\|FS244248_P1 | 3602 | 6521 | 290 | 97.9 | globlastp |
| WNU101_H85 | liriodendron\|gb166\|CO995509_P1 | 3603 | 6521 | 290 | 97.9 | globlastp |
| WNU101_H86 | melon\|10v1\|DV631514_P1 | 3604 | 6521 | 290 | 97.9 | globlastp |
| WNU101_H87 | momordica\|10v1\|SRR071315S0002724_P1 | 3605 | 6521 | 290 | 97.9 | globlastp |
| WNU101_H88 | monkeyflower\|10v1\|DV206684 | 3606 | 6517 | 290 | 97.9 | globlastp |
| WNU101_H89 | oak\|10v1\|FP025535_P1 | 3607 | 6523 | 290 | 97.9 | globlastp |
| WNU101_H90 | oak\|10v1\|FP040425_P1 | 3608 | 6523 | 290 | 97.9 | globlastp |
| WNU101_H91 | papaya\|gb165\|EX260690_P1 | 3609 | 6527 | 290 | 97.9 | globlastp |
| WNU101_H92 | peanut\|10v1\|ES715587_P1 | 3610 | 6521 | 290 | 97.9 | globlastp |
| WNU101_H93 | petunia\|gb171\|DC240537_P1 | 3611 | 6528 | 290 | 97.9 | globlastp |
| WNU101_H94 | primula\|11v1\|SRR098679X118382_P1 | 3612 | 6529 | 290 | 97.9 | globlastp |
| WNU101_H95 | prunus\|10v1\|BF717180 | 3613 | 6519 | 290 | 97.9 | globlastp |
| WNU101_H96 | sarracenia\|11v1\|SRR192669.118427 | 3614 | 6530 | 290 | 97.9 | globlastp |
| WNU101_H97 | sunflower\|12v1\|CD847531 | 3615 | 6524 | 290 | 97.9 | globlastp |
| WNU101_H98 | sunflower\|12v1\|EE651498 | 3616 | 6524 | 290 | 97.9 | globlastp |
| WNU101_H99 | sunflower\|12v1\|EE657167XX1 | 3617 | 6524 | 290 | 97.9 | globlastp |
| WNU101_H100 | thellungiella_halophilum\|11v1\|BM985553 | 3618 | 6521 | 290 | 97.9 | globlastp |
| WNU101_H101 | thellungiella_halophilum\|11v1\|DN778887 | 3619 | 6521 | 290 | 97.9 | globlastp |
| WNU101_H102 | tragopogon\|10v1\|SRR020205S0042330 | 3620 | 6524 | 290 | 97.9 | globlastp |
| WNU101_H103 | valeriana\|11v1\|SRR099039X102759 | 3621 | 6531 | 290 | 97.9 | globlastp |
| WNU101_H104 | watermelon\|11v1\|AM715146 | 3622 | 6521 | 290 | 97.9 | globlastp |
| WNU101_H305 | nicotiana_benthamiana\|12v1\|CN741539_P1 | 3623 | 6532 | 290 | 97.2 | globlastp |
| WNU101_H306 | olea\|13v1\|SRR014466X64437D1_P1 | 3624 | 6533 | 290 | 97.2 | globlastp |
| WNU101_H105 | aquilegia\|10v2\|JGIAC002127_P1 | 3625 | 6534 | 290 | 97.2 | globlastp |
| WNU101_H106 | arabidopsis_lyrata\|09v1\|JGIAL020514_P1 | 3626 | 6535 | 290 | 97.2 | globlastp |
| WNU101_H107 | arabidopsis\|10v1\|AT5G08290_P1 | 3627 | 6536 | 290 | 97.2 | globlastp |
| WNU101_H108 | banana\|12v1\|BBS821T3_P1 | 3628 | 6537 | 290 | 97.2 | globlastp |
| WNU101_H109 | brachypodium\|12v1\|BRADI2G20230_P1 | 3629 | 6538 | 290 | 97.2 | globlastp |
| WNU101_H110 | cassava\|09v1\|DV442374_P1 | 3630 | 6539 | 290 | 97.2 | globlastp |
| WNU101_H111 | chelidonium\|11v1\|SRR084752X111705_P1 | 3631 | 6540 | 290 | 97.2 | globlastp |
| WNU101_H112 | clementine\|11v1\|CB293969_P1 | 3632 | 6541 | 290 | 97.2 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU101_H113 | cleome_gynandra\|10v1\|SRR015532S0011342_P1 | 3633 | 6542 | 290 | 97.2 | globlastp |
| WNU101_H114 | cleome_spinosa\|10v1\|GR931475_P1 | 3634 | 6543 | 290 | 97.2 | globlastp |
| WNU101_H115 | cucumber\|09v1\|DV631514_P1 | 3635 | 6544 | 290 | 97.2 | globlastp |
| WNU101_H116 | flaveria\|11v1\|SRR149229.15567_P1 | 3636 | 6545 | 290 | 97.2 | globlastp |
| WNU101_H117 | flaveria\|11v1\|SRR149232.130294_P1 | 3637 | 6546 | 290 | 97.2 | globlastp |
| WNU101_H118 | gerbera\|09v1\|AJ751066_P1 | 3638 | 6547 | 290 | 97.2 | globlastp |
| WNU101_H119 | leymus\|gb166\|EG375649_P1 | 3639 | 6548 | 290 | 97.2 | globlastp |
| WNU101_H120 | lotus\|09v1\|LLBW596117_P1 | 3640 | 6549 | 290 | 97.2 | globlastp |
| WNU101_H121 | monkeyflower\|10v1\|GO986033 | 3641 | 6550 | 290 | 97.2 | glotblastn |
| WNU101_H122 | nicotiana_benthamiana\|gb162\|CN741539 | 3642 | 6532 | 290 | 97.2 | globlastp |
| WNU101_H123 | nuphar\|gb166\|CD474407_P1 | 3643 | 6551 | 290 | 97.2 | globlastp |
| WNU101_H124 | oat\|11v1\|GR356084_P1 | 3644 | 6538 | 290 | 97.2 | globlastp |
| WNU101_H125 | olea\|11v1\|SRR014463.12122 | 3645 | 6533 | 290 | 97.2 | globlastp |
| WNU101_H125 | olea\|13v1\|SRR014463X12122D1_P1 | 3646 | 6533 | 290 | 97.2 | globlastp |
| WNU101_H126 | olea\|11v1\|SRR014463.6941 | 3647 | 6533 | 290 | 97.2 | globlastp |
| WNU101_H127 | orange\|11v1\|CB293969_P1 | 3648 | 6541 | 290 | 97.2 | globlastp |
| WNU101_H128 | orobanche\|10v1\|SRR023189S0011862_P1 | 3649 | 6552 | 290 | 97.2 | globlastp |
| WNU101_H129 | petunia\|gb171\|DY395476_P1 | 3650 | 6532 | 290 | 97.2 | globlastp |
| WNU101_H130 | poppy\|11v1\|FE965510_P1 | 3651 | 6535 | 290 | 97.2 | globlastp |
| WNU101_H131 | poppy\|11v1\|FE968162_P1 | 3652 | 6535 | 290 | 97.2 | globlastp |
| WNU101_H132 | poppy\|11v1\|SRR030259.140845_P1 | 3653 | 6535 | 290 | 97.2 | globlastp |
| WNU101_H133 | poppy\|11v1\|SRR096789.129001_P1 | 3654 | 6535 | 290 | 97.2 | globlastp |
| WNU101_H134 | potato\|10v1\|BG598825_P1 | 3655 | 6532 | 290 | 97.2 | globlastp |
| WNU101_H135 | rose\|12v1\|BQ104850 | 3656 | 6553 | 290 | 97.2 | globlastp |
| WNU101_H136 | rye\|12v1\|DRR001012.152837 | 3657 | 6548 | 290 | 97.2 | globlastp |
| WNU101_H137 | scabiosa\|11v1\|SRR063723X100235 | 3658 | 6554 | 290 | 97.2 | globlastp |
| WNU101_H138 | solanum_phureja\|09v1\|SPHBG133499 | 3659 | 6532 | 290 | 97.2 | globlastp |
| WNU101_H139 | strawberry\|11v1\|CO381722 | 3660 | 6553 | 290 | 97.2 | globlastp |
| WNU101_H140 | sunflower\|12v1\|BU672024 | 3661 | 6555 | 290 | 97.2 | globlastp |
| WNU101_H141 | sunflower\|12v1\|CF085521 | 3662 | 6556 | 290 | 97.2 | globlastp |
| WNU101_H142 | switchgrass\|gb167\|FE640147 | 3663 | 6557 | 290 | 97.2 | globlastp |
| WNU101_H143 | tea\|10v1\|DY523280 | 3664 | 6558 | 290 | 97.2 | globlastp |
| WNU101_H144 | tobacco\|gb162\|CV020574 | 3665 | 6532 | 290 | 97.2 | globlastp |
| WNU101_H145 | tobacco\|gb162\|DW004387 | 3666 | 6559 | 290 | 97.2 | globlastp |
| WNU101_H146 | tomato\|11v1\|BG133499 | 3667 | 6532 | 290 | 97.2 | globlastp |
| WNU101_H147 | watermelon\|11v1\|VMEL06624730052175 | 3668 | 6544 | 290 | 97.2 | globlastp |
| WNU101_H148 | wheat\|12v3\|BE516783 | 3669 | 6548 | 290 | 97.2 | globlastp |
| WNU101_H149 | amorphophallus\|11v2\|SRR089351X183516_T1 | 3670 | 6560 | 290 | 97.18 | glotblastn |
| WNU101_H150 | flaveria\|11v1\|SRR149229.223003_T1 | 3671 | 6561 | 290 | 97.18 | glotblastn |
| WNU101_H151 | flaveria\|11v1\|SRR149229.348878XX1_T1 | 3672 | 6562 | 290 | 97.18 | glotblastn |
| WNU101_H152 | abies\|11v2\|SRR098676X118115_P1 | 3673 | 6563 | 290 | 96.5 | globlastp |
| WNU101_H153 | ambrosia\|11v1\|SRR346943.100935_P1 | 3674 | 6564 | 290 | 96.5 | globlastp |
| WNU101_H154 | antirrhinum\|gb166\|AJ806089_P1 | 3675 | 6565 | 290 | 96.5 | globlastp |
| WNU101_H155 | b_Juncea\|12v1\|E6ANDIZ01B6RJK_P1 | 3676 | 6566 | 290 | 96.5 | globlastp |
| WNU101_H156 | b_Juncea\|12v1\|E6ANDIZ01BM0LN_P1 | 3677 | 6566 | 290 | 96.5 | globlastp |
| WNU101_H157 | b_oleracea\|gb161\|DY023458_P1 | 3678 | 6566 | 290 | 96.5 | globlastp |
| WNU101_H158 | b_rapa\|11v1\|CD830767_P1 | 3679 | 6566 | 290 | 96.5 | globlastp |
| WNU101_H159 | barley\|12v1\|BE422314_P1 | 3680 | 6567 | 290 | 96.5 | globlastp |
| WNU101_H160 | beech\|11v1\|SRR006293.28635_P1 | 3681 | 6568 | 290 | 96.5 | globlastp |
| WNU101_H161 | bupleurum\|11v1\|SRR301254.104295_P1 | 3682 | 6569 | 290 | 96.5 | globlastp |
| WNU101_H162 | canola\|11v1\|CN730207_P1 | 3683 | 6566 | 290 | 96.5 | globlastp |
| WNU101_H163 | centaurea\|11v1\|EH752544_P1 | 3684 | 6570 | 290 | 96.5 | globlastp |
| WNU101_H164 | cirsium\|11v1\|SRR346952.1007521_P1 | 3685 | 6570 | 290 | 96.5 | globlastp |
| WNU101_H165 | cirsium\|11v1\|SRR346952.103291_P1 | 3686 | 6570 | 290 | 96.5 | globlastp |
| WNU101_H166 | cirsium\|11v1\|SRR349641.102618_P1 | 3687 | 6570 | 290 | 96.5 | globlastp |
| WNU101_H167 | coffea\|10v1\|DV664615_P1 | 3688 | 6571 | 290 | 96.5 | globlastp |
| WNU101_H168 | cucurbita\|11v1\|SRR091276X10160_P1 | 3689 | 6572 | 290 | 96.5 | globlastp |
| WNU101_H169 | distylium\|11v1\|SRR065077X11672_P1 | 3690 | 6573 | 290 | 96.5 | globlastp |
| WNU101_H170 | fescue\|gb161\|DT678464_P1 | 3691 | 6567 | 290 | 96.5 | globlastp |
| WNU101_H171 | flax\|11v1\|EU830158_P1 | 3692 | 6574 | 290 | 96.5 | globlastp |
| WNU101_H172 | flax\|11v1\|GW864378_P1 | 3693 | 6574 | 290 | 96.5 | globlastp |
| WNU101_H173 | fraxinus\|11v1\|SRR058827.118876_P1 | 3694 | 6575 | 290 | 96.5 | globlastp |
| WNU101_H174 | ginger\|gb164\|DY345152_P1 | 3695 | 6563 | 290 | 96.5 | globlastp |
| WNU101_H175 | gossypium_raimondii\|12v1\|SRR032877.152174_P1 | 3696 | 6576 | 290 | 96.5 | globlastp |
| WNU101_H176 | lotus\|09v1\|BI417743_P1 | 3697 | 6577 | 290 | 96.5 | globlastp |
| WNU101_H177 | medicago\|12v1\|AJ388790_P1 | 3698 | 6563 | 290 | 96.5 | globlastp |
| WNU101_H178 | oat\|11v1\|CN819608_P1 | 3699 | 6567 | 290 | 96.5 | globlastp |
| WNU101_H179 | oat\|11v1\|GO592755_P1 | 3700 | 6567 | 290 | 96.5 | globlastp |
| WNU101_H180 | onion\|12v1\|SRR073446X1027D1_P1 | 3701 | 6578 | 290 | 96.5 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU101_H181 | onion\|12v1\|SRR073446X107895D1_P1 | 3702 | 6578 | 290 | 96.5 | globlastp |
| WNU101_H182 | *phalaenopsis*\|11v1\|CB033892_P1 | 3703 | 6579 | 290 | 96.5 | globlastp |
| WNU101_H183 | phylap\|11v2\|SRR099037X110675_P1 | 3704 | 6580 | 290 | 96.5 | globlastp |
| WNU101_H184 | pine\|10v2\|AW226051_P1 | 3705 | 6563 | 290 | 96.5 | globlastp |
| WNU101_H185 | pine\|10v2\|BM157567_P1 | 3706 | 6563 | 290 | 96.5 | globlastp |
| WNU101_H186 | *pseudoroegneria*\|gb167\|FF344285 | 3707 | 6567 | 290 | 96.5 | globlastp |
| WNU101_H187 | *pseudoroegneria*\|gb167\|FF360594 | 3708 | 6581 | 290 | 96.5 | globlastp |
| WNU101_H188 | *pseudotsuga*\|10v1\|SRR065119S0012174 | 3709 | 6563 | 290 | 96.5 | globlastp |
| WNU101_H189 | radish\|gb164\|EV526928 | 3710 | 6566 | 290 | 96.5 | globlastp |
| WNU101_H190 | radish\|gb164\|EV536846 | 3711 | 6566 | 290 | 96.5 | globlastp |
| WNU101_H191 | radish\|gb164\|EV546061 | 3712 | 6566 | 290 | 96.5 | globlastp |
| WNU101_H192 | radish\|gb164\|EV552595 | 3713 | 6566 | 290 | 96.5 | globlastp |
| WNU101_H193 | radish\|gb164\|EW715626 | 3714 | 6566 | 290 | 96.5 | globlastp |
| WNU101_H194 | radish\|gb164\|EW718137 | 3715 | 6566 | 290 | 96.5 | globlastp |
| WNU101_H195 | radish\|gb164\|EX754496 | 3716 | 6566 | 290 | 96.5 | globlastp |
| WNU101_H196 | radish\|gb164\|FD967082 | 3717 | 6566 | 290 | 96.5 | globlastp |
| WNU101_H197 | rye\|12v1\|DRR001012.107996 | 3718 | 6567 | 290 | 96.5 | globlastp |
| WNU101_H198 | rye\|12v1\|DRR001012.271505 | 3719 | 6567 | 290 | 96.5 | globlastp |
| WNU101_H199 | rye\|12v1\|DRR001012.273776 | 3720 | 6567 | 290 | 96.5 | globlastp |
| WNU101_H200 | rye\|12v1\|DRR001012.316946 | 3721 | 6567 | 290 | 96.5 | globlastp |
| WNU101_H201 | *salvia*\|10v1\|CV170127 | 3722 | 6580 | 290 | 96.5 | globlastp |
| WNU101_H202 | *sciadopitys*\|10v1\|SRR065035S0010777 | 3723 | 6573 | 290 | 96.5 | globlastp |
| WNU101_H203 | solanum_phureja\|09v1\|SPHBG129871 | 3724 | 6582 | 290 | 96.5 | globlastp |
| WNU101_H204 | spruce\|11v1\|ES248362 | 3725 | 6563 | 290 | 96.5 | globlastp |
| WNU101_H205 | strawberry\|11v1\|CX661524 | 3726 | 6583 | 290 | 96.5 | globlastp |
| WNU101_H206 | *thalictrum*\|11v1\|SRR096787X139137 | 3727 | 6584 | 290 | 96.5 | globlastp |
| WNU101_H207 | thellungiella_parvulum\|11v1\|BM985553 | 3728 | 6585 | 290 | 96.5 | globlastp |
| WNU101_H208 | tomato\|11v1\|BG129871 | 3729 | 6586 | 290 | 96.5 | globlastp |
| WNU101_H209 | *trigonella*\|11v1\|SRR066194X128110 | 3730 | 6563 | 290 | 96.5 | globlastp |
| WNU101_H210 | *tripterygium*\|11v1\|SRR098677X100265 | 3731 | 6563 | 290 | 96.5 | globlastp |
| WNU101_H211 | *vinca*\|11v1\|SRR098690X110755 | 3732 | 6587 | 290 | 96.5 | globlastp |
| WNU101_H212 | wheat\|12v3\|BE399722 | 3733 | 6567 | 290 | 96.5 | globlastp |
| WNU101_H213 | *zostera*\|10v1\|AM771035 | 3734 | 6588 | 290 | 96.5 | globlastp |
| WNU101_H214 | *bupleurum*\|11v1\|SRR301254.104964_T1 | 3735 | 6589 | 290 | 96.48 | glotblastn |
| WNU101_H215 | *cedrus*\|11v1\|SRR065007X138898_T1 | 3736 | 6590 | 290 | 96.48 | glotblastn |
| WNU101_H216 | cotton\|11v1\|SRR032799.218046_T1 | 3737 | 6591 | 290 | 96.48 | glotblastn |
| WNU101_H217 | *fraxinus*\|11v1\|SRR058827.139368_T1 | 3738 | 6592 | 290 | 96.48 | glotblastn |
| WNU101_H218 | poppy\|11v1\|SRR030259.109854_T1 | 3739 | 6593 | 290 | 96.48 | glotblastn |
| WNU101_H219 | b_Juncea\|12v1\|E6ANDIZ01A7FXP_P1 | 3740 | 6594 | 290 | 95.8 | globlastp |
| WNU101_H220 | *cenchrus*\|gb166\|EB654842_P1 | 3741 | 6595 | 290 | 95.8 | globlastp |
| WNU101_H221 | *cephalotaxus*\|11v1\|SRR064395X104976_P1 | 3742 | 6596 | 290 | 95.8 | globlastp |
| WNU101_H222 | *cryptomeria*\|gb166\|BP173808_P1 | 3743 | 6597 | 290 | 95.8 | globlastp |
| WNU101_H223 | *euonymus*\|11v1\|SRR070038X107379_P1 | 3744 | 6598 | 290 | 95.8 | globlastp |
| WNU101_H224 | *euonymus*\|11v1\|SRR070038X122208_P1 | 3745 | 6598 | 290 | 95.8 | globlastp |
| WNU101_H225 | *euonymus*\|11v1\|SRR070038X167324_P1 | 3746 | 6598 | 290 | 95.8 | globlastp |
| WNU101_H226 | *euonymus*\|11v1\|SRR070038X303898_P1 | 3747 | 6598 | 290 | 95.8 | globlastp |
| WNU101_H227 | *guizotia*\|10v1\|GE561377_P1 | 3748 | 6599 | 290 | 95.8 | globlastp |
| WNU101_H228 | *medicago*\|12v1\|AL379466_P1 | 3749 | 6600 | 290 | 95.8 | globlastp |
| WNU101_H229 | pepper\|12v1\|GD060357_P1 | 3750 | 6601 | 290 | 95.8 | globlastp |
| WNU101_H230 | *sequoia*\|10v1\|SRR065044S0003965 | 3751 | 6597 | 290 | 95.8 | globlastp |
| WNU101_H231 | *trigonella*\|11v1\|SRR066194X132286 | 3752 | 6600 | 290 | 95.8 | globlastp |
| WNU101_H232 | *triphysaria*\|10v1\|DR174156 | 3753 | 6602 | 290 | 95.8 | globlastp |
| WNU101_H233 | *triphysaria*\|10v1\|DR174471 | 3754 | 6602 | 290 | 95.8 | globlastp |
| WNU101_H234 | *ambrosia*\|11v1\|SRR346935.266437_T1 | 3755 | 6603 | 290 | 95.77 | glotblastn |
| WNU101_H235 | *fraxinus*\|11v1\|SRR058827.101637_T1 | 3756 | 6604 | 290 | 95.77 | glotblastn |
| WNU101_H307 | bean\|12v2\|CA911930_T1 | 3757 | 6605 | 290 | 95.1 | glotblastn |
| WNU101_H236 | b_oleracea\|gb161\|DY019123_P1 | 3758 | 6606 | 290 | 95.1 | globlastp |
| WNU101_H238 | *guizotia*\|10v1\|GE555178_P1 | 3759 | 6607 | 290 | 95.1 | globlastp |
| WNU101_H239 | *nasturtium*\|11v1\|GH170206_P1 | 3760 | 6608 | 290 | 95.1 | globlastp |
| WNU101_H240 | *nasturtium*\|11v1\|SRR032558.142872_P1 | 3761 | 6608 | 290 | 95.1 | globlastp |
| WNU101_H241 | pigeonpea\|11v1\|SRR054580X166585_P1 | 3762 | 6609 | 290 | 95.1 | globlastp |
| WNU101_H242 | *podocarpus*\|10v1\|SRR065014S0029356_P1 | 3763 | 6610 | 290 | 95.1 | globlastp |
| WNU101_H243 | *taxus*\|10v1\|SRR032523S0009023 | 3764 | 6611 | 290 | 95.1 | globlastp |
| WNU101_H244 | *vinca*\|11v1\|SRR098690X103143 | 3765 | 6612 | 290 | 95.1 | globlastp |
| WNU101_H245 | *gnetum*\|10v1\|SRR064399S0043656_T1 | 3766 | 6613 | 290 | 95.07 | glotblastn |
| WNU101_H246 | onion\|12v1\|SRR073446X168589D1_T1 | 3767 | 6614 | 290 | 95.07 | glotblastn |
| WNU101_H247 | *aquilegia*\|10v2\|JGIAC002827_P1 | 3768 | 6615 | 290 | 94.4 | globlastp |
| WNU101_H248 | *arnica*\|11v1\|SRR099034X106017_P1 | 3769 | 6616 | 290 | 94.4 | globlastp |
| WNU101_H249 | *ceratodon*\|10v1\|SRR074890S0096822_P1 | 3770 | 6617 | 290 | 94.4 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU101_H250 | cotton\|11v1\|SRR032368.104563_P1 | 3771 | 6618 | 290 | 94.4 | globlastp |
| WNU101_H251 | *physcomitrella*\|10v1\|BJ157579_P1 | 3772 | 6617 | 290 | 94.4 | globlastp |
| WNU101_H252 | *pteridium*\|11v1\|SRR043594X101280 | 3773 | 6619 | 290 | 94.4 | globlastp |
| WNU101_H253 | *pteridium*\|11v1\|SRR043594X144633 | 3774 | 6620 | 290 | 94.4 | globlastp |
| WNU101_H254 | *artemisia*\|10v1\|EY036412_T1 | 3775 | 6621 | 290 | 94.37 | glotblastn |
| WNU101_H308 | *zostera*\|12v1\|SRR057351X120093D1_P1 | 3776 | 6622 | 290 | 93.7 | globlastp |
| WNU101_H255 | *marchantia*\|gb166\|BJ841020_P1 | 3777 | 6623 | 290 | 93.7 | globlastp |
| WNU101_H256 | *medicago*\|12v1\|XM_003607213_P1 | 3778 | 6624 | 290 | 93.7 | globlastp |
| WNU101_H257 | *brachypodium*\|12v1\|BRADI5G26987_P1 | 3779 | 6625 | 290 | 92.3 | globlastp |
| WNU101_H258 | *epimedium*\|11v1\|SRR013502.28172_P1 | 3780 | 6626 | 290 | 92.3 | globlastp |
| WNU101_H309 | *zostera*\|12v1\|SRR057351X155005D1_P1 | 3781 | 6627 | 290 | 91.5 | globlastp |
| WNU101_H259 | *brachypodium*\|12v1\|BRADI2G61080_P1 | 3782 | 6628 | 290 | 91.5 | globlastp |
| WNU101_H260 | *senecio*\|gb170\|DY661572 | 3783 | 6629 | 290 | 91.1 | globlastp |
| WNU101_H261 | maritime_pine\|10v1\|AL751085_P1 | 3784 | 6630 | 290 | 91 | globlastp |
| WNU101_H262 | *brachypodium*\|12v1\|BRADI5G26970_P1 | 3785 | 6631 | 290 | 90.8 | globlastp |
| WNU101_H263 | b_rapa\|11v1\|CD817247_T1 | 3786 | 6632 | 290 | 90.14 | glotblastn |
| WNU101_H264 | *brachypodium*\|12v1\|BRADI2G62110_P1 | 3787 | 6633 | 290 | 90.1 | globlastp |
| WNU101_H265 | safflower\|gb162\|EL390885 | 3788 | 6634 | 290 | 89.7 | globlastp |
| WNU101_H266 | peanut\|10v1\|GO334384_T1 | 3789 | 6635 | 290 | 88.82 | glotblastn |
| WNU101_H310 | *volvox*\|12v1\|FD808894_P1 | 3790 | 6636 | 290 | 88 | globlastp |
| WNU101_H267 | *cirsium*\|11v1\|SRR346952.614503_P1 | 3791 | 6637 | 290 | 88 | globlastp |
| WNU101_H268 | *mesostigma*\|gb166\|DN254740_P1 | 3792 | 6638 | 290 | 88 | globlastp |
| WNU101_H269 | *volvox*\|gb162\|CBGZ13922FWD | 3793 | 6636 | 290 | 88 | globlastp |
| WNU101_H270 | *cirsium*\|11v1\|SRR349641.1172450_P1 | 3794 | 6639 | 290 | 87.8 | globlastp |
| WNU101_H271 | *medicago*\|12v1\|MTPRD023853_T1 | 3795 | 6640 | 290 | 87.42 | glotblastn |
| WNU101_H311 | soybean\|12v1\|GLYMA11G10560_P1 | 3796 | 6641 | 290 | 87.3 | globlastp |
| WNU101_H272 | spikemoss\|gb165\|FE439447 | 3797 | 6642 | 290 | 87.3 | globlastp |
| WNU101_H273 | pepper\|12v1\|SRR203275X23113D1_P1 | 3798 | 6643 | 290 | 86.7 | globlastp |
| WNU101_H274 | *cannabis*\|12v1\|SOLX00030512_T1 | 3799 | 6644 | 290 | 86.62 | glotblastn |
| WNU101_H275 | clover\|gb162\|BB917276_P1 | 3800 | 6645 | 290 | 86.6 | globlastp |
| WNU101_H276 | oat\|11v1\|CN820466_P1 | 3801 | 6646 | 290 | 85.9 | globlastp |
| WNU101_H277 | *aquilegia*\|10v2\|JGIAC008410_P1 | 3802 | 6647 | 290 | 85.2 | globlastp |
| WNU101_H278 | *chlamydomonas*\|gb162\|AV623913_P1 | 3803 | 6648 | 290 | 85.2 | globlastp |
| WNU101_H279 | maritime_pine\|10v1\|SRR073317S0022071_P1 | 3804 | 6649 | 290 | 84 | globlastp |
| WNU101_H280 | poppy\|11v1\|SRR096789.155178_P1 | 3805 | 6650 | 290 | 83.8 | globlastp |
| WNU101_H281 | spruce\|11v1\|SRR066110X1234 | 3806 | 6651 | 290 | 83.8 | globlastp |
| WNU101_H282 | *silene*\|11v1\|SRR096785X28894 | 3807 | 6652 | 290 | 83.1 | globlastp |
| WNU101_H283 | *ostreococcus*\|gb162\|XM001420623_P1 | 3808 | 6653 | 290 | 82.4 | globlastp |
| WNU101_H284 | *scabiosa*\|11v1\|SRR063723X106819 | 3809 | 6654 | 290 | 82.4 | globlastp |
| WNU101_H285 | spruce\|11v1\|SRR066110X156724 | 3810 | 6655 | 290 | 82.4 | globlastp |
| WNU101_H286 | fern\|gb171\|DK949164_T1 | 3811 | 6656 | 290 | 82.39 | glotblastn |
| WNU101_H287 | *rhizophora*\|10v1\|SRR005793S0032422 | 3812 | 6657 | 290 | 82.3 | globlastp |
| WNU101_H288 | cucumber\|09v1\|AM715146_P1 | 3813 | 6658 | 290 | 82.2 | globlastp |
| WNU101_H289 | cassava\|09v1\|DB928964_T1 | 3814 | 6659 | 290 | 81.55 | glotblastn |
| WNU101_H290 | *tamarix*\|gb166\|EH053611 | 3815 | 6660 | 290 | 81 | globlastp |
| WNU101_H291 | ginseng\|10v1\|GR874635_P1 | 3816 | 6661 | 290 | 80.3 | globlastp |
| WNU101_H292 | *conyza*\|10v1\|SRR035294S0005061_T1 | 3817 | 6662 | 290 | 80.28 | glotblastn |
| WNU102_H1 | *pseudoroegneria*\|gb167\|FF359580 | 3818 | 6663 | 291 | 95.8 | globlastp |
| WNU102_H2 | rye\|12v1\|BE705366 | 3819 | 6664 | 291 | 94.1 | globlastp |
| WNU102_H3 | rye\|12v1\|DRR001012.104065 | 3820 | 6665 | 291 | 93.3 | globlastp |
| WNU102_H4 | rye\|12v1\|DRR001012.20624 | 3821 | 6666 | 291 | 93.3 | globlastp |
| WNU102_H5 | rye\|12v1\|DRR001012.544828 | 3822 | 6665 | 291 | 93.3 | globlastp |
| WNU103_H1 | wheat\|12v3\|BQ236960 | 3823 | 6667 | 292 | 96.6 | glotblastn |
| WNU103_H2 | rye\|12v1\|DRR001012.118432 | 3824 | 6668 | 292 | 95.99 | glotblastn |
| WNU103_H3 | barley\|12v1\|AV932859_T1 | 3825 | 6669 | 292 | 95.83 | glotblastn |
| WNU103_H4 | wheat\|12v1\|BJ270163 | 3826 | 6670 | 292 | 95.52 | glotblastn |
| WNU103_H5 | wheat\|12v3\|BQ161926 | 3827 | 6671 | 292 | 95.52 | glotblastn |
| WNU103_H6 | wheat\|12v3\|BM137647 | 3828 | 6672 | 292 | 92.1 | globlastp |
| WNU103_H7 | *brachypodium*\|12v1\|BRADI1G16770_T1 | 3829 | 6673 | 292 | 89.37 | glotblastn |
| WNU103_H8 | oat\|11v1\|GO591581_P1 | 3830 | 6674 | 292 | 87.4 | globlastp |
| WNU103_H9 | wheat\|12v3\|BE497973 | 3831 | 6675 | 292 | 86.6 | globlastp |
| WNU103_H10 | foxtail_millet\|11v3\|PHY7SI028842M_T1 | 3832 | 6676 | 292 | 85.36 | glotblastn |
| WNU103_H12 | millet\|10v1\|EVO454PM008851_T1 | 3833 | 6677 | 292 | 84.9 | glotblastn |
| WNU103_H13 | *sorghum*\|12v1\|SB02G002970 | 3834 | 6678 | 292 | 84.28 | glotblastn |
| WNU103_H14 | maize\|10v1\|AI891217_T1 | 3835 | 6679 | 292 | 83.51 | glotblastn |
| WNU104_H1 | *sorghum*\|12v1\|SB02G039640 | 3836 | 6680 | 293 | 97.6 | globlastp |
| WNU104_H2 | sugarcane\|10v1\|CA091213 | 3837 | 6681 | 293 | 96.5 | globlastp |
| WNU104_H3 | switchgrass\|gb167\|DN141143 | 3838 | 6682 | 293 | 95 | globlastp |
| WNU104_H4 | foxtail_millet\|11v3\|PHY7SI030417M_P1 | 3839 | 6683 | 293 | 94.7 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU104_H5 | millet\|10v1\|EVO454PM007449_P1 | 3840 | 6684 | 293 | 94.1 | globlastp |
| WNU104_H6 | switchgrass\|gb167\|FE635872 | 3841 | 6685 | 293 | 93.8 | globlastp |
| WNU104_H30 | switchgrass\|12v1\|DN141143_P1 | 3842 | 6686 | 293 | 93.5 | globlastp |
| WNU104_H8 | brachypodium\|12v1\|BRADI1G21310_P1 | 3843 | 6687 | 293 | 90.3 | globlastp |
| WNU104_H11 | wheat\|12v3\|AL829503 | 3844 | 6688 | 293 | 89.7 | globlastp |
| WNU104_H12 | wheat\|12v3\|BE499735 | 3845 | 6689 | 293 | 89.7 | globlastp |
| WNU104_H13 | oat\|11v1\|GR315509_T1 | 3846 | 6690 | 293 | 88.86 | glotblastn |
| WNU104_H14 | sugarcane\|10v1\|CA110280 | 3847 | 6691 | 293 | 87.4 | globlastp |
| WNU104_H17 | millet\|10v1\|EVO454PM003756_P1 | 3848 | 6692 | 293 | 86 | globlastp |
| WNU104_H18 | foxtail_millet\|11v3\|PHY7SI036041M_P1 | 3849 | 6693 | 293 | 85.8 | globlastp |
| WNU104_H31 | switchgrass\|12v1\|FL792794_P1 | 3850 | 6694 | 293 | 85.7 | globlastp |
| WNU104_H19 | switchgrass\|gb167\|FL763438 | 3851 | 6695 | 293 | 85.4 | globlastp |
| WNU104_H20 | brachypodium\|12v1\|BRADI1G60720_P1 | 3852 | 6696 | 293 | 85.1 | globlastp |
| WNU104_H21 | wheat\|12v3\|M94726 | 3853 | 6697 | 293 | 85.1 | globlastp |
| WNU104_H22 | oat\|11v1\|GO591794_P1 | 3854 | 6698 | 293 | 84.5 | globlastp |
| WNU104_H23 | rye\|12v1\|DRR001012.130878 | 3855 | 6699 | 293 | 84.5 | globlastp |
| WNU104_H24 | oil_palm\|11v1\|EL930266_P1 | 3856 | 6700 | 293 | 83 | globlastp |
| WNU104_H25 | amorphophallus\|11v2\|SRR089351X142963_P1 | 3857 | 6701 | 293 | 82.5 | globlastp |
| WNU104_H26 | grape\|11v1\|GSVIVT01009074001_P1 | 3858 | 6702 | 293 | 80.7 | globlastp |
| WNU104_H27 | poplar\|10v1\|DT524995 | 3859 | 6703 | 293 | 80.6 | globlastp |
| WNU104_H27 | poplar\|13v1\|DT524995_P1 | 3860 | 6703 | 293 | 80.6 | globlastp |
| WNU104_H28 | orange\|11v1\|CX076591_P1 | 3861 | 6704 | 293 | 80.1 | globlastp |
| WNU104_H29 | strawberry\|11v1\|DV440652 | 3862 | 6705 | 293 | 80 | globlastp |
| WNU105_H1 | foxtail_millet\|11v3\|PHY7SI030718M_P1 | 3863 | 6706 | 294 | 81.9 | globlastp |
| WNU105_H2 | switchgrass\|12v1\|FL765830_P1 | 3864 | 6707 | 294 | 81.8 | globlastp |
| WNU105_H3 | switchgrass\|12v1\|SRR187766.292736_T1 | 3865 | 6708 | 294 | 80.82 | glotblastn |
| WNU1_H1 | switchgrass\|gb167\|FL978666 | 3866 | 6709 | 297 | 92.67 | glotblastn |
| WNU1_H2 | sugarcane\|10v1\|CA074048 | 3867 | 6710 | 297 | 89.66 | glotblastn |
| WNU1_H3 | maize\|10v1\|CF029169_T1 | 3868 | 6711 | 297 | 88.79 | glotblastn |
| WNU1_H4 | rice\|11v1\|BI809550 | 3869 | 6712 | 297 | 85.34 | glotblastn |
| WNU1_H9 | switchgrass\|12v1\|FE613340_P1 | 3870 | 6713 | 297 | 82.9 | globlastp |
| WNU1_H8 | pseudoroegneria\|gb167\|FF342031 | 3871 | 6714 | 297 | 80.17 | glotblastn |
| WNU10_H1 | rye\|12v1\|DRR001012.118659 | 3872 | 6715 | 298 | 94.7 | globlastp |
| WNU10_H4 | wheat\|12v3\|CA595300 | 3873 | 6716 | 298 | 88.3 | globlastp |
| WNU10_H9 | maize\|10v1\|AI666068_T1 | 3874 | 6717 | 298 | 83.69 | glotblastn |
| WNU10_H10 | maize\|10v1\|CF057796_T1 | 3875 | 6718 | 298 | 83.1 | glotblastn |
| WNU10_H12 | rye\|12v1\|DRR001012.335122 | 3876 | 6719 | 298 | 81.93 | glotblastn |
| WNU10_H13 | barley\|12v1\|AJ464019_T1 | 3877 | 6720 | 298 | 80.94 | glotblastn |
| WNU12_H10 | switchgrass\|gb167\|FL691189 | 3878 | 6721 | 299 | 89.15 | glotblastn |
| WNU12_H11 | maize\|10v1\|AW056009_T1 | 3879 | 6722 | 299 | 88.89 | glotblastn |
| WNU12_H12 | oil_palm\|11v1\|EL687121_T1 | 3880 | 6723 | 299 | 81.65 | glotblastn |
| WNU12_H13 | oil_palm\|11v1\|ES273973_T1 | 3881 | 6724 | 299 | 80.41 | glotblastn |
| WNU12_H14 | banana\|12v1\|MAGEN2012018857_T1 | 3882 | 6725 | 299 | 80.1 | glotblastn |
| WNU12_H15 | phalaenopsis\|11v1\|SRR125771.10131_T1 | 3883 | 6726 | 299 | 80.1 | glotblastn |
| WNU36_H6 | rye\|12v1\|BE495705 | 3884 | 6727 | 301 | 89.5 | globlastp |
| WNU36_H7 | oat\|11v1\|CN816059_T1 | 3885 | 6728 | 301 | 81.71 | glotblastn |
| WNU41_H1 | pseudoroegneria\|gb167\|FF353522 | 3886 | 6729 | 302 | 86.3 | globlastp |
| WNU90_H1 | maize\|10v1\|AI621741_P1 | 3887 | 6730 | 304 | 86 | globlastp |
| WNU90_H3 | switchgrass\|12v1\|FL814028_P1 | 3888 | 6731 | 304 | 84.3 | globlastp |
| WNU90_H2 | foxtail_millet\|11v3\|PHY7SI000622M_P1 | 3889 | 6732 | 304 | 83.1 | globlastp |
| WNU12_H3 | wheat\|12v3\|CA639029 | 3890 | 6733 | 305 | 96 | globlastp |
| WNU12_H2 | wheat\|12v3\|BE412252 | 3891 | 6734 | 305 | 94.3 | globlastp |
| WNU12_H1 | rye\|12v1\|DRR001012.123825 | 3892 | 6735 | 305 | 93.6 | globlastp |
| WNU12_H4 | oat\|11v1\|GR341130_P1 | 3893 | 6736 | 305 | 92.1 | globlastp |
| WNU12_H6 | rice\|11v1\|AU033135 | 3894 | 6737 | 305 | 87.3 | globlastp |
| WNU12_H5 | sorghum\|12v1\|SB06G014710 | 3895 | 6738 | 305 | 86.3 | globlastp |
| WNU12_H16 | switchgrass\|12v1\|FL696652_P1 | 3896 | 6739 | 305 | 86 | globlastp |
| WNU12_H9 | millet\|10v1\|EVO454PM052099_P1 | 3897 | 6740 | 305 | 85.9 | globlastp |
| WNU12_H8 | foxtail_millet\|11v3\|PHY7SI009537M_P1 | 3898 | 6741 | 305 | 85.2 | globlastp |
| WNU12_H7 | sugarcane\|10v1\|CA067037 | 3899 | 6742 | 305 | 85 | globlastp |
| WNU12_H17 | switchgrass\|12v1\|FL691189_P1 | 3900 | 6743 | 305 | 84.9 | globlastp |
| WNU14_H5 | wheat\|12v3\|BE406669 | 3901 | 6744 | 306 | 87.4 | globlastp |
| WNU14_H6 | brachypodium\|12v1\|BRADI5G22780_P1 | 3902 | 6745 | 306 | 85.4 | globlastp |
| WNU14_H7 | wheat\|12v3\|BI750679 | 3903 | 6746 | 306 | 83.5 | globlastp |
| WNU14_H8 | rice\|11v1\|AU097232 | 3904 | 6747 | 306 | 81.3 | globlastp |
| WNU21_H1 | wheat\|12v3\|BG313700 | 3905 | 6748 | 307 | 97.8 | globlastp |
| WNU21_H2 | pseudoroegneria\|gb167\|FF343018 | 3906 | 6749 | 307 | 97.3 | globlastp |
| WNU21_H3 | rye\|12v1\|DRR001012.138574 | 3907 | 6750 | 307 | 97.3 | globlastp |
| WNU21_H4 | rye\|12v1\|DRR001012.10155 | 3908 | 6751 | 307 | 96.7 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU21_H5 | rye\|12v1\|DRR001012.10485 | 3909 | 6751 | 307 | 96.7 | globlastp |
| WNU21_H6 | rye\|12v1\|DRR001013.189535 | 3910 | 6752 | 307 | 96.7 | globlastp |
| WNU21_H7 | rye\|12v1\|DRR001017.1025316 | 3911 | 6751 | 307 | 96.7 | globlastp |
| WNU21_H8 | wheat\|12v3\|CA737303 | 3912 | 6753 | 307 | 96.7 | globlastp |
| WNU21_H11 | rye\|12v1\|DRR001012.148105 | 3913 | 6754 | 307 | 96.2 | globlastp |
| WNU21_H9 | rye\|12v1\|DRR001012.182796 | 3914 | 6755 | 307 | 96.17 | globlastp |
| WNU21_H10 | rye\|12v1\|DRR001012.20658 | 3915 | 6756 | 307 | 96.17 | glotblastn |
| WNU21_H12 | wheat\|12v3\|BQ166247 | 3916 | 6757 | 307 | 95.6 | globlastp |
| WNU21_H13 | wheat\|12v3\|BF200640 | 3917 | 6758 | 307 | 94 | globlastp |
| WNU21_H14 | *leymus*\|gb166\|CD809143_P1 | 3918 | 6759 | 307 | 91.8 | globlastp |
| WNU21_H15 | *fescue*\|gb161\|DT681490_P1 | 3919 | 6760 | 307 | 88.5 | globlastp |
| WNU21_H16 | *brachypodium*\|12v1\|BRADI3G26930_P1 | 3920 | 6761 | 307 | 86.9 | globlastp |
| WNU27_H1 | wheat\|12v3\|BE488391 | 3921 | 6762 | 308 | 95.9 | globlastp |
| WNU27_H2 | rye\|12v1\|BF145226 | 3922 | 6763 | 308 | 95.6 | globlastp |
| WNU27_H3 | wheat\|12v3\|BE412113 | 3923 | 6764 | 308 | 95.6 | globlastp |
| WNU27_H4 | rye\|12v1\|DRR001012.270703 | 3924 | 6765 | 308 | 88.76 | glotblastn |
| WNU27_H5 | *brachypodium*\|12v1\|BRADI3G56757_P1 | 3925 | 6766 | 308 | 88.4 | globlastp |
| WNU27_H6 | *sorghum*\|12v1\|SB04G038010 | 3926 | 6767 | 308 | 84.5 | globlastp |
| WNU27_H7 | foxtail_millet\|11v3\|PHY7SI019250M_P1 | 3927 | 6768 | 308 | 82.4 | globlastp |
| WNU27_H11 | switchgrass\|12v1\|FE641715_P1 | 3928 | 6769 | 308 | 82.1 | globlastp |
| WNU27_H8 | switchgrass\|gb167\|FE641715 | 3929 | 6769 | 308 | 82.1 | globlastp |
| WNU27_H9 | maize\|10v1\|AI920575_T1 | 3930 | 6770 | 308 | 81.4 | glotblastn |
| WNU28_H1 | rye\|12v1\|DRR001012.114780 | 3931 | 6771 | 309 | 88.9 | globlastp |
| WNU28_H2 | rye\|12v1\|DRR001012.48939 | 3932 | 6772 | 309 | 88.1 | globlastp |
| WNU28_H3 | rye\|12v1\|DRR001018.89399 | 3933 | 6773 | 309 | 87.4 | globlastp |
| WNU28_H4 | rye\|12v1\|DRR001017.104402 | 3934 | 6774 | 309 | 87.3 | globlastp |
| WNU28_H5 | rye\|12v1\|DRR001012.141928 | 3935 | 6775 | 309 | 86.7 | globlastp |
| WNU28_H6, WNU28_H7 | wheat\|12v3\|CJ963327_P1 | 3936 | 6776 | 309 | 85.8 | globlastp |
| WNU28_H6, WNU28_H7 | wheat\|12v3\|CJ963327 | 3937 | — | 309 | 85.8 | globlastp |
| WNU28_H8 | wheat\|12v3\|CA693523 | 3938 | 6777 | 309 | 85.1 | globlastp |
| WNU28_H9 | rye\|12v1\|DRR001018.49987 | 3939 | 6778 | 309 | 84.3 | globlastp |
| WNU28_H12 | wheat\|12v3\|CD872329 | 3940 | 6779 | 309 | 83 | globlastp |
| WNU28_H15 | wheat\|12v3\|BE404460 | 3941 | 6780 | 309 | 82.2 | globlastp |
| WNU28_H16 | barley\|12v1\|AV930429_P1 | 3942 | 6781 | 309 | 82.1 | globlastp |
| WNU28_H17 | barley\|12v1\|BF253983_P1 | 3943 | 6781 | 309 | 82.1 | globlastp |
| WNU28_H13 | barley\|12v1\|BI951355_P1 | 3944 | 6782 | 309 | 80.1 | globlastp |
| WNU28_H21 | rye\|12v1\|DRR001012.224627_P1 | 3945 | 6783 | 309 | 80 | globlastp |
| WNU28_H22 | rye\|12v1\|DRR001012.62536_P1 | 3946 | 6784 | 309 | 80 | globlastp |
| WNU28_H23 | rye\|12v1\|DRR001012.656377_P1 | 3947 | 6785 | 309 | 80 | globlastp |
| WNU37_H6 | *brachypodium*\|12v1\|BRADI4G04420_P1 | 3948 | 6786 | 311 | 96.3 | globlastp |
| WNU37_H16 | oil_palm\|11v1\|CN599820_P1 | 3949 | 6787 | 311 | 83.5 | globlastp |
| WNU37_H17 | oil_palm\|11v1\|SRR190698.114726_P1 | 3950 | 6787 | 311 | 83.5 | globlastp |
| WNU37_H18 | banana\|12v1\|MAGEN2012018569_P1 | 3951 | 6788 | 311 | 82.5 | globlastp |
| WNU37_H20 | cacao\|10v1\|CGD0019884_P1 | 3952 | 6789 | 311 | 81 | globlastp |
| WNU37_H24 | cassava\|09v1\|AI253959_P1 | 3953 | 6790 | 311 | 80.2 | globlastp |
| WNU37_H27 | prunus_mume\|13v1\|CV047022_T1 | 3954 | 6791 | 311 | 80.06 | glotblastn |
| WNU61_H1 | *sorghum*\|12v1\|SB10G006070 | 3955 | 6792 | 315 | 89.2 | globlastp |
| WNU61_H2 | maize\|10v1\|BM737452_P1 | 3956 | 6793 | 315 | 87.1 | globlastp |
| WNU61_H3 | rice\|11v1\|CI069708_P1 | 3957 | 6794 | 315 | 82.7 | globlastp |
| WNU61_H4 | rye\|12v1\|BE495393_T1 | 3958 | 6795 | 315 | 81.89 | glotblastn |
| WNU61_H5 | *brachypodium*\|12v1\|BRADI1G46900_P1 | 3959 | 6796 | 315 | 81.6 | globlastp |
| WNU61_H6 | wheat\|12v3\|AL822556_P1 | 3960 | 6797 | 315 | 80.3 | globlastp |
| WNU63_H1 | *cenchrus*\|gb166\|EB658691_P1 | 3961 | 6798 | 316 | 97.5 | globlastp |
| WNU63_H2 | foxtail_millet\|11v3\|PHY7SI012165M_T1 | 3962 | 6799 | 316 | 95.05 | glotblastn |
| WNU63_H16 | switchgrass\|12v1\|DN146418_P1 | 3963 | 6800 | 316 | 94.7 | globlastp |
| WNU63_H3 | switchgrass\|gb167\|DN146418 | 3964 | 6801 | 316 | 94.7 | globlastp |
| WNU63_H4 | millet\|10v1\|EVO454PM118273_P1 | 3965 | 6802 | 316 | 93.6 | globlastp |
| WNU63_H5 | maize\|10v1\|AI622273_P1 | 3966 | 6803 | 316 | 92.9 | globlastp |
| WNU63_H6 | *sorghum*\|12v1\|SB04G009630 | 3967 | 6804 | 316 | 92.9 | globlastp |
| WNU63_H7 | *sorghum*\|12v1\|SB01G016190 | 3968 | 6805 | 316 | 91.5 | globlastp |
| WNU63_H8 | maize\|10v1\|AI948046_P1 | 3969 | 6806 | 316 | 88.7 | globlastp |
| WNU63_H9 | rice\|11v1\|BM420094 | 3970 | 6807 | 316 | 86.3 | globlastp |
| WNU63_H10 | *brachypodium*\|12v1\|BRADI2G33020T2_P1 | 3971 | 6808 | 316 | 85.5 | globlastp |
| WNU63_H11 | rye\|12v1\|DRR001012.157809 | 3972 | 6809 | 316 | 84.5 | globlastp |
| WNU63_H12 | barley\|12v1\|BE215196_T1 | 3973 | 6810 | 316 | 84.1 | glotblastn |
| WNU63_H13 | rye\|12v1\|DRR001015.124656 | 3974 | 6811 | 316 | 84.1 | glotblastn |
| WNU63_H14 | wheat\|12v3\|CA661311 | 3975 | 6812 | 316 | 84.1 | globlastp |

TABLE 2-continued

Homologues (e.g., orthologues) of the identified genes/polypeptides for increasing
nitrogen use efficiency, fertilizer use efficiency, yield, seed yield, growth rate, vigor,
biomass, oil content, fiber yield, fiber quality, fiber length, abiotic stress tolerance
and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU63_H15 | pseudoroegneria\|gb167\|FF340909 | 3976 | 6813 | 316 | 80.92 | glotblastn |
| WNU78_H1 | millet\|10v1\|EVO454PM004199_P1 | 3977 | 6814 | 319 | 92.5 | globlastp |
| WNU78_H17 | switchgrass\|12v1\|DN146651_P1 | 3978 | 6815 | 319 | 89.7 | globlastp |
| WNU78_H18 | switchgrass\|12v1\|FE643273_P1 | 3979 | 6816 | 319 | 89.7 | globlastp |
| WNU78_H2 | switchgrass\|gb167\|DN146651 | 3980 | 6815 | 319 | 89.7 | globlastp |
| WNU78_H3 | switchgrass\|gb167\|FE643273 | 3981 | 6816 | 319 | 89.7 | globlastp |
| WNU78_H4 | foxtail_millet\|11v3\|PHY7SI007162M_P1 | 3982 | 6817 | 319 | 88.9 | globlastp |
| WNU78_H5 | sorghum\|12v1\|SB10G000890 | 3983 | 6818 | 319 | 88.9 | globlastp |
| WNU78_H19 | switchgrass\|12v1\|FL849979_P1 | 3984 | 6819 | 319 | 87.3 | globlastp |
| WNU78_H6 | rice\|11v1\|AU093254 | 3985 | 6820 | 319 | 85.7 | globlastp |
| WNU78_H7 | switchgrass\|gb167\|FL779241 | 3986 | 6821 | 319 | 84.76 | glotblastn |
| WNU78_H8 | brachypodium\|12v1\|BRADI3G13680_P1 | 3987 | 6822 | 319 | 84.1 | globlastp |
| WNU78_H9 | fescue\|gb161\|DT700845_P1 | 3988 | 6823 | 319 | 83.7 | globlastp |
| WNU78_H10 | barley\|12v1\|BI955393_T1 | 3989 | 6824 | 319 | 83.33 | glotblastn |
| WNU78_H11 | wheat\|12v3\|BJ208990 | 3990 | 6825 | 319 | 82.9 | globlastp |
| WNU78_H12 | wheat\|12v3\|BE444900 | 3991 | 6826 | 319 | 82.5 | globlastp |
| WNU78_H13 | brachypodium\|12v1\|BRADI1G51860_P1 | 3992 | 6827 | 319 | 82.1 | globlastp |
| WNU78_H14 | rye\|12v1\|DRR001012.33764 | 3993 | 6828 | 319 | 82.1 | globlastp |
| WNU78_H15 | wheat\|12v3\|CA632170 | 3994 | 6829 | 319 | 82.1 | globlastp |
| WNU78_H16 | oat\|11v1\|CN819016_P1 | 3995 | 6830 | 319 | 81.3 | globlastp |
| WNU80_H1 | foxtail_millet\|11v3\|PHY7SI002358M_P1 | 3996 | 6831 | 320 | 96.7 | globlastp |
| WNU80_H2 | millet\|10v1\|CD724968_P1 | 3997 | 6832 | 320 | 96.7 | globlastp |
| WNU80_H3 | sorghum\|12v1\|SB03G040810 | 3998 | 6833 | 320 | 96.7 | globlastp |
| WNU80_H17 | switchgrass\|12v1\|FE599977_P1 | 3999 | 6834 | 320 | 96.4 | globlastp |
| WNU80_H4 | switchgrass\|gb167\|FE599977 | 4000 | 6835 | 320 | 95.4 | globlastp |
| WNU80_H5 | sugarcane\|10v1\|CA079518 | 4001 | 6836 | 320 | 93.5 | globlastp |
| WNU80_H6 | rice\|11v1\|AU070592 | 4002 | — | 320 | 90.91 | glotblastn |
| WNU80_H7 | brachypodium\|12v1\|BRADI2G55950_P1 | 4003 | 6837 | 320 | 90.6 | globlastp |
| WNU80_H8 | pseudoroegneria\|gb167\|FF349822 | 4004 | 6838 | 320 | 90.3 | globlastp |
| WNU80_H9 | wheat\|12v3\|BE405865 | 4005 | 6839 | 320 | 90.3 | globlastp |
| WNU80_H10 | rye\|12v1\|DRR001012.116997 | 4006 | 6840 | 320 | 89.9 | globlastp |
| WNU80_H11 | rye\|12v1\|DRR001012.163420 | 4007 | 6840 | 320 | 89.9 | globlastp |
| WNU80_H12 | rye\|12v1\|BE587858 | 4008 | 6841 | 320 | 89.6 | globlastp |
| WNU80_H13 | rye\|12v1\|DRR001015.911252 | 4009 | 6842 | 320 | 89.6 | globlastp |
| WNU80_H14 | wheat\|12v3\|BE405262 | 4010 | 6843 | 320 | 89.6 | globlastp |
| WNU80_H15 | cenchrus\|gb166\|BM084416_T1 | 4011 | 6844 | 320 | 88.6 | glotblastn |
| WNU80_H16 | rye\|12v1\|DRR001012.173208 | 4012 | 6845 | 320 | 87.99 | glotblastn |
| WNU81_H1 | foxtail_millet\|11v3\|PHY7SI013223M_P1 | 4013 | 6846 | 321 | 93 | globlastp |
| WNU81_H2 | brachypodium\|12v1\|BRADI3G22387_P1 | 4014 | 6847 | 321 | 89.7 | globlastp |
| WNU81_H3 | rice\|11v1\|BM419293 | 4015 | 6848 | 321 | 89.1 | globlastp |
| WNU81_H4 | foxtail_millet\|11v3\|PHY7SI028859M_P1 | 4016 | 6849 | 321 | 85.4 | globlastp |
| WNU81_H5 | rice\|11v1\|CA754384 | 4017 | 6850 | 321 | 84.8 | globlastp |
| WNU81_H6 | sorghum\|12v1\|SB02G019450 | 4018 | 6851 | 321 | 84.7 | globlastp |
| WNU81_H7 | rye\|12v1\|DRR001012.105803 | 4019 | 6852 | 321 | 83.7 | globlastp |
| WNU81_H8 | maize\|10v1\|MZEAKHDA_P1 | 4020 | 6853 | 321 | 83.2 | globlastp |
| WNU81_H10 | brachypodium\|12v1\|BRADI4G27450_P1 | 4021 | 6854 | 321 | 82.7 | globlastp |
| WNU81_H9 | switchgrass\|gb167\|FE600070 | 4022 | 6855 | 321 | 82.65 | glotblastn |
| WNU81_H11 | wheat\|12v3\|BE412231 | 4023 | 6856 | 321 | 82.4 | globlastp |
| WNU81_H12 | wheat\|12v3\|BM136038 | 4024 | 6857 | 321 | 81.82 | glotblastn |
| WNU82_H1 | sugarcane\|10v1\|CA151757 | 4025 | 6858 | 322 | 90.9 | globlastp |
| WNU82_H2 | sorghum\|12v1\|SB03G042740 | 4026 | 6859 | 322 | 89 | globlastp |
| WNU82_H4 | foxtail_millet\|11v3\|PHY7SI003185M_P1 | 4027 | 6860 | 322 | 81.3 | globlastp |
| WNU82_H5 | switchgrass\|gb167\|DN144831 | 4028 | 6861 | 322 | 80.6 | globlastp |
| WNU83_H11 | switchgrass\|12v1\|FL769499_P1 | 4029 | 6862 | 323 | 95.5 | globlastp |
| WNU83_H12 | switchgrass\|12v1\|FL734741_P1 | 4030 | 6863 | 323 | 95 | globlastp |
| WNU83_H2 | foxtail_millet\|11v3\|PHY7SI022165M_T1 | 4031 | 6864 | 323 | 94.09 | glotblastn |
| WNU83_H1 | sorghum\|12v1\|SB09G003210 | 4032 | 6865 | 323 | 93.6 | globlastp |
| WNU83_H3 | brachypodium\|12v1\|BRADI2G36660_P1 | 4033 | 6866 | 323 | 89.7 | globlastp |
| WNU83_H5 | wheat\|12v3\|BE499001 | 4034 | 6867 | 323 | 89.1 | globlastp |
| WNU83_H4 | rice\|11v1\|AU091309 | 4035 | 6868 | 323 | 89.09 | glotblastn |
| WNU83_H6 | rice\|11v1\|GFXAC105262X7 | 4036 | 6869 | 323 | 87.5 | globlastp |
| WNU83_H7 | cenchrus\|gb166\|EB657522_P1 | 4037 | 6870 | 323 | 87.3 | globlastp |
| WNU83_H8 | rye\|12v1\|DRR001012.509710 | 4038 | 6871 | 323 | 86 | globlastp |
| WNU83_H9 | rye\|12v1\|DRR001012.585241 | 4039 | 6872 | 323 | 86 | globlastp |
| WNU83_H10 | switchgrass\|gb167\|FL734741 | 4040 | 6873 | 323 | 84.09 | glotblastn |
| WNU98_H2 | sorghum\|12v1\|SB04G026090 | 4041 | 6874 | 325 | 94.3 | globlastp |
| WNU98_H4 | foxtail_millet\|11v3\|PHY7SI035026M_P1 | 4042 | 6875 | 325 | 88.3 | globlastp |
| WNU98_H5 | foxtail_millet\|11v3\|EC612739_P1 | 4043 | 6876 | 325 | 87.6 | globlastp |
| WNU98_H6 | foxtail_millet\|11v3\|PHY7SI000916M_P1 | 4044 | 6877 | 325 | 87.4 | globlastp |

TABLE 2-continued

Homologues (e.g., orthologues) of the identified genes/polypeptides for increasing nitrogen use efficiency, fertilizer use efficiency, yield, seed yield, growth rate, vigor, biomass, oil content, fiber yield, fiber quality, fiber length, abiotic stress tolerance and/or water use efficiency of a plant

| Hom. Name | Organism/cluster name | Polyn. SEQ ID NO: | Polyp. SEQ ID NO: | Hom. to SEQ ID NO: | % glob. Ident. | Algor. |
|---|---|---|---|---|---|---|
| WNU98_H22 | switchgrass\|12v1\|FE607028_P1 | 4045 | 6878 | 325 | 87.2 | globlastp |
| WNU98_H7 | switchgrass\|gb167\|FE607028 | 4046 | 6878 | 325 | 87.2 | globlastp |
| WNU98_H23 | switchgrass\|12v1\|FE608115_P1 | 4047 | 6879 | 325 | 87.1 | globlastp |
| WNU98_H8 | switchgrass\|gb167\|FE608115 | 4048 | 6879 | 325 | 87.1 | globlastp |
| WNU98_H24 | switchgrass\|12v1\|FE599520_P1 | 4049 | 6880 | 325 | 86.9 | globlastp |
| WNU98_H10 | rice\|11v1\|AA754522 | 4050 | 6881 | 325 | 85.2 | globlastp |
| WNU98_H12 | barley\|12v1\|AV833668_P1 | 4051 | 6882 | 325 | 82.7 | globlastp |
| WNU98_H13 | wheat\|12v3\|BJ268384 | 4052 | 6883 | 325 | 82.5 | globlastp |
| WNU98_H14 | rye\|12v1\|DRR001012.140848 | 4053 | 6884 | 325 | 81.2 | globlastp |
| WNU98_H15 | wheat\|12v3\|BE500326 | 4054 | 6885 | 325 | 81.2 | globlastp |
| WNU98_H16 | rye\|12v1\|DRR001012.130831 | 4055 | 6886 | 325 | 80.8 | globlastp |
| WNU98_H19 | rye\|12v1\|DRR001012.119066 | 4056 | 6887 | 325 | 80.3 | globlastp |
| WNU98_H20 | rye\|12v1\|BE494854 | 4057 | 6888 | 325 | 80.1 | globlastp |
| WNU98_H25 | barley\|12v1\|BG414863_P1 | 4058 | 6889 | 325 | 80 | globlastp |
| WNU99_H1 | maize\|10v1\|BM032584_P1 | 4059 | 6890 | 326 | 89.7 | globlastp |
| WNU99_H3 | switchgrass\|12v1\|FL698201_P1 | 4060 | 6891 | 326 | 88.2 | globlastp |
| WNU99_H2 | maize\|10v1\|AW520084_P1 | 4061 | 6892 | 326 | 88 | globlastp |
| WNU99_H4 | switchgrass\|12v1\|FE632329_P1 | 4062 | 6893 | 326 | 87.3 | globlastp |

Table 2: Provided are the homologous polypeptides and polynucleotides of the genes identified in Table 1 and of their cloned genes, which can increase nitrogen use efficiency, fertilizer use efficiency, yield, seed yield, growth rate, vigor, biomass, oil content, fiber yield, fiber quality, fiber length, abiotic stress tolerance and/or water use efficiency of a plant. Homology was calculated as % of identity over the aligned sequences. The query sequences were polypeptide sequences SEQ ID NOs: 202-327 and polynucleotides SEQ ID NOs: 1-201) and the subject sequences are polypeptide sequences or polynucleotide sequences which were dynamically translated in all six reading frames identified in the database based on greater than 80% identity to the query polypeptide sequences.
"Polyp." = polypeptide;
"Polyn." - Polynucleotide.
Algor. = Algorithm,
"globlastp" - global homology using blastp;
"glotblastn" - global homology using tblastn.
"Hom." - homologous.

The output of the functional genomics approach described herein is a set of genes highly predicted to improve nitrogen use efficiency, fertilizer use efficiency, yield, seed yield, growth rate, vigor, biomass, oil content, fiber yield, fiber length, fiber quality, abiotic stress tolerance and/or water use efficiency of a plant by increasing their expression.

Although each gene is predicted to have its own impact, modifying the mode of expression of more than one gene or gene product (RNA, polypeptide) is expected to provide an additive or synergistic effect on the desired trait (e.g., nitrogen use efficiency, fertilizer use efficiency, yield, growth rate, vigor, biomass, oil content, abiotic stress tolerance and/or water use efficiency of a plant). Altering the expression of each gene described here alone or of a set of genes together increases the overall yield and/or other agronomic important traits, hence expects to increase agricultural productivity.

Example 3

Production of Arabidopsis Transcriptome and High Throughput Correlation Analysis Using 44K Arabidopsis Oligonucleotide Micro-Array In order to produce a high throughput correlation analysis comparing between plant phenotype and gene expression level, the present inventors utilized a Arabidopsis oligonucleotide micro-array, produced by Agilent Technologies [chem (dot) agilent (dot) com/Scripts/PDS (dot) asp?1Page=50879]. The array oligonucleotide represents about 44,000 Arabidopsis genes and transcripts. To define correlations between the levels of RNA expression with NUE, yield components or vigor related parameters various plant characteristics of 14 different Arabidopsis ecotypes were analyzed. Among them, ten ecotypes encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Analyzed Arabidopsis tissues—Two tissues of plants [leaves and stems] growing at two different nitrogen fertilization levels (1.5 mM Nitrogen or 6 mM Nitrogen) were sampled and RNA was extracted as described above. Each micro-array expression information tissue type has received a Set ID as summarized Table 3 below.

TABLE 3

Arabidopsis transcriptome experimental sets

| Expression Set | Set ID |
|---|---|
| Leaves at 1.5 mM Nitrogen fertilization | 1 |
| Leaves at 6 mM Nitrogen fertilization | 2 |
| Stems at 1.5 mM Nitrogen fertilization | 3 |
| Stem at 6 mM Nitrogen fertilization | 4 |

Table 3.

Arabidopsis yield components and vigor related parameters under different nitrogen fertilization levels assessment—10 Arabidopsis accessions in 2 repetitive plots each containing 8 plants per plot were grown at greenhouse. The growing protocol used was as follows: surface sterilized seeds were sown in Eppendorf tubes containing 0.5× Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [rsb (dot) info (dot) nih (dot) gov/ij/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]). Next, analyzed data was saved to text files and processed using the JMP statistical analysis software (SAS institute).

Data parameters collected are summarized in Table 4, hereinbelow.

TABLE 4

Arabidopsis correlated parameters (vectors)

| Correlated parameter with | Correlation ID |
|---|---|
| N_1.5 mM 1000 Seeds weight [gr] | 1 |
| N 1.5 mM Biomass reduction compared to 6 mM [gr] | 2 |
| N 1.5 mM DW/SPAD [gr./SPAD unit] | 3 |
| N 1.5 mM Dry Weight [gr] | 4 |
| N 1.5 mM Harvest Index | 5 |
| N 1.5 mM Leaf Blade Area 10 day [$cm^2$] | 6 |
| N 1.5 mM Leaf Number 10 day | 7 |
| N 1.5 mM GR of Rosette Area 3 day [$cm^2$/day] | 8 |
| N 1.5 mM Rosette Area 10 day [$cm^2$] | 9 |
| N 1.5 mM Rosette Area 8 day [$cm^2$] | 10 |
| N 1.5 mM SPAD/DW [SPAD unit/gr.] | 11 |
| N 1.5 mM Seed Yield [gr] | 12 |
| N 1.5 mM Seed yield reduction compared to 6 mM [gr] | 13 |
| N 1.5 mM Spad/FW [SPAD unit/gr.] | 14 |
| N 1.5 mM seed yield/spad [gr./SPAD unit] | 15 |
| N 1.5 mM seed yield per leaf blead [gr./$cm^2$] | 16 |
| N 1.5 mM seed yield per rossete area day 10 [gr./$cm^2$] | 17 |
| N 1.5 mM t50 Flowering [days] | 18 |
| N 6 mMDW/SPAD [gr./SPAD unit] | 19 |
| N 6 mMSpad/FW [SPAD unit/gr.] | 20 |
| N 6 mM 10 day 00 Seeds weight [gr] | 21 |
| N 6 mM Dry Weight [gr] | 22 |
| N 6 mM Harvest Index | 23 |
| N 6 mM Leaf Blade Area 10 day [$cm^2$] | 24 |
| N 6 mM Leaf Number 10 day | 25 |
| N 6 mM GR of Rosette Area 3 day [$cm^2$/day] | 26 |
| N 6 mM Rosette Area 10 day [$cm^2$] | 27 |
| N 6 mM Rosette Area 8 day [$cm^2$] | 28 |
| N 6 mM Seed Yield [gr] | 29 |
| N 6 mM Seed yield/N unit [gr./SPAD unit] | 30 |
| N 6 mM seed yield/rossete area day 10 day [gr./$cm^2$] | 31 |
| N 6 mM seed yield/leaf blade [gr./$cm^2$] | 32 |

TABLE 4-continued

Arabidopsis correlated parameters (vectors)

| Correlated parameter with | Correlation ID |
|---|---|
| N 6 mM spad/DW [SPAD unit/gr.] | 33 |
| N 6 mM t50 Flowering (days) | 34 |

Table 4.
"N" = Nitrogen at the noted concentrations;
"gr." = grams;
"SPAD" = chlorophyll levels;
"t50" = time where 50% of plants flowered;
"gr./SPAD unit" = plant biomass expressed in grams per unit of nitrogen in plant measured by SPAD.
"DW" = plant dry weight;
"N level/DW" = plant Nitrogen level measured in SPAD unit per plant biomass [gr.];
"DW/N level" = plant biomass per plant [gr.]/SPAD unit;

Assessment of NUE, yield components and vigor-related parameters—Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process was repeated every 2-3 days starting at day 9-12 till day 16-19 (respectively) from transplanting.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf analysis—Using the digital analysis leaves data was calculated, including leaf number, leaf blade area, Rosette diameter and area.

Vegetative growth rate: the growth rate (GR) of leaf blade area (Formula XII), leaf number (Formula VIII), rosette area (Formula IX), rosette diameter (Formula X), plot coverage (Formula XI) and Petiole Relative Area (Formula XXV) were calculated using the indicated Formulas as described above.

Seed yield and 1000 seeds weight—At the end of the experiment all seeds from all plots were collected and weighed in order to measure seed yield per plant in terms of total seed weight per plant (gr.). For the calculation of 1000 seed weight, an average weight of 0.02 grams was measured from each sample, the seeds were scattered on a glass tray and a picture was taken. Using the digital analysis, the number of seeds in each sample was calculated.

Dry weight and seed yield—At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index—The harvest index was calculated using Formula XV as described above.

$T_{50}$ days to flowering—Each of the repeats was monitored for flowering date.

Days of flowering was calculated from sowing date till 50% of the plots flowered.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr.]/SPAD unit], plant DW per nitrogen unit [DW/N level=plant biomass per plant [gr.]/SPAD unit], and nitrogen level per gram of biomass [N level/DW=SPAD unit/plant biomass per plant (gr.)] were calculated.

Percent of seed yield reduction—measures the amount of seeds obtained in plants when grown under nitrogen-limiting conditions compared to seed yield produced at normal nitrogen levels expressed in %.

Experimental Results 10 different *Arabidopsis* accessions (ecotypes) were grown and characterized for 37 parameters as described above. The average for each of the measured parameters was calculated using the JMP software and values are summarized in Table 5 below. Subsequent correlation analysis between the various transcriptome sets (Table 3) and the measured parameters was conducted. Following, the results were integrated to the database.

TABLE 5

Measured parameters in *Arabidopsis* accessions

| Corr. ID/ Line | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 0.016 | 0.016 | 0.018 | 0.014 | 0.022 | 0.015 | 0.014 | 0.022 | 0.019 | 0.018 |
| 2 | 60.746 | 76.706 | 78.560 | 78.140 | 78.641 | 73.192 | 83.068 | 77.190 | 70.120 | 62.972 |
| 4 | 0.164 | 0.124 | 0.082 | 0.113 | 0.124 | 0.134 | 0.106 | 0.148 | 0.171 | 0.184 |
| 5 | 0.192 | 0.203 | 0.295 | 0.085 | 0.071 | 0.241 | 0.179 | 0.081 | 0.079 | 0.031 |
| 6 | 0.335 | 0.266 | 0.374 | 0.387 | 0.370 | 0.386 | 0.350 | 0.379 | 0.307 | 0.373 |
| 7 | 6.875 | 7.313 | 7.313 | 7.875 | 7.750 | 7.625 | 7.188 | 8.625 | 5.929 | 7.938 |
| 8 | 0.631 | 0.793 | 0.502 | 0.491 | 0.720 | 0.825 | 0.646 | 0.668 | 0.636 | 0.605 |
| 9 | 1.430 | 1.325 | 1.766 | 1.971 | 1.832 | 1.818 | 1.636 | 1.996 | 1.150 | 1.754 |
| 10 | 0.760 | 0.709 | 1.061 | 1.157 | 1.000 | 0.910 | 0.942 | 1.118 | 0.638 | 0.996 |
| 12 | 0.032 | 0.025 | 0.023 | 0.010 | 0.009 | 0.032 | 0.019 | 0.012 | 0.014 | 0.006 |
| 13 | 72.559 | 84.701 | 78.784 | 87.996 | 92.622 | 76.710 | 81.938 | 91.301 | 85.757 | 91.820 |
| 16 | 0.095 | 0.095 | 0.063 | 0.026 | 0.024 | 0.084 | 0.059 | 0.034 | 0.044 | 0.015 |
| 17 | 0.022 | 0.019 | 0.014 | 0.005 | 0.005 | 0.018 | 0.013 | 0.007 | 0.012 | 0.003 |
| 18 | 15.967 | 20.968 | 14.836 | 24.708 | 23.698 | 18.059 | 19.488 | 23.568 | 21.888 | 23.566 |
| 21 | 0.015 | 0.017 | 0.018 | 0.012 | 0.016 | 0.015 | 0.014 | 0.017 | 0.016 | 0.016 |
| 22 | 0.419 | 0.531 | 0.382 | 0.518 | 0.579 | 0.501 | 0.628 | 0.649 | 0.573 | 0.496 |
| 23 | 0.280 | 0.309 | 0.284 | 0.158 | 0.206 | 0.276 | 0.171 | 0.212 | 0.166 | 0.136 |
| 24 | 0.342 | 0.315 | 0.523 | 0.449 | 0.430 | 0.497 | 0.428 | 0.509 | 0.405 | 0.430 |
| 25 | 6.250 | 7.313 | 8.063 | 8.750 | 8.750 | 8.375 | 7.125 | 9.438 | 6.313 | 8.063 |
| 26 | 0.689 | 1.024 | 0.614 | 0.601 | 0.651 | 0.676 | 0.584 | 0.613 | 0.515 | 0.477 |
| 27 | 1.406 | 1.570 | 2.673 | 2.418 | 2.142 | 2.474 | 1.965 | 2.721 | 1.642 | 2.207 |
| 28 | 0.759 | 0.857 | 1.477 | 1.278 | 1.095 | 1.236 | 1.094 | 1.410 | 0.891 | 1.224 |
| 29 | 0.116 | 0.165 | 0.108 | 0.082 | 0.119 | 0.139 | 0.107 | 0.138 | 0.095 | 0.068 |
| 31 | 0.082 | 0.106 | 0.041 | 0.034 | 0.056 | 0.057 | 0.055 | 0.051 | 0.058 | 0.031 |
| 32 | 0.339 | 0.526 | 0.207 | 0.183 | 0.277 | 0.281 | 0.252 | 0.271 | 0.235 | 0.158 |
| 34 | 16.371 | 20.500 | 14.635 | 24.000 | 23.595 | 15.033 | 19.750 | 22.887 | 18.804 | 23.378 |
| 3 | 0.006 | | | 0.004 | | 0.005 | | | 0.006 | 0.006 |
| 11 | 167.300 | | | 241.061 | | 194.977 | | | 169.343 | 157.823 |
| 14 | 45.590 | | | 42.110 | | 53.110 | | | 67.000 | 28.150 |
| 15 | 0.001 | | | 0.000 | | 0.001 | | | 0.000 | 0.000 |
| 19 | 0.019 | | | 0.018 | | 0.015 | | | 0.015 | 0.028 |
| 20 | 22.490 | | | 28.270 | | 33.320 | | | 39.000 | 17.640 |
| 30 | 0.004 | | | 0.003 | | 0.005 | | | 0.003 | 0.002 |
| 33 | 53.705 | | | 54.625 | | 66.479 | | | 68.054 | 35.548 |

Table 5. Provided are the measured parameters under various treatments in various ecotypes (*Arabidopsis* accessions).

TABLE 6

Correlation between the expression level of WNU selected genes of some embodiments of the invention in various tissues and the phenotypic performance under normal or low nitrogen fertilization conditions across *Arabidopsis* accessions

| Gene Name | R | P value | Exp. set | Cor. Set ID | Gene Name | R | P value | Exp. set | Cor. Set ID |
|---|---|---|---|---|---|---|---|---|---|
| WNU5 | 0.704 | 3.44E−02 | 4 | 4 | WNU5 | 0.826 | 3.21E−03 | 3 | 17 |
| WNU5 | 0.801 | 5.31E−03 | 3 | 16 | WNU5 | 0.762 | 1.05E−02 | 3 | 12 |
| WNU7 | 0.709 | 2.18E−02 | 1 | 34 | WNU7 | 0.730 | 1.65E−02 | 3 | 31 |

Table 6. "Corr. ID"—correlation set ID according to the correlated parameters Table above.
"Exp. Set"—Expression set.
"R" = Pearson correlation coefficient;
"P" = p value.

Example 4

Production of *Arabidopsis* Transcriptome and High Throughput Correlation Analysis of Yield, Biomass and/or Vigor Related Parameters Using 44K *Arabidopsis* Full Genome Oligonucleotide Micro-Array To produce a high throughput correlation analysis comparing between plant phenotype and gene expression level, the present inventors utilized an *Arabidopsis thaliana* oligonucleotide micro-array, produced by Agilent Technologies [chem. (dot) agilent (dot) com/Scripts/PDS (dot) asp?1Page=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Analyzed *Arabidopsis* tissues—Five tissues at different developmental stages including root, leaf, flower at anthesis, seed at 5 days after flowering (DAF) and seed at 12 DAF, representing different plant characteristics, were sampled and RNA was extracted as described above. Each microarray expression information tissue type has received a Set ID as summarized in Table 7 below.

TABLE 7

Tissues used for *Arabidopsis* transcriptome expression sets

| Expression Set | Set ID |
| --- | --- |
| Leaf | 1 |
| Root | 2 |
| Seed 5 DAF | 3 |
| Flower | 4 |
| Seed 12 DAF | 5 |

Table 7: Provided are the identification (ID) letters of each of the *Arabidopsis* expression sets (A-E).
DAF = days after flowering.

Yield components and vigor related parameters assessment—Eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in a vertical grown transparent agar plates. Most of chosen parameters were analyzed by digital imaging.

Digital imaging in plantlets analysis—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P43.0 GHz processor) and a public domain program—ImageJ 1.37, Java based image processing program, which was developed at the U.S. National Institutes of Health and is freely available on the internet at rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root analysis—During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula XXVIII (above).

Vegetative growth rate analysis—was calculated according to Formulas VII-XIII above. The analysis was ended with the appearance of overlapping plants.

For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra-Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil yield—The oil yield was calculated using Formula XXIX above.

Harvest Index (seed)—The harvest index was calculated using Formula XV (described above).

Experimental Results

Nine different *Arabidopsis* ecotypes were grown and characterized for 18 parameters (named as vectors). Table 8 describes the *Arabidopsis* correlated parameters. The average for each of the measured parameter was calculated using the JMP software (Table 9) and a subsequent correlation analysis was performed (Table 10). Results were then integrated to the database.

TABLE 8

*Arabidopsis* correlated parameters (vectors)

| Correlated parameter with | Correlation ID |
| --- | --- |
| Blade circularity | 1 |
| Dry matter per plant [gr] | 2 |
| Harvest Index | 3 |
| Lamina length [cm] | 4 |
| Lamina width [cm] | 5 |
| Leaf width/length | 6 |
| Oil % per seed [%] | 7 |
| Oil yield per plant [mg] | 8 |
| Seeds per Pod | 9 |
| Silique length [cm] | 10 |
| Total Leaf Area per plant [cm$^2$] | 11 |
| Vegetative growth rate [cm$^2$/day] | 12 |
| fresh weight [gr] | 13 |
| relative root growth [cm/day] | 14 |
| root length day 13 [cm] | 15 |
| root length day 7 [cm] | 16 |
| seed weight [gr] | 17 |
| seed yield per plant [gr] | 18 |

Table 8. Provided are the *Arabidopsis* correlated parameters (correlation ID Nos. 1-18).
Abbreviations:
Cm = centimeter(s);
gr. = gram(s);
mg = milligram(s).

The characterized values are summarized in Table 9 below.

TABLE 9

Measured parameters in *Arabidopsis* ecotypes

| Corr ID./Line | Line-1 | Line-2 | Line-3 | Line-4 | Line-5 | Line-6 | Line-7 | Line-8 | Line-9 |
| --- | --- | --- | --- | --- | --- | --- | --- | --- | --- |
| 1 | 0.509 | 0.481 | 0.450 | 0.370 | 0.501 | 0.376 | 0.394 | 0.491 | 0.409 |
| 2 | 0.640 | 1.270 | 1.050 | 1.280 | 1.690 | 1.340 | 0.810 | 1.210 | 1.350 |
| 3 | 0.530 | 0.350 | 0.560 | 0.330 | 0.370 | 0.320 | 0.450 | 0.510 | 0.410 |
| 4 | 2.767 | 3.544 | 3.274 | 3.785 | 3.690 | 4.597 | 3.877 | 3.717 | 4.149 |
| 5 | 1.385 | 1.697 | 1.460 | 1.374 | 1.828 | 1.650 | 1.510 | 1.817 | 1.668 |
| 6 | 0.353 | 0.288 | 0.316 | 0.258 | 0.356 | 0.273 | 0.305 | 0.335 | 0.307 |
| 7 | 34.420 | 31.190 | 38.050 | 27.760 | 35.490 | 32.910 | 31.560 | 30.790 | 34.020 |
| 8 | 118.630 | 138.730 | 224.060 | 116.260 | 218.270 | 142.110 | 114.150 | 190.060 | 187.620 |
| 9 | 45.440 | 53.470 | 58.470 | 35.270 | 48.560 | 37.000 | 39.380 | 40.530 | 25.530 |
| 10 | 1.060 | 1.260 | 1.310 | 1.470 | 1.240 | 1.090 | 1.180 | 1.180 | 1.000 |
| 11 | 46.860 | 109.890 | 58.360 | 56.800 | 114.660 | 110.820 | 88.490 | 121.790 | 93.040 |
| 12 | 0.313 | 0.378 | 0.484 | 0.474 | 0.425 | 0.645 | 0.430 | 0.384 | 0.471 |
| 13 | 1.510 | 3.607 | 1.935 | 2.082 | 3.556 | 4.338 | 3.467 | 3.479 | 3.710 |
| 14 | 0.631 | 0.664 | 1.176 | 1.089 | 0.907 | 0.774 | 0.606 | 0.701 | 0.782 |
| 15 | 4.419 | 8.530 | 5.621 | 4.834 | 5.957 | 6.372 | 5.649 | 7.060 | 7.041 |
| 16 | 0.937 | 1.759 | 0.701 | 0.728 | 0.991 | 1.163 | 1.284 | 1.414 | 1.251 |
| 17 | 0.020 | 0.023 | 0.025 | 0.034 | 0.020 | 0.026 | 0.020 | 0.023 | 0.024 |
| 18 | 0.340 | 0.440 | 0.590 | 0.420 | 0.610 | 0.430 | 0.360 | 0.620 | 0.550 |

Table 9. Provided are the values of each of the parameters (as described above) measured in *Arabidopsis* accessions (line) under normal growth conditions. Growth conditions are specified in the experimental procedure section.

TABLE 10

Correlation between the expression level of WNU selected genes of some embodiments of the invention in various tissues and the phenotypic performance under normal or low nitrogen fertilization conditions across *Arabidopsis* accessions

| Gene Name | R | P value | Exp. set | Cor. Set ID | Gene Name | R | P value | Exp. set | Cor. Set ID |
| --- | --- | --- | --- | --- | --- | --- | --- | --- | --- |
| WNU5 | 0.746 | 5.41E−02 | 3 | 16 | WNU6 | 0.788 | 3.55E−02 | 3 | 3 |
| WNU7 | 0.728 | 6.39E−02 | 3 | 9 | WNU7 | 0.824 | 2.26E−02 | 3 | 10 |

TABLE 10-continued

Correlation between the expression level of WNU selected genes of some embodiments of the invention in various tissues and the phenotypic performance under normal or low nitrogen fertilization conditions across *Arabidopsis* accessions

| Gene Name | R | P value | Exp. set | Cor. Set ID | Gene Name | R | P value | Exp. set | Cor. Set ID |
|---|---|---|---|---|---|---|---|---|---|
| WNU7 | 0.738 | 5.84E−02 | 3 | 18 | WNU7 | 0.770 | 4.28E−02 | 3 | 8 |
| WNU7 | 0.862 | 1.27E−02 | 3 | 14 | WNU7 | 0.704 | 5.12E−02 | 5 | 5 |

Table 10. "Corr. ID"—correlation set ID according to the correlated parameters Table above.
"Exp. Set"—Expression set.
"R" = Pearson correlation coefficient;
"P" = p value.

Example 5

Production of Barley Transcriptome and High Throughput Correlation Analysis Using 44K Barley Oligonucleotide Micro-Array In order to produce a high throughput correlation analysis comparing between plant phenotype and gene expression level, the present inventors utilized a Barley oligonucleotide micro-array, produced by Agilent Technologies [chem. (dot) agilent (dot) com/Scripts/PDS (dot) asp?1Page=50879]. The array oligonucleotide represents about 47,500 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Analyzed Barley Tissues—Five tissues at different developmental stages [meristem, flower, booting spike, stem, flag leaf], representing different plant characteristics, were sampled and RNA was extracted as described above. Each micro-array expression information tissue type has received a Set ID as summarized in Table 11 below.

TABLE 11

Barley transcriptome expression sets

| Expression Set | Set ID |
|---|---|
| booting spike | 1 |
| flowering spike | 2 |
| meristem | 3 |
| Stem | 4 |

Table 11.

Barley yield components and vigor related parameters assessment—25 Barley accessions in 4 repetitive blocks (named A, B, C, and D), each containing 4 plants per plot were grown at net house. Plants were phenotyped on a daily basis following the standard descriptor of barley (Table 12, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

TABLE 12

Barley standard descriptors

| Trait | Parameter | Range | Description |
|---|---|---|---|
| Growth habit | Scoring | 1-9 | Prostrate (1) or Erect (9) |
| Hairiness of basal leaves | Scoring | P (Presence)/ A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 12.

Grains per spike—At the end of the experiment (50% of the spikes were dry) all spikes from plots within blocks A-D were collected. The total number of grains from 5 spikes that were manually threshed was counted. The average grain per spike was calculated by dividing the total grain number by the number of spikes.

Grain average size (cm)—At the end of the experiment (50% of the spikes were dry) all spikes from plots within blocks A-D were collected. The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

Grain average weight (mgr)—At the end of the experiment (50% of the spikes were dry) all spikes from plots within blocks A-D were collected. The total grains from 5 spikes that were manually threshed were counted and weight. The average weight was calculated by dividing the total weight by the total grain number.

Grain yield per spike (gr)—At the end of the experiment (50% of the spikes were dry) all spikes from plots within blocks A-D were collected. The total grains from 5 spikes that were manually threshed were weight. The grain yield was calculated by dividing the total weight by the spike number.

Spike length analysis—At the end of the experiment (50% of the spikes were dry) all spikes from plots within blocks A-D were collected. The five chosen spikes per plant were measured using measuring tape excluding the awns.

Spike number analysis—At the end of the experiment (50% of the spikes were dry) all spikes from plots within blocks A-D were collected. The spikes per plant were counted.

Growth habit scoring—At the growth stage 10 (booting), each of the plants was scored for its growth habit nature. The scale that was used was 1 for prostate nature till 9 for erect.

Hairiness of basal leaves—At the growth stage 5 (leaf sheath strongly erect; end of tillering), each of the plants was scored for its hairiness nature of the leaf before the last. The scale that was used was 1 for prostate nature till 9 for erect.

Plant height—At the harvest stage (50% of spikes were dry) each of the plants was measured for its height using measuring tape. Height was measured from ground level to top of the longest spike excluding awns.

Days to flowering—Each of the plants was monitored for flowering date. Days of flowering was calculated from sowing date till flowering date.

Stem pigmentation—At the growth stage 10 (booting), each of the plants was scored for its stem color. The scale that was used was 1 for green till 5 for full purple.

Vegetative dry weight and spike yield—At the end of the experiment (50% of the spikes were dry) all spikes and vegetative material from plots within blocks A-D were collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr) after drying at 30° C. in oven for 48 hours.

Harvest index (for barley)—The harvest index was calculated using Formula XVIII (described above).

TABLE 13

| Barley correlated parameters (vectors) | |
|---|---|
| Correlated parameter with | Correlation ID |
| Grain weight [mg] | 1 |
| Grains Size [mm$^2$] | 2 |
| Grains per spike | 3 |
| Growth habit [scores 1-9] | 4 |
| Hairiness of basal leaves [scoring 1-2] | 5 |
| Plant height [cm] | 6 |
| Seed Yield of 5 Spikes [gr] | 7 |
| Spike length [cm] | 8 |
| Spikes per plant | 9 |
| Stem pigmentation [scoring 1-5] | 10 |
| Vegetative dry weight [gr] | 11 |
| days to flowering [days] | 12 |

Table 13.

Experimental Results 13 different Barley accessions were grown and characterized for 13 parameters as described above. The average for each of the measured parameter was calculated using the JMP software and values are summarized in Table 14 below. Subsequent correlation analysis between the various transcriptome sets (Table 11) and the average parameters, was conducted. Follow, results were integrated to the database.

TABLE 14

Measured parameters of correlation Ids in Barley accessions

| Cor. ID./L | L-1 | L-2 | L-3 | L-4 | L-5 | L-6 | L-7 | L-8 | L-9 | L-10 | L-11 | L-12 | L-13 |
|---|---|---|---|---|---|---|---|---|---|---|---|---|---|
| 1 | 35.0 | 28.1 | 28.8 | 17.9 | 41.2 | 29.7 | 35.0 | 20.6 | 37.1 | 25.2 | | | |
| 2 | 0.3 | 0.2 | 0.2 | 0.2 | 0.3 | 0.3 | 0.3 | 0.2 | 0.3 | 0.2 | | | |
| 3 | 20.2 | 18.0 | 17.3 | 17.7 | 14.5 | 16.8 | 14.1 | 21.5 | 13.4 | 12.1 | | | |
| 4 | 2.6 | 2.0 | 1.9 | 3.2 | 4.3 | 2.7 | 3.5 | 3.0 | 2.5 | 3.6 | | | |
| 5 | 1.5 | 1.3 | 1.7 | 1.1 | 1.4 | 1.7 | 1.2 | 1.0 | 1.6 | 1.3 | | | |
| 6 | 134.3 | 130.5 | 138.8 | 114.6 | 127.8 | 129.4 | 121.6 | 126.8 | 121.4 | 103.9 | | | |
| 7 | 3.6 | 2.5 | 2.6 | 1.6 | 3.0 | 2.5 | 2.6 | 2.3 | 2.7 | 1.5 | | | |
| 8 | 12.0 | 10.9 | 11.8 | 9.9 | 11.7 | 11.5 | 11.2 | 11.1 | 10.2 | 8.9 | | | |
| 10 | 1.1 | 2.5 | 1.7 | 1.8 | 2.3 | 2.3 | 2.2 | 2.3 | 3.1 | 1.7 | | | |
| 11 | 78.9 | 66.1 | 68.5 | 53.4 | 68.3 | 74.2 | 58.3 | 62.2 | 68.3 | 35.4 | | | |
| 12 | 62.4 | 64.1 | 65.2 | 58.9 | 63.0 | 70.5 | 60.9 | 58.1 | 60.4 | 52.8 | | | |
| 1 | 35.0 | 28.1 | 28.8 | 17.9 | 41.2 | 29.7 | 35.0 | 20.6 | 37.1 | 25.2 | 27.5 | 29.6 | 19.6 |
| 2 | 0.3 | 0.2 | 0.2 | 0.2 | 0.3 | 0.3 | 0.3 | 0.2 | 0.3 | 0.2 | 0.2 | 0.3 | 0.2 |
| 3 | 20.2 | 18.0 | 17.3 | 17.7 | 14.5 | 16.8 | 14.1 | 21.5 | 13.4 | 12.1 | 12.1 | 15.3 | 17.1 |
| 4 | 2.6 | 2.0 | 1.9 | 3.2 | 4.3 | 2.7 | 3.5 | 3.0 | 2.5 | 3.6 | 3.7 | 3.5 | 3.0 |
| 5 | 1.5 | 1.3 | 1.7 | 1.1 | 1.4 | 1.7 | 1.2 | 1.0 | 1.6 | 1.3 | 1.2 | 1.1 | 1.2 |
| 6 | 134.3 | 130.5 | 138.8 | 114.6 | 127.8 | 129.4 | 121.6 | 126.8 | 121.4 | 103.9 | 99.8 | 118.4 | 117.2 |
| 7 | 3.6 | 2.5 | 2.6 | 1.6 | 3.0 | 2.5 | 2.6 | 2.3 | 2.7 | 1.5 | 1.7 | 2.4 | 1.7 |
| 8 | 12.0 | 10.9 | 11.8 | 9.9 | 11.7 | 11.5 | 11.2 | 11.1 | 10.2 | 8.9 | 8.6 | 10.5 | 9.8 |
| 9 | 48.8 | 48.3 | 37.4 | 61.9 | 33.3 | 41.7 | 40.6 | 62.0 | 50.6 | 40.0 | 49.3 | 43.1 | 51.4 |
| 10 | 1.1 | 2.5 | 1.7 | 1.8 | 2.3 | 2.3 | 2.2 | 2.3 | 3.1 | 1.7 | 1.8 | 1.6 | 2.2 |
| 11 | 78.9 | 66.1 | 68.5 | 53.4 | 68.3 | 74.2 | 58.3 | 62.2 | 68.3 | 35.4 | 38.3 | 56.1 | 42.7 |
| 12 | 62.4 | 64.1 | 65.2 | 58.9 | 63.0 | 70.5 | 60.9 | 58.1 | 60.4 | 52.8 | 53.0 | 64.6 | 56.0 |

Table 14. Provided are the values of each of the parameters (as described above) measured in barley accessions (line, "L") under normal growth conditions. Growth conditions are specified in the experimental procedure section.

TABLE 15

Correlation between the expression level of WNU selected genes of some embodiments of the invention in various tissues and the phenotypic performance under normal fertilization conditions across barley accessions

| Gene Name | R | P value | Exp. set | Cor. Set ID | Gene Name | R | P value | Exp. set | Cor. Set ID |
|---|---|---|---|---|---|---|---|---|---|
| LAB446 | 0.748 | 2.05E−02 | 1 | 3 | LYM82 | 0.830 | 5.62E−03 | 3 | 6 |
| LYM82 | 0.785 | 4.24E−03 | 3 | 8 | LYM82 | 0.815 | 2.22E−03 | 3 | 7 |
| LYM82 | 0.864 | 6.09E−04 | 3 | 11 | LYM82 | 0.888 | 1.40E−03 | 3 | 12 |
| WNU10 | 0.721 | 4.36E−02 | 2 | 4 | WNU10 | 0.894 | 2.72E−03 | 3 | 9 |
| WNU11 | 0.711 | 4.79E−02 | 1 | 9 | WNU11 | 0.758 | 1.79E−02 | 3 | 2 |
| WNU11 | 0.749 | 7.95E−03 | 3 | 1 | WNU12 | 0.862 | 2.83E−03 | 1 | 2 |
| WNU12 | 0.812 | 7.80E−03 | 1 | 1 | WNU12 | 0.808 | 1.52E−02 | 3 | 9 |
| WNU13 | 0.788 | 1.16E−02 | 1 | 2 | WNU13 | 0.826 | 6.06E−03 | 1 | 1 |
| WNU14 | 0.809 | 2.56E−03 | 3 | 9 | WNU15 | 0.784 | 2.14E−02 | 1 | 9 |
| WNU16 | 0.811 | 4.43E−03 | 2 | 6 | WNU16 | 0.753 | 3.12E−02 | 2 | 12 |
| WNU16 | 0.766 | 9.84E−03 | 2 | 5 | WNU16 | 0.843 | 4.35E−03 | 3 | 2 |
| WNU16 | 0.869 | 2.38E−03 | 3 | 1 | WNU17 | 0.833 | 1.02E−02 | 2 | 3 |
| WNU17 | 0.796 | 1.02E−02 | 3 | 11 | WNU17 | 0.765 | 1.64E−02 | 3 | 12 |
| WNU18 | 0.882 | 1.64E−03 | 1 | 2 | WNU18 | 0.866 | 2.52E−03 | 1 | 1 |
| WNU19 | 0.807 | 1.54E−02 | 2 | 4 | WNU20 | 0.768 | 9.43E−03 | 2 | 4 |
| WNU20 | 0.744 | 3.45E−02 | 3 | 9 | WNU23 | 0.930 | 2.83E−04 | 1 | 5 |
| WNU26 | 0.901 | 8.96E−04 | 3 | 4 | WNU27 | 0.733 | 2.47E−02 | 1 | 5 |
| WNU29 | 0.810 | 8.14E−03 | 1 | 5 | WNU29 | 0.840 | 4.61E−03 | 3 | 2 |
| WNU29 | 0.802 | 9.37E−03 | 3 | 1 | WNU31 | 0.768 | 9.48E−03 | 2 | 2 |
| WNU31 | 0.725 | 4.18E−02 | 2 | 1 | WNU31 | 0.759 | 2.89E−02 | 2 | 7 |
| WNU33 | 0.767 | 2.63E−02 | 2 | 5 | WNU33 | 0.790 | 3.80E−03 | 3 | 2 |
| WNU34 | 0.833 | 1.02E−02 | 3 | 9 | WNU35 | 0.756 | 3.02E−02 | 2 | 4 |
| WNU35 | 0.887 | 3.32E−03 | 3 | 9 | WNU36 | 0.723 | 1.19E−02 | 3 | 9 |
| WNU37 | 0.727 | 4.08E−02 | 1 | 9 | WNU38 | 0.705 | 2.28E−02 | 2 | 4 |
| WNU39 | 0.800 | 9.62E−03 | 1 | 7 | WNU39 | 0.763 | 2.77E−02 | 3 | 9 |
| WNU39 | 0.712 | 3.14E−02 | 3 | 3 | WNU40 | 0.707 | 3.34E−02 | 1 | 2 |
| WNU40 | 0.800 | 1.71E−02 | 2 | 5 | WNU40 | 0.728 | 2.62E−02 | 3 | 12 |
| WNU44 | 0.809 | 8.22E−03 | 1 | 2 | WNU44 | 0.827 | 5.92E−03 | 1 | 1 |
| WNU44 | 0.786 | 1.21E−02 | 1 | 7 | WNU44 | 0.757 | 1.83E−02 | 1 | 5 |
| WNU44 | 0.827 | 1.12E−02 | 3 | 9 | WNU8 | 0.825 | 1.18E−02 | 2 | 4 |
| WNU8 | 0.776 | 1.39E−02 | 3 | 12 | WNU9 | 0.852 | 7.23E−03 | 2 | 10 |

Table 15. "Corr. ID"—correlation set ID according to the correlated parameters Table above.
"Exp. Set"—Expression set.
"R" = Pearson correlation coefficient;
"P" = p value.

Example 6

Production of Barley Transcriptome and High Throughput Correlation Analysis Using 60K Barley Oligonucleotide Micro-Array In order to produce a high throughput correlation analysis comparing between plant phenotype and gene expression level, the present inventors utilized a Barley oligonucleotide micro-array, produced by Agilent Technologies [chem. (dot) agilent (dot) com/Scripts/PDS (dot) asp?1Page=50879]. The array oligonucleotide represents about 60K Barley genes and transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

15 Barley accessions in 5 repetitive blocks, each containing 5 plants per pot were grown at net house. Three different treatments were applied: plants were regularly fertilized and watered during plant growth until harvesting (as recommended for commercial growth, plants were irrigated 2-3 times a week, and fertilization was given in the first 1.5 months of the growth period) or under low Nitrogen (80% percent less Nitrogen) or under drought stress (cycles of drought and re-irrigating were conducted throughout the whole experiment, overall 40% less water were given in the drought treatment).

Analyzed Barley tissues Five tissues at different developmental stages [leaf, stem, root tip and adventitious root, flower], representing different plant characteristics, were sampled and RNA was extracted as described above. Each micro-array expression information tissue type has received a Set ID as summarized in Table 16 below.

TABLE 16

Barley transcriptome expression sets of vegetative developmental stage

| Expression Set | Set ID |
|---|---|
| adv root T3 low N | 1 |
| adv root T3 normal | 2 |
| leaf T3 low N | 3 |
| leaf T3 low normal | 4 |
| root tip T3 low N | 5 |
| root tip T3 normal | 6 |

Table 16. Provided are the barley transcriptome expression sets.

TABLE 17

Barley transcriptome expression sets of reproductive developmental stage

| Expression Set | Set ID |
|---|---|
| booting spike: low N: | 1 |
| booting spike: normal: | 2 |
| leaf: low N: | 3 |
| leaf: normal: | 4 |
| stem: low N: | 5 |
| stem: normal: | 6 |

Table 17. Provided are the barley transcriptome expression sets.

Barley yield components and vigor related parameters assessment—Plants were phenotyped on a daily basis following the parameters listed in Table 18 below. Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

Grain yield (gr.)—At the end of the experiment all spikes of the pots were collected. The total grains from all spikes that were manually threshed were weighted. The grain yield was calculated by per plot or per plant.

Spike length and width analysis—At the end of the experiment the length and width of five chosen spikes per plant were measured using measuring tape excluding the awns.

Spike number analysis—The spikes per plant were counted.

Plant height—Each of the plants was measured for its height using measuring tape. Height was measured from ground level to top of the longest spike excluding awns at two time points at the Vegetative growth (30 days after sowing) and at harvest.

Spike weight—The biomass and spikes weight of each plot was separated, measured and divided by the number of plants.

Dry weight=total weight of the vegetative portion above ground (excluding roots) after drying at 70° C. in oven for 48 hours at two time points at the Vegetative growth (30 days after sowing) and at harvest.

Spikelet per spike=number of spikelets per spike was counted.

Root/Shoot Ratio—The Root/Shoot Ratio was calculated using Formula XXII above.

Total No. of tillers—all tillers were counted per plot at two time points at the Vegetative growth (30 days after sowing) and at harvest.

Percent of reproductive tillers—the number of reproductive tillers barring a spike at harvest was divided by the total numbers of tillers.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—3 plants per plot were selected for measurement of root weight, root length and for counting the number of lateral roots formed.

Shoot FW (fresh weight)—weight of 3 plants per plot were recorded at different time-points.

Average Grain Area ($cm^2$)—At the end of the growing period the grains were separated from the spike. A sample of ~200 grains was weighted, photographed and images were processed using the below described image processing system. The grain area was measured from those images and was divided by the number of grains.

Average Grain Length and width (cm)—At the end of the growing period the grains were separated from the spike. A sample of ~200 grains was weighted, photographed and images were processed using the below described image processing system. The sum of grain lengths or width (longest axis) was measured from those images and was divided by the number of grains.

Average Grain perimeter (cm)—At the end of the growing period the grains were separated from the spike. A sample of ~200 grains was weighted, photographed and images were processed using the below described image processing system. The sum of grain perimeter was measured from those images and was divided by the number of grains.

Heading date—the day in which booting stage was observed was recorded and number of days from sowing to heading was calculated.

Relative water content—Fresh weight (FW) of three leaves from three plants each from different seed ID was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) is calculated according to Formula I above.

Harvest Index (for barley)—The harvest index was calculated using Formula XVIII above.

Growth rate: the growth rate (GR) of Plant Height (Formula III above), SPAD (Formula IV above) and number of tillers (Formula V above) were calculated using the indicated Formulas.

Ratio low N/Normal: Represents ratio for the specified parameter of low N condition results divided by Normal conditions results (maintenance of phenotype under low N in comparison to normal conditions).

TABLE 18

Barley correlated parameters (vectors)

| Correlated parameter with | Correlation ID |
|---|---|
| Lateral Roots | 1 |
| Lateral Roots NUE ratio | 2 |
| Leaf Area [$cm^2$] | 3 |
| Leaf Area NUE ratio | 4 |
| Leaf Length [cm] | 5 |
| Leaf Length NUE ratio | 6 |
| Num Leaves | 7 |
| Num Leaves NUE ratio | 8 |
| Num Seeds | 9 |
| Num Seeds NUE ratio | 10 |
| Num Spikes | 11 |
| Num Spikes NUE ratio | 12 |
| Num Tillers | 13 |
| Plant Height [cm] | 14 |
| Plant Height NUE ratio | 15 |
| Root FW [gr] | 16 |
| Root FW NUE ratio | 17 |

TABLE 18-continued

Barley correlated parameters (vectors)

| Correlated parameter with | Correlation ID |
|---|---|
| Root Length [cm] | 18 |
| Root Length NUE ratio | 19 |
| SPAD | 20 |
| SPAD NUE ratio | 21 |
| Seed Yield [gr] | 22 |
| Seed Yield NUE ratio | 23 |
| Shoot FW [gr] | 24 |
| Shoot FW NUE ratio | 25 |
| Spike Length [cm] | 26 |
| Spike Length NUE ratio | 27 |
| Spike Width [mm] | 28 |
| Spike Width NUE ratio | 29 |
| Spike weight [gr] | 30 |
| Spike weight NUE ratio | 31 |
| Tiller survival NUE | 32 |
| Tiller survival NUE ratio | 33 |
| Tiller survival Normal | 34 |
| Total Tillers | 35 |
| Total Tillers NUE ratio | 36 |

Table 18. Provided are the barley correlated parameters.

Experimental Results 15 different Barley accessions were grown and characterized for different parameters as described above. Table 18 describes the Barley correlated parameters. The average for each of the measured parameter was calculated using the JMP software and values are summarized in Tables 19-20 below. Subsequent correlation analysis between the various transcriptome sets and the average parameters was conducted (Table 21). Follow, results were integrated to the database.

TABLE 19

Measured parameters of correlation IDs in Barley accessions under normal conditions

| Line ID/ Corr. ID | L-1 | L-2 | L-3 | L-4 | L-5 | L-6 | L-7 | L-8 | L-9 | L-10 | L-11 | L-12 | L-13 | L-14 | L-15 |
|---|---|---|---|---|---|---|---|---|---|---|---|---|---|---|---|
| 1 | 7.0 | 7.0 | 8.3 | 6.3 | 8.0 | 8.7 | 8.7 | 8.3 | 9.7 | 10.7 | 9.7 | 9.7 | 8.7 | 10.0 | 9.7 |
| 3 | 294.0 | 174.0 | 309.5 | 75.1 | 317.6 | 305.1 | 198.6 | 273.0 | 275.6 | 313.5 | 308.5 | 258.8 | 291.1 | 299.4 | 296.1 |
| 5 | 501.5 | 386.4 | 478.3 | 278.5 | 496.7 | 467.6 | 348.0 | 498.5 | 593.7 | 534.5 | 550.9 | 479.0 | 399.3 | 384.3 | 469.6 |
| 7 | 24.2 | 22.0 | 19.5 | 20.2 | 21.4 | 20.8 | 18.2 | 22.7 | 25.5 | 23.2 | 28.3 | 22.2 | 19.0 | 17.3 | 22.0 |
| 9 | 1093.5 | 263.3 | 987.8 | 157.7 | 972.6 | 683.4 | 510.5 | 242.4 | 581.8 | 621.0 | 1069.0 | 903.2 | 949.9 | 984.2 | 767.6 |
| 11 | 41.5 | 48.0 | 30.0 | 54.7 | 27.6 | 38.6 | 32.0 | 36.0 | 71.4 | 34.2 | 45.6 | 49.8 | 28.0 | 19.3 | 38.0 |
| 13 | 2.0 | 1.3 | 2.3 | 2.0 | 1.3 | 2.3 | 2.0 | 1.0 | 2.3 | 2.3 | 3.3 | 2.3 | 1.3 | 1.3 | 1.7 |
| 14 | 64.7 | 52.8 | 68.0 | 44.0 | 76.2 | 76.4 | 84.0 | 67.4 | 82.0 | 72.0 | 56.6 | 65.8 | 62.8 | 91.6 | 66.2 |
| 16 | 0.3 | 0.0 | 0.0 | 0.4 | 0.5 | 0.2 | 0.3 | 0.3 | 0.4 | 0.6 | 0.3 | 0.4 | 0.3 | 0.2 | 0.3 |
| 18 | 21.3 | 15.2 | 14.0 | 17.4 | 27.8 | 14.3 | 15.0 | 21.8 | 20.3 | 27.2 | 16.0 | 24.0 | 13.5 | 21.5 | 15.2 |
| 20 | 39.1 | 32.5 | 36.5 | 36.5 | 36.7 | 39.2 | 41.4 | 35.2 | 33.7 | 34.2 | 42.8 | 37.0 | 36.9 | 35.0 | 36.8 |
| 22 | 46.4 | 5.7 | 39.7 | 3.7 | 42.4 | 33.2 | 19.8 | 10.8 | 22.6 | 30.3 | 54.1 | 37.0 | 42.0 | 35.4 | 38.3 |
| 24 | 2.2 | 1.6 | 2.5 | 1.3 | 2.1 | 1.9 | 1.9 | 1.3 | 3.0 | 15.6 | 3.0 | 2.6 | 1.8 | 2.2 | 1.8 |
| 26 | 16.5 | 15.9 | 19.8 | 13.1 | 17.0 | 19.3 | 19.2 | 18.3 | 20.4 | 17.2 | 19.1 | 20.3 | 21.7 | 16.5 | 16.1 |
| 28 | 9.5 | 5.8 | 10.0 | 4.3 | 10.0 | 9.0 | 9.1 | 8.3 | 6.6 | 10.5 | 8.8 | 7.4 | 10.4 | 10.2 | 10.4 |
| 30 | 69.4 | 21.7 | 63.5 | 16.9 | 60.1 | 69.8 | 39.4 | 34.9 | 50.3 | 60.8 | 79.1 | 62.7 | 60.0 | 55.9 | 59.7 |
| 34 | 0.9 | NA | 0.9 | 2.1 | 1.0 | 0.9 | 0.8 | 0.9 | 1.5 | 1.0 | 0.9 | 1.0 | 1.0 | 0.7 | 1.0 |
| 35 | 46.7 | NA | 32.4 | 26.0 | 28.5 | 44.3 | 41.6 | 40.0 | 48.8 | 34.6 | 48.6 | 49.2 | 29.0 | 27.5 | 38.8 |

Table 19. Provided are the values of each of the parameters (as described above) measured in Barley accessions (line, "L") under growth conditions as described above. Growth conditions are specified in the experimental procedure section.

TABLE 20

Measured parameters of correlation IDs in Barley accessions under low N conditions

| Line ID/ Corr. ID | L-1 | L-2 | L-3 | L-4 | L-5 | L-6 | L-7 | L-8 | L-9 | L-10 | L-11 | L-12 | L-13 | L-14 | L-15 |
|---|---|---|---|---|---|---|---|---|---|---|---|---|---|---|---|
| 1 | 5.0 | 5.0 | 6.7 | 4.3 | 5.3 | 5.3 | 6.0 | 4.3 | 6.0 | 6.3 | 6.0 | 6.7 | 4.7 | 5.7 | 7.3 |
| 2 | 0.7 | 0.7 | 0.8 | 0.7 | 0.7 | 0.6 | 0.7 | 0.5 | 0.6 | 0.6 | 0.6 | 0.7 | 0.5 | 0.6 | 0.8 |
| 3 | 39.4 | 49.9 | 54.1 | 37.0 | 74.8 | 53.0 | 46.3 | 51.5 | 57.1 | 67.8 | 64.2 | 52.4 | 46.2 | 68.0 | 57.9 |
| 4 | 0.1 | 0.3 | 0.2 | 0.5 | 0.2 | 0.2 | 0.2 | 0.2 | 0.2 | 0.2 | 0.2 | 0.2 | 0.2 | 0.2 | 0.2 |
| 5 | 102.9 | 128.5 | 135.9 | 120.3 | 148.0 | 123.7 | 107.8 | 111.6 | 142.4 | 152.4 | 149.3 | 124.1 | 95.0 | 124.1 | 135.2 |
| 6 | 0.2 | 0.3 | 0.3 | 0.4 | 0.3 | 0.3 | 0.3 | 0.2 | 0.2 | 0.3 | 0.3 | 0.3 | 0.2 | 0.3 | 0.3 |
| 7 | 8.0 | 10.0 | 10.7 | 9.7 | 8.6 | 9.2 | 8.0 | 7.5 | 8.5 | 10.0 | 11.5 | 8.6 | 6.3 | 7.5 | 10.0 |
| 8 | 0.3 | 0.5 | 0.5 | 0.5 | 0.4 | 0.4 | 0.4 | 0.3 | 0.3 | 0.4 | 0.4 | 0.4 | 0.3 | 0.4 | 0.5 |
| 9 | 230.2 | 61.6 | 159.4 | 65.8 | 139.6 | 153.2 | 164.6 | 88.3 | 133.6 | 106.0 | 222.6 | 219.2 | 143.5 | 201.8 | 125.0 |
| 10 | 0.2 | 0.2 | 0.2 | 0.4 | 0.1 | 0.2 | 0.3 | 0.4 | 0.2 | 0.2 | 0.2 | 0.2 | 0.2 | 0.2 | 0.2 |
| 11 | 12.2 | 12.0 | 8.4 | 16.4 | 7.6 | 10.8 | 9.0 | 11.6 | 25.0 | 7.8 | 14.5 | 15.0 | 7.0 | 5.4 | 8.4 |
| 12 | 0.3 | 0.3 | 0.3 | 0.3 | 0.3 | 0.3 | 0.3 | 0.3 | 0.4 | 0.2 | 0.3 | 0.3 | 0.3 | 0.3 | 0.2 |
| 14 | 41.0 | 57.4 | 60.6 | 69.0 | 65.6 | 75.2 | 82.0 | 61.4 | 59.4 | 65.8 | 47.8 | 53.8 | 56.4 | 81.8 | 44.6 |
| 15 | 20.5 | 43.1 | 26.0 | 34.5 | 49.2 | 32.2 | 41.0 | 61.4 | 25.5 | 28.2 | 14.3 | 23.1 | 42.3 | 61.4 | 26.8 |
| 16 | 0.4 | 0.1 | 0.6 | 0.1 | 0.3 | 0.4 | 0.2 | 0.1 | 0.4 | 0.9 | 0.5 | 0.4 | 0.0 | 0.3 | 0.6 |
| 17 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 |
| 18 | 24.7 | 17.2 | 24.5 | 18.8 | 21.0 | 21.7 | 21.7 | 22.0 | 21.7 | 22.2 | 23.0 | 30.5 | 22.8 | 23.8 | 24.5 |
| 19 | 92.5 | 85.8 | 105.0 | 51.4 | 46.7 | 92.9 | 81.3 | 88.0 | 61.9 | 35.9 | 86.3 | 87.1 | 72.1 | 102.1 | 91.9 |
| 20 | 24.0 | 18.6 | 23.0 | 22.0 | 24.5 | 25.6 | 23.3 | 26.5 | 23.9 | 26.6 | 23.2 | 25.4 | 24.2 | 25.0 | 26.1 |
| 21 | 11.1 | 11.7 | 9.2 | 17.6 | 11.9 | 13.6 | 12.3 | 21.2 | 8.0 | 1.7 | 7.7 | 9.8 | 13.8 | 11.5 | 14.3 |

TABLE 20-continued

Measured parameters of correlation IDs in Barley accessions under low N conditions

| Line ID/Corr. ID | L-1 | L-2 | L-3 | L-4 | L-5 | L-6 | L-7 | L-8 | L-9 | L-10 | L-11 | L-12 | L-13 | L-14 | L-15 |
|---|---|---|---|---|---|---|---|---|---|---|---|---|---|---|---|
| 22 | 9.8 | 1.1 | 6.4 | 1.4 | 6.7 | 6.7 | 7.3 | 3.3 | 5.1 | 6.0 | 9.7 | 7.4 | 5.8 | 7.8 | 6.3 |
| 23 | 0.5 | 0.1 | 0.5 | 0.1 | 0.2 | 0.5 | 0.5 | 0.2 | 0.2 | 0.2 | 0.6 | 0.3 | 0.4 | 0.4 | 0.4 |
| 24 | 0.4 | 0.2 | 0.5 | 0.3 | 0.4 | 0.6 | 0.4 | 0.3 | 0.6 | 0.8 | 0.5 | 0.5 | 0.4 | 0.5 | 0.6 |
| 25 | 0.0 | 0.0 | 0.0 | 0.1 | 0.0 | 0.0 | 0.0 | 0.0 | 0.0 | 0.0 | 0.0 | 0.0 | 0.0 | 0.0 | 0.0 |
| 26 | 15.2 | 15.0 | 20.3 | 12.4 | 16.8 | 18.9 | 19.6 | 16.3 | 19.3 | 90.2 | 16.4 | 20.4 | 18.8 | 18.8 | 16.7 |
| 27 | 0.4 | 0.5 | 0.6 | 0.3 | 0.5 | 0.5 | 0.5 | 0.5 | 0.6 | 2.6 | 0.4 | 0.6 | 0.5 | 0.5 | 0.5 |
| 28 | 8.0 | 7.6 | 8.4 | 6.2 | .1 | 9.1 | 8.1 | 9.4 | 4.9 | 9.6 | 7.2 | 7.1 | 8.5 | 10.0 | 9.4 |
| 29 | 0.1 | 0.4 | 0.1 | 0.4 | 0.2 | 0.1 | 0.2 | 0.3 | 0.1 | 0.2 | 0.1 | 0.1 | 0.1 | 0.2 | 0.2 |
| 30 | 13.7 | 5.0 | 11.6 | 5.7 | 12.4 | 11.4 | 13.4 | 9.2 | 11.6 | 11.3 | 15.1 | 12.2 | 11.0 | 12.2 | 10.6 |
| 31 | 0.8 | 0.3 | 0.6 | 0.4 | 0.7 | 0.6 | 0.7 | 0.5 | 0.6 | 0.7 | 0.8 | 0.6 | 0.5 | 0.7 | 0.37 |
| 32 | 0.8 | NA | 0.7 | 0.5 | 0.7 | 0.7 | 0.6 | 0.7 | 1.2 | 0.6 | 0.8 | 0.7 | 0.6 | 0.8 | 0.6 |
| 33 | 0.8 | NA | 0.8 | 0.2 | 0.7 | 0.8 | 0.8 | 0.8 | 0.8 | 0.6 | 0.8 | 0.7 | 0.7 | 1.1 | 0.6 |
| 35 | 16.2 | NA | 12.0 | 35.0 | 10.8 | 16.0 | 14.6 | 16.0 | 20.8 | 12.5 | 18.8 | 21.2 | 11.0 | 6.8 | 14.0 |
| 36 | 1.7 | NA | 1.2 | 8.1 | 1.1 | 1.8 | 1.6 | 1.9 | 3.2 | 1.2 | 2.1 | 2.9 | 1.1 | 0.7 | 1.4 |

Table 20.

TABLE 21

Correlation between the expression level of selected genes of some embodiments of the invention in various tissues and the phenotypic performance under normal or low nitrogen fertilization conditions across barley accessions (vegetative developmental stages)

| Gene Name | R | P value | Exp. set | Cor. Set ID | Gene Name | R | P value | Exp. set | Cor. Set ID |
|---|---|---|---|---|---|---|---|---|---|
| LAB21 | 0.848 | 3.91E−03 | 1 | 10 | LAB21 | 0.711 | 3.17E−02 | 1 | 12 |
| LAB21 | 0.826 | 3.25E−03 | 5 | 33 | LAB446 | 0.788 | 1.16E−02 | 1 | 10 |
| LAB446 | 0.723 | 1.82E−02 | 5 | 31 | LAB446 | 0.849 | 3.76E−03 | 3 | 27 |
| LAB446 | 0.859 | 3.04E−03 | 3 | 26 | LYM316 | 0.731 | 3.94E−02 | 6 | 13 |
| LYM316 | 0.758 | 1.10E−02 | 5 | 18 | LYM316 | 0.711 | 3.16E−02 | 2 | 13 |
| LYM316 | 0.865 | 2.61E−03 | 3 | 27 | LYM316 | 0.901 | 9.04E−04 | 3 | 17 |
| LYM316 | 0.867 | 2.47E−03 | 3 | 26 | LYM316 | 0.894 | 1.13E−03 | 3 | 18 |
| LYM316 | 0.833 | 5.35E−03 | 3 | 24 | LYM316 | 0.900 | 9.58E−04 | 3 | 16 |
| LYM82 | 0.873 | 2.14E−03 | 1 | 12 | LYM82 | 0.722 | 1.84E−02 | 5 | 32 |
| LYM82 | 0.761 | 1.73E−02 | 2 | 16 | WNU10 | 0.789 | 1.99E−02 | 6 | 20 |
| WNU10 | 0.734 | 2.44E−02 | 1 | 28 | WNU10 | 0.801 | 5.33E−03 | 5 | 2 |
| WNU10 | 0.718 | 2.95E−02 | 2 | 20 | WNU10 | 0.707 | 3.31E−02 | 3 | 14 |
| WNU11 | 0.781 | 2.21E−02 | 6 | 26 | WNU11 | 0.810 | 8.10E−03 | 1 | 11 |
| WNU11 | 0.865 | 2.63E−03 | 1 | 32 | WNU11 | 0.714 | 2.04E−02 | 5 | 20 |
| WNU11 | 0.734 | 2.43E−02 | 3 | 27 | WNU11 | 0.734 | 2.43E−02 | 3 | 26 |
| WNU12 | 0.754 | 1.90E−02 | 2 | 1 | WNU12 | 0.750 | 1.99E−02 | 3 | 21 |
| WNU13 | 0.706 | 2.25E−02 | 5 | 17 | WNU13 | 0.713 | 2.07E−02 | 5 | 24 |
| WNU13 | 0.759 | 1.09E−02 | 5 | 16 | WNU13 | 0.709 | 2.18E−02 | 5 | 5 |
| WNU13 | 0.824 | 6.34E−03 | 3 | 6 | WNU13 | 0.854 | 3.39E−03 | 3 | 4 |
| WNU13 | 0.806 | 8.69E−03 | 3 | 8 | WNU14 | 0.852 | 3.52E−03 | 1 | 18 |
| WNU14 | 0.793 | 1.08E−02 | 3 | 31 | WNU15 | 0.767 | 1.59E−02 | 3 | 1 |
| WNU15 | 0.736 | 2.39E−02 | 3 | 5 | WNU16 | 0.868 | 5.16E−03 | 6 | 16 |
| WNU16 | 0.735 | 1.54E−02 | 5 | 7 | WNU16 | 0.752 | 1.21E−02 | 5 | 1 |
| WNU16 | 0.827 | 3.17E−03 | 5 | 17 | WNU16 | 0.818 | 3.79E−03 | 5 | 24 |
| WNU16 | 0.842 | 2.23E−03 | 5 | 16 | WNU17 | 0.721 | 1.85E−02 | 5 | 31 |
| WNU17 | 0.744 | 1.35E−02 | 5 | 1 | WNU17 | 0.842 | 2.26E−03 | 5 | 2 |
| WNU17 | 0.719 | 1.92E−02 | 5 | 24 | WNU17 | 0.741 | 1.42E−02 | 5 | 16 |
| WNU18 | 0.760 | 1.74E−02 | 2 | 9 | WNU18 | 0.777 | 1.37E−02 | 2 | 30 |
| WNU18 | 0.735 | 2.42E−02 | 2 | 22 | WNU19 | 0.773 | 2.44E−02 | 6 | 35 |
| WNU19 | 0.776 | 2.37E−02 | 6 | 7 | WNU19 | 0.836 | 9.78E−03 | 6 | 18 |
| WNU19 | 0.726 | 2.69E−02 | 1 | 18 | WNU19 | 0.817 | 3.90E−03 | 5 | 35 |
| WNU19 | 0.732 | 1.60E−02 | 5 | 11 | WNU19 | 0.825 | 3.29E−03 | 5 | 36 |
| WNU19 | 0.771 | 1.51E−02 | 2 | 35 | WNU19 | 0.756 | 1.85E−02 | 2 | 11 |
| WNU19 | 0.730 | 2.54E−02 | 3 | 35 | WNU19 | 0.736 | 2.37E−02 | 3 | 29 |
| WNU19 | 0.861 | 2.88E−03 | 3 | 21 | WNU19 | 0.802 | 9.28E−03 | 3 | 36 |
| WNU19 | 0.722 | 2.81E−02 | 3 | 18 | WNU20 | 0.738 | 3.67E−02 | 6 | 35 |
| WNU20 | 0.779 | 1.34E−02 | 2 | 35 | WNU20 | 0.943 | 1.40E−04 | 3 | 27 |
| WNU20 | 0.943 | 1.35E−04 | 3 | 26 | WNU20 | 0.782 | 1.27E−02 | 3 | 24 |
| WNU20 | 0.766 | 1.60E−02 | 3 | 16 | WNU21 | 0.813 | 1.41E−02 | 6 | 34 |
| WNU21 | 0.710 | 4.86E−02 | 6 | 11 | WNU21 | 0.709 | 3.24E−02 | 1 | 3 |
| WNU21 | 0.724 | 1.80E−02 | 5 | 32 | WNU21 | 0.750 | 1.99E−02 | 2 | 18 |
| WNU21 | 0.878 | 1.83E−03 | 2 | 24 | WNU21 | 0.937 | 1.90E−04 | 2 | 16 |
| WNU21 | 0.739 | 2.30E−02 | 3 | 7 | WNU21 | 0.709 | 3.23E−02 | 3 | 2 |
| WNU21 | 0.803 | 9.20E−03 | 3 | 17 | WNU21 | 0.827 | 5.91E−03 | 3 | 24 |
| WNU21 | 0.821 | 6.69E−03 | 3 | 16 | WNU22 | 0.797 | 1.01E−02 | 3 | 7 |
| WNU22 | 0.815 | 7.44E−03 | 3 | 27 | WNU22 | 0.870 | 2.32E−03 | 3 | 17 |
| WNU22 | 0.820 | 6.78E−03 | 3 | 26 | WNU22 | 0.947 | 1.06E−04 | 3 | 24 |

TABLE 21-continued

Correlation between the expression level of selected genes of some embodiments of the invention in various tissues and the phenotypic performance under normal or low nitrogen fertilization conditions across barley accessions (vegetative developmental stages)

| Gene Name | R | P value | Exp. set | Cor. Set ID | Gene Name | R | P value | Exp. set | Cor. Set ID |
|---|---|---|---|---|---|---|---|---|---|
| WNU22 | 0.926 | 3.32E−04 | 3 | 16 | WNU22 | 0.737 | 2.34E−02 | 3 | 5 |
| WNU23 | 0.736 | 2.39E−02 | 1 | 1 | WNU23 | 0.837 | 4.93E−03 | 2 | 20 |
| WNU25 | 0.754 | 3.05E−02 | 6 | 20 | WNU25 | 0.880 | 1.75E−03 | 2 | 35 |
| WNU26 | 0.704 | 3.41E−02 | 2 | 9 | WNU26 | 0.873 | 2.13E−03 | 3 | 9 |
| WNU27 | 0.891 | 2.97E−03 | 6 | 35 | WNU27 | 0.857 | 6.60E−03 | 6 | 11 |
| WNU27 | 0.797 | 1.77E−02 | 6 | 7 | WNU27 | 0.711 | 4.80E−02 | 6 | 24 |
| WNU27 | 0.756 | 3.01E−02 | 6 | 13 | WNU27 | 0.850 | 7.56E−03 | 6 | 5 |
| WNU27 | 0.808 | 8.45E−03 | 3 | 7 | WNU27 | 0.730 | 2.56E−02 | 3 | 24 |
| WNU28 | 0.931 | 2.69E−04 | 1 | 10 | WNU28 | 0.839 | 4.73E−03 | 1 | 29 |
| WNU28 | 0.736 | 2.38E−02 | 1 | 21 | WNU28 | 0.758 | 2.94E−02 | 6 | 24 |
| WNU29 | 0.744 | 3.41E−02 | 6 | 13 | WNU29 | 0.856 | 1.59E−03 | 5 | 27 |
| WNU29 | 0.854 | 1.67E−03 | 5 | 17 | WNU29 | 0.850 | 1.83E−03 | 5 | 26 |
| WNU29 | 0.814 | 4.14E−03 | 5 | 24 | WNU29 | 0.912 | 2.41E−04 | 5 | 16 |
| WNU29 | 0.752 | 1.95E−02 | 2 | 35 | WNU29 | 0.804 | 8.95E−03 | 2 | 7 |
| WNU29 | 0.839 | 4.73E−03 | 3 | 27 | WNU29 | 0.723 | 2.78E−02 | 3 | 17 |
| WNU29 | 0.829 | 5.69E−03 | 3 | 26 | WNU29 | 0.866 | 2.51E−03 | 3 | 24 |
| WNU29 | 0.798 | 9.97E−03 | 3 | 16 | WNU30 | 0.790 | 1.97E−02 | 6 | 34 |
| WNU30 | 0.722 | 2.80E−02 | 1 | 33 | WNU30 | 0.713 | 3.09E−02 | 1 | 12 |
| WNU30 | 0.723 | 1.82E−02 | 5 | 33 | WNU30 | 0.720 | 1.89E−02 | 5 | 32 |
| WNU30 | 0.711 | 3.19E−02 | 2 | 34 | WNU30 | 0.814 | 7.53E−03 | 2 | 16 |
| WNU30 | 0.738 | 2.31E−02 | 3 | 4 | WNU31 | 0.758 | 2.93E−02 | 6 | 11 |
| WNU31 | 0.833 | 1.02E−02 | 6 | 7 | WNU31 | 0.764 | 2.74E−02 | 6 | 24 |
| WNU31 | 0.808 | 1.53E−02 | 6 | 5 | WNU31 | 0.700 | 3.56E−02 | 1 | 11 |
| WNU31 | 0.857 | 3.15E−03 | 1 | 18 | WNU31 | 0.807 | 4.73E−03 | 5 | 1 |
| WNU31 | 0.781 | 7.63E−03 | 5 | 33 | WNU31 | 0.849 | 3.83E−03 | 2 | 9 |
| WNU31 | 0.716 | 3.02E−02 | 2 | 1 | WNU31 | 0.718 | 2.95E−02 | 2 | 30 |
| WNU31 | 0.760 | 1.75E−02 | 2 | 22 | WNU31 | 0.840 | 4.57E−03 | 3 | 6 |
| WNU31 | 0.905 | 7.93E−04 | 3 | 11 | WNU31 | 0.704 | 3.41E−02 | 3 | 36 |
| WNU31 | 0.939 | 1.72E−04 | 3 | 32 | WNU31 | 0.708 | 3.30E−02 | 3 | 4 |
| WNU31 | 0.746 | 2.11E−02 | 3 | 3 | WNU31 | 0.816 | 7.37E−03 | 3 | 8 |
| WNU32 | 0.735 | 3.80E−02 | 6 | 20 | WNU33 | 0.749 | 2.01E−02 | 2 | 30 |
| WNU33 | 0.779 | 1.33E−02 | 2 | 13 | WNU33 | 0.789 | 1.15E−02 | 3 | 11 |
| WNU33 | 0.766 | 1.60E−02 | 3 | 36 | WNU34 | 0.708 | 3.30E−02 | 1 | 1 |
| WNU34 | 0.759 | 1.78E−02 | 1 | 2 | WNU34 | 0.715 | 3.05E−02 | 1 | 18 |
| WNU34 | 0.737 | 2.36E−02 | 2 | 9 | WNU34 | 0.840 | 4.62E−03 | 3 | 30 |
| WNU35 | 0.764 | 1.65E−02 | 1 | 2 | WNU35 | 0.719 | 2.89E−02 | 1 | 17 |
| WNU35 | 0.728 | 2.63E−02 | 1 | 20 | WNU35 | 0.729 | 2.60E−02 | 1 | 16 |
| WNU35 | 0.765 | 1.62E−02 | 2 | 9 | WNU35 | 0.759 | 1.77E−02 | 2 | 30 |
| WNU35 | 0.741 | 2.24E−02 | 2 | 22 | WNU35 | 0.719 | 2.90E−02 | 3 | 10 |
| WNU35 | 0.872 | 2.19E−03 | 3 | 21 | WNU35 | 0.756 | 1.84E−02 | 3 | 19 |
| WNU36 | 0.717 | 2.96E−02 | 1 | 18 | WNU36 | 0.731 | 2.54E−02 | 3 | 15 |
| WNU36 | 0.700 | 3.56E−02 | 3 | 33 | WNU37 | 0.827 | 1.14E−02 | 6 | 24 |
| WNU37 | 0.788 | 2.02E−02 | 6 | 16 | WNU37 | 0.731 | 3.96E−02 | 6 | 13 |
| WNU37 | 0.861 | 2.87E−03 | 1 | 18 | WNU37 | 0.850 | 3.70E−03 | 1 | 3 |
| WNU37 | 0.704 | 2.32E−02 | 5 | 7 | WNU37 | 0.773 | 8.73E−03 | 5 | 1 |
| WNU37 | 0.822 | 3.55E−03 | 5 | 2 | WNU37 | 0.750 | 1.25E−02 | 5 | 17 |
| WNU37 | 0.863 | 2.74E−03 | 3 | 27 | WNU37 | 0.715 | 3.03E−02 | 3 | 36 |
| WNU37 | 0.751 | 1.96E−02 | 3 | 17 | WNU37 | 0.861 | 2.84E−03 | 3 | 26 |
| WNU37 | 0.833 | 5.32E−03 | 3 | 19 | WNU37 | 0.735 | 2.41E−02 | 3 | 18 |
| WNU37 | 0.749 | 2.03E−02 | 3 | 24 | WNU37 | 0.791 | 1.11E−02 | 3 | 16 |
| WNU38 | 0.780 | 2.25E−02 | 6 | 35 | WNU38 | 0.758 | 2.93E−02 | 6 | 13 |
| WNU38 | 0.756 | 1.85E−02 | 1 | 28 | WNU38 | 0.778 | 8.04E−03 | 5 | 2 |
| WNU38 | 0.856 | 1.59E−03 | 5 | 17 | WNU38 | 0.800 | 5.48E−03 | 5 | 16 |
| WNU38 | 0.731 | 2.52E−02 | 3 | 28 | WNU38 | 0.725 | 2.70E−02 | 3 | 31 |
| WNU39 | 0.770 | 2.53E−02 | 6 | 7 | WNU39 | 0.886 | 3.38E−03 | 6 | 24 |
| WNU39 | 0.792 | 1.92E−02 | 6 | 30 | WNU39 | 0.869 | 5.13E−03 | 6 | 13 |
| WNU39 | 0.709 | 4.90E−02 | 6 | 22 | WNU39 | 0.837 | 2.50E−03 | 5 | 35 |
| WNU39 | 0.865 | 1.22E−03 | 5 | 11 | WNU39 | 0.922 | 1.47E−04 | 5 | 36 |
| WNU39 | 0.756 | 1.13E−02 | 5 | 12 | WNU39 | 0.790 | 1.13E−02 | 2 | 35 |
| WNU39 | 0.788 | 1.16E−02 | 2 | 13 | WNU39 | 0.781 | 1.30E−02 | 3 | 11 |
| WNU39 | 0.839 | 4.74E−03 | 3 | 32 | WNU40 | 0.868 | 1.14E−03 | 5 | 33 |
| WNU41 | 0.841 | 8.87E−03 | 6 | 9 | WNU41 | 0.894 | 2.75E−03 | 6 | 30 |
| WNU41 | 0.912 | 1.58E−03 | 6 | 22 | WNU41 | 0.890 | 1.29E−03 | 1 | 18 |
| WNU41 | 0.744 | 1.36E−02 | 5 | 21 | WNU41 | 0.748 | 1.28E−02 | 5 | 23 |
| WNU41 | 0.701 | 3.53E−02 | 3 | 35 | WNU41 | 0.798 | 9.91E−03 | 3 | 31 |
| WNU41 | 0.935 | 2.14E−04 | 3 | 11 | WNU41 | 0.838 | 4.80E−03 | 3 | 36 |
| WNU41 | 0.880 | 1.77E−03 | 3 | 32 | WNU42 | 0.749 | 2.02E−02 | 1 | 1 |
| WNU42 | 0.730 | 1.66E−02 | 5 | 10 | WNU42 | 0.787 | 6.85E−03 | 5 | 21 |
| WNU42 | 0.868 | 2.42E−03 | 2 | 20 | WNU42 | 0.846 | 4.05E−03 | 3 | 11 |
| WNU42 | 0.794 | 1.06E−02 | 3 | 32 | WNU43 | 0.785 | 1.21E−02 | 1 | 14 |
| WNU43 | 0.729 | 2.60E−02 | 1 | 15 | WNU43 | 0.990 | 3.52E−07 | 2 | 24 |
| WNU43 | 0.946 | 1.16E−04 | 2 | 16 | WNU44 | 0.715 | 3.04E−02 | 1 | 1 |
| WNU44 | 0.701 | 3.55E−02 | 1 | 2 | WNU44 | 0.701 | 2.39E−02 | 5 | 12 |

TABLE 21-continued

Correlation between the expression level of selected genes of some embodiments of the invention in various tissues and the phenotypic performance under normal or low nitrogen fertilization conditions across barley accessions (vegetative developmental stages)

| Gene Name | R | P value | Exp. set | Cor. Set ID | Gene Name | R | P value | Exp. set | Cor. Set ID |
|---|---|---|---|---|---|---|---|---|---|
| WNU44 | 0.819 | 6.97E−03 | 3 | 27 | WNU44 | 0.833 | 5.35E−03 | 3 | 26 |
| WNU44 | 0.756 | 1.85E−02 | 3 | 24 | WNU44 | 0.760 | 1.75E−02 | 3 | 16 |
| WNU8 | 0.705 | 5.07E−02 | 6 | 20 | WNU8 | 0.771 | 2.52E−02 | 6 | 30 |
| WNU8 | 0.787 | 2.04E−02 | 6 | 13 | WNU8 | 0.754 | 3.07E−02 | 6 | 22 |
| WNU8 | 0.732 | 2.50E−02 | 1 | 28 | WNU8 | 0.769 | 1.55E−02 | 1 | 15 |
| WNU8 | 0.812 | 7.80E−03 | 1 | 33 | WNU8 | 0.703 | 2.32E−02 | 5 | 27 |
| WNU8 | 0.857 | 1.54E−03 | 5 | 20 | WNU8 | 0.724 | 1.78E−02 | 5 | 18 |
| WNU8 | 0.703 | 3.45E−02 | 3 | 31 | WNU8 | 0.956 | 5.59E−05 | 3 | 30 |
| WNU8 | 0.782 | 1.28E−02 | 3 | 9 | WNU8 | 0.748 | 2.04E−02 | 3 | 23 |
| WNU8 | 0.860 | 2.94E−03 | 3 | 22 | WNU9 | 0.703 | 3.47E−02 | 3 | 35 |
| WNU9 | 0.709 | 3.26E−02 | 3 | 36 | WNU9 | 0.735 | 2.42E−02 | 3 | 9 |

Table 21. "Con. ID"—correlation set ID according to the correlated parameters Table above.
"Exp. Set"—Expression set.
"R" = Pearson correlation coefficient;
"P" = p value.

TABLE 22

Correlation between the expression level of selected genes of some embodiments of the invention in various tissues and the phenotypic performance under normal or low nitrogen fertilization conditions across barley accessions (reproductive developmental stages)

| Gene Name | R | P value | Exp. set | Corr. Set ID | Gene Name | R | P value | Exp. set | Corr. Set ID |
|---|---|---|---|---|---|---|---|---|---|
| LAB21 | 0.747 | 1.31E−02 | 2 | 34 | LAB21 | 0.725 | 1.77E−02 | 3 | 4 |
| LAB21 | 0.718 | 1.95E−02 | 3 | 3 | LAB21 | 0.712 | 2.08E−02 | 1 | 11 |
| LAB21 | 0.882 | 7.27E−04 | 1 | 32 | LAB446 | 0.709 | 2.17E−02 | 5 | 23 |
| LYM316 | 0.714 | 2.03E−02 | 6 | 13 | LYM316 | 0.760 | 1.07E−02 | 5 | 27 |
| LYM316 | 0.749 | 1.26E−02 | 5 | 26 | LYM316 | 0.802 | 5.23E−03 | 5 | 25 |
| LYM316 | 0.732 | 1.61E−02 | 4 | 13 | LYM82 | 0.781 | 7.64E−03 | 5 | 25 |
| LYM82 | 0.754 | 1.17E−02 | 5 | 24 | LYM82 | 0.725 | 1.76E−02 | 5 | 16 |
| WNU10 | 0.795 | 6.01E−03 | 6 | 13 | WNU10 | 0.865 | 1.23E−03 | 3 | 35 |
| WNU10 | 0.719 | 1.92E−02 | 3 | 11 | WNU10 | 0.823 | 3.44E−03 | 3 | 36 |
| WNU10 | 0.746 | 1.31E−02 | 5 | 35 | WNU10 | 0.772 | 8.87E−03 | 5 | 11 |
| WNU10 | 0.736 | 1.52E−02 | 5 | 36 | WNU11 | 0.780 | 7.81E−03 | 2 | 34 |
| WNU11 | 0.717 | 1.97E−02 | 2 | 18 | WNU11 | 0.827 | 3.19E−03 | 2 | 24 |
| WNU11 | 0.854 | 1.66E−03 | 2 | 16 | WNU11 | 0.724 | 1.79E−02 | 3 | 10 |
| WNU11 | 0.752 | 1.21E−02 | 3 | 11 | WNU11 | 0.736 | 1.53E−02 | 3 | 36 |
| WNU11 | 0.755 | 1.16E−02 | 3 | 32 | WNU11 | 0.747 | 1.30E−02 | 5 | 35 |
| WNU11 | 0.763 | 1.03E−02 | 5 | 15 | WNU11 | 0.922 | 1.44E−04 | 1 | 35 |
| WNU11 | 0.835 | 2.62E−03 | 1 | 11 | WNU11 | 0.778 | 8.09E−03 | 1 | 1 |
| WNU11 | 0.920 | 1.60E−04 | 1 | 36 | WNU12 | 0.813 | 4.25E−03 | 3 | 7 |
| WNU14 | 0.710 | 2.13E−02 | 3 | 6 | WNU14 | 0.770 | 9.23E−03 | 3 | 29 |
| WNU14 | 0.748 | 1.29E−02 | 3 | 3 | WNU14 | 0.801 | 5.38E−03 | 5 | 14 |
| WNU15 | 0.742 | 1.40E−02 | 3 | 7 | WNU15 | 0.773 | 8.71E−03 | 3 | 1 |
| WNU15 | 0.702 | 2.36E−02 | 1 | 11 | WNU16 | 0.798 | 5.67E−03 | 2 | 18 |
| WNU16 | 0.714 | 2.04E−02 | 2 | 16 | WNU16 | 0.759 | 1.09E−02 | 3 | 2 |
| WNU16 | 0.708 | 2.19E−02 | 4 | 24 | WNU16 | 0.841 | 2.28E−03 | 4 | 16 |
| WNU17 | 0.748 | 1.28E−02 | 2 | 34 | WNU17 | 0.766 | 9.81E−03 | 3 | 5 |
| WNU17 | 0.750 | 1.24E−02 | 4 | 16 | WNU17 | 0.878 | 8.26E−04 | 1 | 7 |
| WNU17 | 0.797 | 5.80E−03 | 1 | 17 | WNU17 | 0.710 | 2.15E−02 | 1 | 24 |
| WNU17 | 0.793 | 6.21E−03 | 1 | 16 | WNU17 | 0.764 | 1.01E−02 | 1 | 5 |
| WNU18 | 0.728 | 1.71E−02 | 6 | 34 | WNU18 | 0.859 | 1.45E−03 | 6 | 11 |
| WNU18 | 0.741 | 1.41E−02 | 6 | 5 | WNU19 | 0.732 | 1.61E−02 | 2 | 35 |
| WNU19 | 0.736 | 1.52E−02 | 2 | 11 | WNU19 | 0.708 | 2.20E−02 | 2 | 14 |
| WNU19 | 0.775 | 8.44E−03 | 2 | 3 | WNU19 | 0.728 | 1.69E−02 | 6 | 34 |
| WNU19 | 0.792 | 6.37E−03 | 6 | 11 | WNU19 | 0.756 | 1.14E−02 | 6 | 1 |
| WNU19 | 0.730 | 1.66E−02 | 6 | 24 | WNU19 | 0.767 | 9.66E−03 | 6 | 3 |
| WNU19 | 0.839 | 2.40E−03 | 3 | 35 | WNU19 | 0.864 | 1.28E−03 | 3 | 11 |
| WNU19 | 0.912 | 2.33E−04 | 3 | 36 | WNU19 | 0.798 | 5.65E−03 | 5 | 35 |
| WNU19 | 0.782 | 7.52E−03 | 5 | 11 | WNU19 | 0.723 | 1.81E−02 | 5 | 1 |
| WNU19 | 0.805 | 4.97E−03 | 5 | 36 | WNU19 | 0.710 | 2.15E−02 | 5 | 32 |
| WNU19 | 0.731 | 1.64E−02 | 4 | 34 | WNU19 | 0.848 | 1.91E−03 | 4 | 11 |
| WNU19 | 0.896 | 4.51E−04 | 1 | 35 | WNU19 | 0.873 | 9.85E−04 | 1 | 11 |
| WNU19 | 0.900 | 3.90E−04 | 1 | 27 | WNU19 | 0.902 | 3.63E−04 | 1 | 36 |
| WNU19 | 0.907 | 2.92E−04 | 1 | 26 | WNU19 | 0.756 | 1.14E−02 | 1 | 16 |
| WNU20 | 0.701 | 2.38E−03 | 2 | 20 | WNU20 | 0.800 | 5.46E−03 | 2 | 9 |
| WNU20 | 0.811 | 4.45E−03 | 2 | 22 | WNU20 | 0.863 | 1.28E−03 | 6 | 26 |
| WNU20 | 0.733 | 1.60E−02 | 4 | 20 | WNU20 | 0.712 | 2.08E−02 | 4 | 9 |

TABLE 22-continued

Correlation between the expression level of selected genes of some embodiments of the invention in various tissues and the phenotypic performance under normal or low nitrogen fertilization conditions across barley accessions (reproductive developmental stages)

| Gene Name | R | P value | Exp. set | Corr. Set ID | Gene Name | R | P value | Exp. set | Corr. Set ID |
|---|---|---|---|---|---|---|---|---|---|
| WNU20 | 0.799 | 5.59E−03 | 4 | 22 | WNU21 | 0.816 | 3.96E−03 | 2 | 26 |
| WNU21 | 0.795 | 5.94E−03 | 3 | 28 | WNU21 | 0.774 | 8.60E−03 | 3 | 29 |
| WNU22 | 0.763 | 1.03E−02 | 6 | 26 | WNU23 | 0.788 | 6.81E−03 | 6 | 34 |
| WNU23 | 0.797 | 5.80E−03 | 6 | 11 | WNU23 | 0.760 | 1.08E−02 | 6 | 5 |
| WNU23 | 0.884 | 6.88E−04 | 5 | 11 | WNU23 | 0.774 | 8.61E−03 | 5 | 36 |
| WNU23 | 0.772 | 8.87E−03 | 5 | 32 | WNU23 | 0.714 | 2.04E−02 | 6 | 35 |
| WNU25 | 0.760 | 1.07E−02 | 6 | 11 | WNU25 | 0.747 | 1.31E−02 | 6 | 13 |
| WNU25 | 0.782 | 7.49E−03 | 6 | 5 | WNU25 | 0.758 | 1.11E−02 | 5 | 35 |
| WNU25 | 0.799 | 5.54E−03 | 5 | 11 | WNU25 | 0.769 | 9.35E−03 | 5 | 36 |
| WNU25 | 0.705 | 2.28E−02 | 4 | 35 | WNU25 | 0.833 | 2.76E−03 | 4 | 11 |
| WNU25 | 0.752 | 1.22E−02 | 4 | 5 | WNU27 | 0.735 | 1.55E−02 | 2 | 3 |
| WNU27 | 0.764 | 1.01E−02 | 3 | 7 | WNU27 | 0.711 | 2.11E−02 | 3 | 5 |
| WNU27 | 0.793 | 6.18E−03 | 4 | 16 | WNU28 | 0.908 | 2.77E−04 | 2 | 24 |
| WNU28 | 0.839 | 2.40E−03 | 2 | 16 | WNU28 | 0.713 | 2.07E−02 | 6 | 28 |
| WNU28 | 0.807 | 4.76E−03 | 3 | 14 | WNU28 | 0.777 | 8.16E−03 | 3 | 33 |
| WNU28 | 0.770 | 9.24E−03 | 5 | 14 | WNU28 | 0.767 | 9.62E−03 | 5 | 33 |
| WNU28 | 0.710 | 2.13E−02 | 4 | 28 | WNU28 | 0.720 | 1.88E−02 | 1 | 35 |
| WNU28 | 0.879 | 8.01E−04 | 1 | 11 | WNU28 | 0.820 | 3.66E−03 | 1 | 36 |
| WNU28 | 0.813 | 4.26E−03 | 1 | 15 | WNU28 | 0.783 | 7.45E−03 | 1 | 32 |
| WNU28 | 0.806 | 4.86E−03 | 1 | 12 | WNU30 | 0.772 | 8.89E−03 | 2 | 34 |
| WNU30 | 0.820 | 3.68E−03 | 3 | 35 | WNU30 | 0.854 | 1.64E−03 | 3 | 10 |
| WNU30 | 0.813 | 4.21E−03 | 3 | 36 | WNU30 | 0.876 | 8.96E−04 | 5 | 17 |
| WNU30 | 0.785 | 7.19E−03 | 5 | 16 | WNU30 | 0.807 | 4.79E−03 | 1 | 1 |
| WNU31 | 0.767 | 9.36E−03 | 2 | 7 | WNU31 | 0.708 | 2.19E−02 | 5 | 14 |
| WNU31 | 0.753 | 1.19E−02 | 4 | 11 | WNU32 | 0.755 | 1.16E−02 | 5 | 35 |
| WNU32 | 0.721 | 1.87E−02 | 5 | 36 | WNU32 | 0.805 | 4.95E−03 | 4 | 26 |
| WNU32 | 0.776 | 8.39E−03 | 1 | 35 | WNU33 | 0.710 | 2.15E−02 | 2 | 35 |
| WNU33 | 0.789 | 6.68E−03 | 2 | 13 | WNU33 | 0.705 | 2.27E−02 | 3 | 5 |
| WNU33 | 0.718 | 1.92E−02 | 5 | 35 | WNU33 | 0.704 | 2.32E−02 | 5 | 36 |
| WNU33 | 0.756 | 1.14E−02 | 4 | 18 | WNU33 | 0.719 | 1.92E−02 | 4 | 16 |
| WNU33 | 0.716 | 1.99E−02 | 1 | 30 | WNU34 | 0.724 | 1.79E−02 | 3 | 32 |
| WNU34 | 0.701 | 2.38E−02 | 3 | 5 | WNU34 | 0.809 | 4.56E−03 | 5 | 35 |
| WNU34 | 0.772 | 8.84E−03 | 5 | 11 | WNU34 | 0.814 | 4.18E−03 | 5 | 36 |
| WNU34 | 0.848 | 1.93E−03 | 1 | 11 | WNU34 | 0.740 | 1.44E−02 | 1 | 36 |
| WNU34 | 0.769 | 9.33E−03 | 1 | 32 | WNU34 | 0.821 | 3.57E−03 | 1 | 12 |
| WNU35 | 0.727 | 1.71E−02 | 6 | 34 | WNU35 | 0.758 | 1.11E−02 | 6 | 16 |
| WNU35 | 0.704 | 2.30E−02 | 3 | 28 | WNU35 | 0.789 | 6.71E−03 | 3 | 31 |
| WNU35 | 0.823 | 3.47E−03 | 3 | 29 | WNU35 | 0.758 | 1.11E−02 | 5 | 25 |
| WNU35 | 0.720 | 1.88E−02 | 4 | 13 | WNU36 | 0.702 | 2.37E−02 | 2 | 14 |
| WNU36 | 0.833 | 2.75E−03 | 6 | 24 | WNU36 | 0.781 | 7.67E−03 | 6 | 16 |
| WNU36 | 0.830 | 2.94E−03 | 5 | 27 | WNU36 | 0.736 | 1.53E−02 | 5 | 17 |
| WNU36 | 0.825 | 3.32E−03 | 5 | 26 | WNU36 | 0.816 | 4.00E−03 | 5 | 16 |
| WNU37 | 0.745 | 1.35E−02 | 2 | 34 | WNU37 | 0.764 | 1.01E−02 | 6 | 11 |
| WNU37 | 0.725 | 1.76E−02 | 6 | 7 | WNU37 | 0.730 | 1.65E−02 | 6 | 24 |
| WNU37 | 0.768 | 9.40E−03 | 6 | 16 | WNU37 | 0.833 | 2.75E−03 | 3 | 15 |
| WNU37 | 0.704 | 2.30E−02 | 5 | 33 | WNU37 | 0.813 | 4.22E−03 | 1 | 32 |
| WNU38 | 0.724 | 1.79E−02 | 2 | 9 | WNU38 | 0.819 | 3.77E−03 | 6 | 20 |
| WNU38 | 0.889 | 5.90E−04 | 6 | 30 | WNU38 | 0.773 | 8.75E−03 | 3 | 31 |
| WNU38 | 0.788 | 6.83E−03 | 5 | 35 | WNU38 | 0.762 | 1.04E−02 | 5 | 11 |
| WNU38 | 0.798 | 5.65E−03 | 5 | 36 | WNU38 | 0.712 | 2.09E−02 | 1 | 28 |
| WNU38 | 0.723 | 1.81E−02 | 1 | 29 | WNU38 | 0.853 | 1.69E−03 | 1 | 21 |
| WNU39 | 0.776 | 8.37E−03 | 6 | 26 | WNU39 | 0.760 | 1.07E−02 | 6 | 16 |
| WNU39 | 0.710 | 2.15E−02 | 3 | 10 | WNU39 | 0.742 | 1.39E−02 | 3 | 36 |
| WNU39 | 0.796 | 5.92E−03 | 5 | 35 | WNU39 | 0.836 | 2.58E−03 | 5 | 11 |
| WNU39 | 0.874 | 9.40E−04 | 5 | 36 | WNU39 | 0.881 | 7.61E−04 | 1 | 11 |
| WNU39 | 0.815 | 4.06E−03 | 1 | 36 | WNU39 | 0.845 | 2.08E−03 | 1 | 32 |
| WNU39 | 0.842 | 2.24E−03 | 1 | 12 | WNU39 | 0.787 | 6.93E−03 | 1 | 4 |
| WNU39 | 0.774 | 8.63E−03 | 1 | 3 | WNU40 | 0.701 | 2.39E−02 | 2 | 34 |
| WNU40 | 0.708 | 2.19E−02 | 2 | 11 | WNU40 | 0.776 | 8.37E−03 | 2 | 5 |
| WNU40 | 0.839 | 2.40E−03 | 6 | 26 | WNU40 | 0.706 | 2.25E−02 | 5 | 35 |
| WNU40 | 0.752 | 1.21E−02 | 5 | 36 | WNU41 | 0.843 | 2.20E−03 | 3 | 35 |
| WNU41 | 0.794 | 6.11E−03 | 3 | 36 | WNU41 | 0.858 | 1.50E−03 | 3 | 18 |
| WNU41 | 0.720 | 1.89E−02 | 5 | 30 | WNU41 | 0.787 | 6.86E−03 | 5 | 33 |
| WNU41 | 0.750 | 1.25E−02 | 5 | 9 | WNU41 | 0.711 | 2.11E−02 | 5 | 23 |
| WNU41 | 0.753 | 1.20E−02 | 1 | 2 | WNU41 | 0.781 | 7.64E−03 | 1 | 1 |
| WNU42 | 0.741 | 1.42E−02 | 6 | 26 | WNU43 | 0.755 | 1.16E−02 | 2 | 20 |
| WNU43 | 0.752 | 1.22E−02 | 2 | 9 | WNU43 | 0.814 | 4.15E−03 | 2 | 22 |
| WNU43 | 0.707 | 2.22E−02 | 1 | 15 | WNU43 | 0.854 | 1.64E−03 | 1 | 33 |
| WNU44 | 0.764 | 1.01E−02 | 3 | 35 | WNU44 | 0.755 | 1.16E−02 | 3 | 11 |
| WNU44 | 0.780 | 7.78E−03 | 3 | 36 | WNU44 | 0.826 | 3.26E−03 | 5 | 2 |
| WNU8 | 0.792 | 6.33E−03 | 2 | 28 | WNU8 | 0.768 | 9.45E−03 | 6 | 11 |
| WNU8 | 0.708 | 2.19E−02 | 6 | 1 | WNU8 | 0.931 | 9.22E−05 | 3 | 15 |
| WNU8 | 0.759 | 1.09E−02 | 5 | 11 | WNU8 | 0.705 | 2.28E−02 | 5 | 36 |

TABLE 22-continued

Correlation between the expression level of selected genes of some embodiments of the invention in various tissues and the phenotypic performance under normal or low nitrogen fertilization conditions across barley accessions (reproductive developmental stages)

| Gene Name | R | P value | Exp. set | Corr. Set ID | Gene Name | R | P value | Exp. set | Corr. Set ID |
|---|---|---|---|---|---|---|---|---|---|
| WNU8 | 0.843 | 2.20E−03 | 4 | 7 | WNU8 | 0.887 | 6.31E−04 | 4 | 18 |
| WNU8 | 0.775 | 8.51E−03 | 4 | 5 | WNU8 | 0.787 | 6.88E−03 | 1 | 27 |
| WNU8 | 0.914 | 2.16E−04 | 1 | 15 | WNU8 | 0.788 | 6.77E−03 | 1 | 26 |
| WNU9 | 0.791 | 6.38E−03 | 2 | 7 | WNU9 | 0.709 | 2.18E−02 | 2 | 13 |
| WNU9 | 0.750 | 1.25E−02 | 2 | 5 | WNU9 | 0.758 | 1.11E−02 | 6 | 34 |
| WNU9 | 0.766 | 9.84E−03 | 6 | 11 | WNU9 | 0.866 | 1.19E−03 | 6 | 5 |
| WNU9 | 0.750 | 1.24E−02 | 3 | 5 | WNU9 | 0.773 | 8.67E−03 | 5 | 11 |
| WNU9 | 0.706 | 2.25E−02 | 5 | 36 | WNU9 | 0.820 | 3.68E−03 | 4 | 35 |

Table 22. "Con. ID"—correlation set ID according to the correlated parameters Table above.
"Exp. Set"—Expression set.
"R" = Pearson correlation coefficient;
"P" = p value.

Example 7

Production of Sorghum Transcriptome and High Throughput Correlation Analysis with Yield, Nue, and Abst Related Parameters Measured in Fields Using 44K Sorguhm Oligonucleotide Micro-Arrays In order to produce a high throughput correlation analysis between plant phenotype and gene expression level, the present inventors utilized a sorghum oligonucleotide microarray, produced by Agilent Technologies [chem. (dot) agilent (dot) com/Scripts/PDS (dot) asp?1Page=50879]. The array oligonucleotide represents about 44,000 sorghum genes and transcripts. In order to define correlations between the levels of RNA expression with ABST, yield and NUE components or vigor related parameters, various plant characteristics of 17 different sorghum hybrids were analyzed. Among them, 10 hybrids encompassing the observed variance were selected for RNA expression analysis. The correlation between the RNA levels and the characterized parameters was analyzed using Pearson correlation test [davidmlane (dot) com/hyperstat/A34739 (dot) html].

Correlation of Sorghum Varieties Across Ecotypes Grown Under Regular Growth Conditions, Severe Drought Conditions and Low Nitrogen Conditions Experimental Procedures 17 Sorghum varieties were grown in 3 repetitive plots, in field. Briefly, the growing protocol was as follows:

1. Regular growth conditions: sorghum plants were grown in the field using commercial fertilization and irrigation protocols (370 liter per meter$^2$, fertilization of 14 units of 21% urea per entire growth period).

2. Drought conditions: sorghum seeds were sown in soil and grown under normal condition until around 35 days from sowing, around stage V8 (eight green leaves are fully expanded, booting not started yet). At this point, irrigation was stopped, and severe drought stress was developed.

3. Low Nitrogen fertilization conditions: sorghum plants were fertilized with 50% less amount of nitrogen in the field than the amount of nitrogen applied in the regular growth treatment. All the fertilizer was applied before flowering.

Analyzed Sorghum tissues—All 10 selected Sorghum hybrids were sampled per each treatment. Tissues [Flag leaf, Flower meristem and Flower] from plants growing under normal conditions, severe drought stress and low nitrogen conditions were sampled and RNA was extracted as described above. Each micro-array expression information tissue type has received a Set ID as summarized in Table 23 below.

TABLE 23

Sorghum transcriptome expression sets in field experiments

| Expression Set | Set ID |
|---|---|
| Flag Leaf Drought | 1 |
| Flag Leaf low nitrogen | 2 |
| Flag Leaf Normal | 3 |
| Flower Meristem Drought | 4 |
| Flower Meristem low nitrogen | 5 |
| Flower Meristem Normal | 6 |
| Flower Drought | 7 |
| Flower low nitrogen | 8 |
| Flower Normal | 9 |

Table 23: Provided are the sorghum transcriptome expression sets. Flag leaf = the leaf below the flower; Flower meristem = Apical meristem following panicle initiation; Flower = the flower at the anthesis day.

The following parameters were collected using digital imaging system:

Average Grain Area (cm$^2$)—At the end of the growing period the grains were separated from the Plant 'Head'. A sample of ~200 grains were weighted, photographed and images were processed using the below described image processing system. The grain area was measured from those images and was divided by the number of grains.

Average Grain Length (cm)—At the end of the growing period the grains were separated from the Plant 'Head'. A sample of ~200 grains were weighted, photographed and images were processed using the below described image processing system. The sum of grain lengths (longest axis) was measured from those images and was divided by the number of grains.

Grain size was also measured after dividing the grains into two groups according to their size (lower and upper groups)

Head Average Area (cm$^2$)—At the end of the growing period 5 'Heads' were, photographed and images were processed using the below described image processing system. The 'Head' area was measured from those images and was divided by the number of 'Heads'.

Head Average Length (cm)—At the end of the growing period 5 'Heads' were, photographed and images were processed using the below described image processing system. The 'Head' length (longest axis) was measured from those images and was divided by the number of 'Heads'.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Seed Weight per Head (gr.)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head per Plant Gram—At the end of the experiment (when heads were harvested) total heads and 5 selected heads per plots within blocks A-C were collected separately. The heads (total and 5) were weighted (gr.) separately, and the average fresh weight per plant was calculated for total (FW Head/Plant gr. based on plot) and for 5 (FW Head/Plant gr. based on 5 plants) heads.

Plant height—Plants were characterized for height during growing period at 5 time points. In each measure, plants were measured for their height using a measuring tape. Height was measured from ground level to top of the longest leaf.

Plant leaf number—Plants were characterized for leaf number during growing period at 5 time points. In each measure, plants were measured for their leaf number by counting all the leaves of 3 selected plants per plot.

Growth Rate—was calculated using Formulas III (above) and VIII (above).

SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative dry weight and heads—At the end of the experiment (when inflorescence were dry) all inflorescence and vegetative material from plots within blocks A-C were collected. The biomass and heads weight of each plot was separated, measured and divided by the number of heads.

Dry weight=total weight of the vegetative portion above ground (excluding roots) after drying at 70° C. in oven for 48 hours;

Harvest Index (HI) (*Sorghum*)—The harvest index was calculated using Formula XVI described above.

FW Heads/(FW Heads+FW Plants)—The total fresh weight of heads and their respective plant biomass was measured at the harvest day. The heads weight was divided by the sum of weights of heads and plants.

Experimental Results 17 different *sorghum* hybrids were grown and characterized for different parameters (Table 24). The average for each of the measured parameter was calculated using the JMP software (Table 25) and a subsequent correlation analysis was performed (Table 26). Results were then integrated to the database.

TABLE 24

*Sorghum* correlated parameters (vectors)

| Correlated parameter with | Correlation ID |
|---|---|
| Average Grain Area (cm$^2$), Drought | 1 |
| Average Grain Area (cm$^2$), Low N | 2 |
| Average Grain Area (cm$^2$), Normal | 3 |
| FW Head/Plant gr (based on plot), Drought | 4 |
| FW Head/Plant gr (based on plot), Low N | 5 |
| FW Head/Plant gr (based on plot), Normal | 6 |
| FW Head/Plant gr (based on 5 plants), Low N | 7 |
| FW Head/Plant gr (based on 5 plants), Normal | 8 |
| FW Heads/(FW Heads + FW Plants) (all plot), Drought | 9 |
| FW Heads/(FW Heads + FW Plants) (all plot), Low N | 10 |
| FW Heads/(FW Heads + FW Plants) (all plot), Normal | 11 |
| FW/Plant gr (based on plot), Drought | 12 |
| FW/Plant gr (based on plot), Low N | 13 |
| FW/Plant gr (based on plot), Normal | 14 |
| Final Plant Height (cm), Drought | 15 |
| Final Plant Height (cm), Low N | 16 |
| Final Plant Height (cm), Normal | 17 |
| Head Average Area (cm$^2$), Drought | 18 |
| Head Average Area (cm$^2$), Low N | 19 |
| Head Average Area (cm$^2$), Normal | 20 |
| Head Average Length (cm), Drought | 21 |
| Head Average Length (cm), Low N | 22 |
| Head Average Length (cm), Normal | 23 |
| Head Average Perimeter (cm), Drought | 24 |
| Head Average Perimeter (cm), Low N | 25 |
| Head Average Perimeter (cm), Normal | 26 |
| Head Average Width (cm), Drought | 27 |
| Head Average Width (cm), Low N | 28 |
| Head Average Width (cm), Normal | 29 |
| Leaf SPAD 64 DPS (Days Post Sowing), Drought | 30 |
| Leaf SPAD 64 DPS (Days Post Sowing), Low N | 31 |
| Leaf SPAD 64 DPS (Days Post Sowing), Normal | 32 |
| Lower Ratio Average Grain Area, Low N | 33 |
| Lower Ratio Average Grain Area, Normal | 34 |
| Lower Ratio Average Grain Length, Low N | 35 |
| Lower Ratio Average Grain Length, Normal | 36 |
| Lower Ratio Average Grain Perimeter, Low N | 37 |
| Lower Ratio Average Grain Perimeter, Normal | 38 |
| Lower Ratio Average Grain Width, Low N | 39 |
| Lower Ratio Average Grain Width, Normal | 40 |
| Total grain weight /Head (based on plot) gr, Low N | 41 |
| Total grain weight /Head gr (based on 5 heads), Low N | 42 |
| Total grain weight /Head gr (based on 5 heads), Normal | 43 |
| Total grain weight /Head gr (based on plot), Normal | 44 |
| Total grain weight /Head gr,(based on plot) Drought | 45 |
| Upper Ratio Average Grain Area, Drought | 46 |
| Upper Ratio Average Grain Area, Low N | 47 |
| Upper Ratio Average Grain Area, Normal | 48 |
| [Grain Yield[plant biomass/SPAD 64 DPS], Normal | 49 |
| [Grain Yield[ plant biomass/SPAD 64 DPS], Low N | 50 |
| [Grain yield /SPAD 64 DPS], Low N | 51 |
| [Grain yield /SPAD 64 DPS], Normal | 52 |
| [Plant biomass (FW)/SPAD 64 DPS], Drought | 53 |
| [Plant biomass (FW)/SPAD 64 DPS], Low N | 54 |
| [Plant biomass (FW)/SPAD 64 DPS], Normal | 55 |

Table 24. Provided are the *Sorghum* correlated parameters (vectors). "gr." = grams; "SPAD" = chlorophyll levels; "FW" = Plant Fresh weight; "DW", Plant Dry weight; "normal" = standard growth conditions; "DPS" = days post-sowing; "Low N" = Low Nitrogen. FW—Head/Plant gr. (based on 5 plants), fresh weigh of the harvested heads was divided by the number of heads that were phenotyped, Low N-low nitrogen conditions: Lower Ratio Average Grain Area grain area of the lower fraction of grains.

TABLE 25

Measured parameters in *Sorghum* accessions under normal, low N and drought conditions

| Seed ID/ Corr. ID | L-1 | L-2 | L-3 | L-4 | L-5 | L-6 | L-7 | L-8 |
|---|---|---|---|---|---|---|---|---|
| 3 | 0.1 | 0.1 | 0.1 | 0.1 | 0.1 | 0.1 | 0.1 | 0.1 |
| 6 | 175.2 | 223.5 | 56.4 | 111.6 | 67.3 | 66.9 | 126.2 | 107.7 |
| 8 | 406.5 | 518.0 | 148.0 | 423.0 | 92.0 | 101.3 | 423.5 | 386.5 |
| 11 | 0.5 | 0.5 | 0.1 | 0.3 | 0.1 | 0.2 | 0.5 | 0.4 |
| 14 | 162.6 | 212.6 | 334.8 | 313.5 | 462.3 | 318.3 | 151.1 | 137.6 |
| 17 | 95.3 | 79.2 | 197.9 | 234.2 | 189.4 | 194.7 | 117.3 | 92.8 |
| 20 | 120.1 | 167.6 | 85.1 | 157.3 | 104.0 | 102.5 | 168.5 | 109.3 |
| 23 | 25.6 | 26.8 | 21.0 | 26.8 | 23.1 | 21.8 | 31.3 | 23.2 |
| 26 | 61.2 | 67.9 | 56.3 | 65.4 | 67.5 | 67.5 | 74.4 | 56.2 |
| 29 | 6.0 | 7.9 | 4.9 | 7.4 | 5.6 | 5.9 | 6.8 | 6.0 |
| 32 | 43.0 | . | 43.3 | 44.7 | 45.8 | 41.6 | 45.2 | 45.1 |
| 34 | 0.8 | 0.7 | 0.8 | 0.8 | 0.7 | 0.7 | 0.8 | 0.8 |
| 36 | 0.9 | 0.9 | 0.9 | 0.9 | 0.9 | 0.9 | 0.9 | 0.9 |
| 38 | 0.9 | 0.9 | 0.9 | 0.9 | 0.9 | 0.9 | 0.9 | 0.9 |
| 40 | 0.9 | 0.8 | 0.8 | 0.9 | 0.8 | 0.8 | 0.9 | 0.9 |
| 43 | 47.4 | 46.3 | 28.4 | 70.4 | 32.2 | 49.2 | 63.5 | 44.5 |
| 44 | 31.1 | 26.4 | 18.7 | 38.4 | 26.7 | 28.8 | 47.7 | 31.0 |
| 48 | 1.2 | 1.3 | 1.1 | 1.1 | 1.2 | 1.1 | 1.2 | 1.2 |
| 49 | 4.5 | 8.2 | 7.9 | 10.7 | 8.3 | 4.4 | 3.7 | 4.8 |
| 52 | 3.8 | 7.7 | 7.0 | 10.1 | 7.6 | 3.3 | 3.0 | 3.9 |
| 55 | 0.7 | 0.4 | 0.9 | 0.6 | 0.7 | 1.1 | 0.7 | 0.9 |
| 2 | 0.1 | 0.1 | 0.1 | 0.1 | 0.1 | 0.1 | 0.1 | 0.1 |
| 5 | 214.8 | 205.0 | 73.5 | 123.0 | 153.1 | 93.2 | 134.1 | 77.4 |
| 7 | 388.0 | 428.7 | 297.7 | 208.0 | 208.3 | 303.7 | 436.0 | 376.3 |
| 10 | 0.5 | 0.5 | 0.2 | 0.4 | 0.2 | 0.2 | 0.5 | 0.4 |
| 13 | 204.8 | 199.6 | 340.5 | 240.6 | 537.8 | 359.4 | 149.2 | 129.1 |
| 16 | 104.0 | 80.9 | 204.7 | 125.4 | 225.4 | 208.1 | 121.4 | 100.3 |
| 19 | 96.2 | 214.7 | 98.6 | 182.8 | 119.6 | 110.2 | 172.4 | 84.8 |
| 22 | 23.2 | 25.6 | 20.9 | 28.4 | 24.3 | 22.6 | 32.1 | 20.4 |
| 25 | 56.3 | 79.2 | 53.3 | 76.2 | 67.3 | 59.5 | 79.3 | 51.5 |
| 28 | 5.3 | 10.4 | 5.9 | 8.3 | 6.2 | 6.1 | 6.8 | 5.3 |
| 31 | 38.3 | 39.0 | 42.3 | 40.9 | 43.2 | 39.9 | 42.7 | 43.3 |
| 33 | 0.8 | 0.8 | 0.8 | 0.8 | 0.8 | 0.8 | 0.8 | 0.8 |
| 35 | 0.9 | 0.9 | 0.9 | 0.9 | 0.9 | 0.9 | 0.9 | 0.9 |
| 37 | 0.9 | 0.9 | 0.9 | 0.9 | 0.9 | 0.9 | 0.9 | 0.9 |
| 39 | 0.9 | 0.9 | 0.9 | 0.9 | 0.9 | 0.9 | 0.9 | 0.9 |
| 41 | 25.9 | 30.6 | 19.4 | 35.6 | 25.2 | 22.2 | 50.0 | 27.5 |
| 42 | 50.3 | 50.9 | 36.1 | 73.1 | 37.9 | 36.4 | 71.7 | 35.0 |
| 47 | 1.2 | 1.3 | 1.1 | 1.2 | 1.2 | 1.2 | 1.2 | 1.2 |
| 50 | 6.0 | 5.9 | 8.5 | 6.8 | 13.1 | 9.6 | 4.7 | 3.6 |
| 51 | 0.7 | 0.8 | 0.5 | 0.9 | 0.6 | 0.6 | 1.2 | 0.6 |
| 54 | 5.3 | 5.1 | 8.0 | 5.9 | 12.5 | 9.0 | 3.5 | 3.0 |
| 1 | 0.1 | 0.1 | 0.1 | 0.1 | 0.1 | 0.1 | | |
| 4 | 154.9 | 122.0 | 130.5 | 241.1 | 69.0 | 186.4 | 62.1 | 39.0 |
| 9 | 0.4 | 0.5 | 0.4 | 0.4 | 0.2 | 0.3 | 0.4 | 0.4 |
| 12 | 208.0 | 138.0 | 255.4 | 402.2 | 233.5 | 391.7 | 89.3 | 50.6 |
| 15 | 89.4 | 75.7 | 92.1 | 94.3 | 150.8 | 110.7 | 99.2 | 84.0 |
| 18 | 83.1 | 107.8 | 88.7 | 135.9 | 90.8 | 124.0 | 86.1 | 85.2 |
| 21 | 21.6 | 21.9 | 21.6 | 22.0 | 21.0 | 28.6 | 21.3 | 20.8 |
| 24 | 52.8 | 64.5 | 56.6 | 64.4 | 53.2 | 71.7 | 55.6 | 53.0 |
| 27 | 4.8 | 6.3 | 5.2 | 7.8 | 5.3 | 5.5 | 5.0 | 5.1 |
| 30 | 40.6 | 40.9 | 45.0 | 42.3 | 45.2 | 40.6 | 44.8 | 45.1 |
| 45 | 22.1 | 16.8 | 9.2 | 104.4 | 3.2 | 22.0 | 10.0 | 18.6 |
| 46 | 1.3 | 1.2 | 1.3 | 1.5 | 1.2 | 1.2 | | |
| 53 | 5.1 | 3.4 | 5.7 | 9.5 | 5.2 | 9.7 | 2.0 | 1.1 |

| Seed ID/ Corr. ID | L-9 | L-10 | L-11 | L-12 | L-13 | L-14 | L-15 | L-16 | L-17 |
|---|---|---|---|---|---|---|---|---|---|
| 3 | 0.1 | 0.1 | 0.1 | 0.1 | 0.1 | 0.1 | 0.1 | 0.1 | 0.1 |
| 6 | 123.9 | 102.8 | 82.3 | 77.6 | 91.2 | 150.4 | 109.1 | 107.6 | 130.9 |
| 8 | 409.5 | 329.0 | 391.0 | 435.8 | 429.5 | 441.0 | 415.8 | 429.5 | 428.5 |
| 11 | 0.4 | 0.4 | 0.5 | 0.4 | 0.4 | 0.5 | 0.5 | 0.4 | 0.4 |
| 14 | 168.0 | 129.0 | 97.6 | 99.3 | 112.2 | 157.4 | 130.5 | 135.7 | 209.2 |
| 17 | 112.7 | 97.5 | 98.0 | 100.0 | 105.6 | 151.2 | 117.1 | 124.5 | 126.5 |
| 20 | 135.1 | 169.0 | 156.1 | 112.1 | 154.7 | 171.7 | 168.5 | 162.5 | 170.5 |
| 23 | 25.7 | 28.8 | 28.1 | 23.0 | 28.1 | 30.0 | 30.5 | 27.2 | 29.3 |
| 26 | 61.6 | 71.4 | 68.6 | 56.4 | 67.8 | 71.5 | 78.9 | 67.0 | 74.1 |
| 29 | 6.6 | 7.4 | 7.0 | 6.2 | 7.0 | 7.2 | 7.0 | 7.4 | 7.4 |
| 32 | 43.0 | 45.6 | 44.8 | 45.3 | 46.5 | 44.0 | 45.1 | 45.1 | 43.1 |
| 34 | 0.8 | 0.8 | 0.8 | 0.8 | 0.8 | 0.8 | 0.8 | 0.8 | 0.8 |
| 36 | 0.9 | 0.9 | 0.9 | 0.9 | 0.9 | 0.9 | 0.9 | 0.9 | 0.9 |
| 38 | 0.9 | 0.9 | 0.9 | 0.9 | 0.9 | 0.9 | 0.9 | 0.9 | 0.9 |
| 40 | 0.9 | 0.9 | 0.9 | 0.9 | 0.9 | 0.9 | 0.9 | 0.9 | 0.9 |
| 43 | 56.7 | 60.0 | 45.5 | 58.2 | 70.6 | 70.1 | 54.0 | 59.9 | 52.7 |

TABLE 25-continued

Measured parameters in *Sorghum* accessions under normal, low N and drought conditions

| | | | | | | | | | |
|---|---|---|---|---|---|---|---|---|---|
| 44 | 40.0 | 38.4 | 32.1 | 32.7 | 32.8 | 51.5 | 35.7 | 38.3 | 42.4 |
| 48 | 1.2 | 1.2 | 1.3 | 1.2 | 1.2 | 1.2 | 1.2 | 1.3 | 1.2 |
| 49 | 3.7 | 2.9 | 2.9 | 3.1 | 4.8 | 3.7 | 3.9 | 5.8 | |
| 52 | 2.8 | 2.2 | 2.2 | 2.4 | 3.6 | 2.9 | 3.0 | 4.9 | |
| 55 | 0.8 | 0.7 | 0.7 | 0.7 | 1.2 | 0.8 | 0.8 | 1.0 | |
| 2 | 0.1 | 0.1 | 0.1 | 0.1 | 0.1 | 0.1 | 0.1 | 0.1 | 0.1 |
| 5 | 129.6 | 99.8 | 76.9 | 84.2 | 92.2 | 138.8 | 113.3 | 95.5 | 129.5 |
| 7 | 474.7 | 437.7 | 383.0 | 375.0 | 425.0 | 434.0 | 408.7 | 378.5 | 432.0 |
| 10 | 0.4 | 0.4 | 0.4 | 0.4 | 0.4 | 0.4 | 0.4 | 0.4 | 0.4 |
| 13 | 178.7 | 124.3 | 101.3 | 132.1 | 117.9 | 177.0 | 143.7 | 127.0 | 180.4 |
| 16 | 121.1 | 94.5 | 110.0 | 115.1 | 104.7 | 173.7 | 115.6 | 138.8 | 144.4 |
| 19 | 156.3 | 136.7 | 137.7 | 96.5 | 158.2 | 163.9 | 138.4 | 135.5 | 165.6 |
| 22 | 26.7 | 26.3 | 25.4 | 23.1 | 27.9 | 28.9 | 27.6 | 25.5 | 30.3 |
| 25 | 69.9 | 66.2 | 67.4 | 57.9 | 70.6 | 73.8 | 66.9 | 65.4 | 76.0 |
| 28 | 7.5 | 6.6 | 6.9 | 5.3 | 7.2 | 7.2 | 6.3 | 6.6 | 6.8 |
| 31 | 39.0 | 42.7 | 40.1 | 44.0 | 45.4 | 44.8 | 42.6 | 43.8 | 46.7 |
| 33 | 0.8 | 0.8 | 0.7 | 0.8 | 0.8 | 0.8 | 0.8 | 0.8 | 0.8 |
| 35 | 0.9 | 0.9 | 0.9 | 0.9 | 0.9 | 0.9 | 0.9 | 0.9 | 0.9 |
| 37 | 0.9 | 0.9 | 0.9 | 0.9 | 0.9 | 0.9 | 0.9 | 0.9 | 0.9 |
| 39 | 0.9 | 0.9 | 0.8 | 0.9 | 0.9 | 0.9 | 0.9 | 0.9 | 0.9 |
| 41 | 51.1 | 36.8 | 29.4 | 26.7 | 29.4 | 51.1 | 37.0 | 39.9 | 41.8 |
| 42 | 76.7 | 57.6 | 42.9 | 36.5 | 68.6 | 71.8 | 49.3 | 43.9 | 52.1 |
| 47 | 1.2 | 1.2 | 1.2 | 1.2 | 1.2 | 1.2 | 1.3 | 1.2 | 1.2 |
| 50 | 5.9 | 3.8 | 3.3 | 3.6 | 3.2 | 5.1 | 4.2 | 3.8 | 4.8 |
| 51 | 1.3 | 0.9 | 0.7 | 0.6 | 0.6 | 1.1 | 0.9 | 0.9 | 0.9 |
| 54 | 4.6 | 2.9 | 2.5 | 3.0 | 2.6 | 4.0 | 3.4 | 2.9 | 3.9 |
| 1 | | | | | | | | | |
| 4 | 58.9 | 76.4 | 33.5 | 42.2 | 41.5 | 131.7 | 60.8 | 44.3 | 185.4 |
| 9 | 0.4 | 0.4 | 0.5 | 0.5 | 0.5 | 0.4 | 0.3 | 0.2 | 0.3 |
| 12 | 87.0 | 120.4 | 37.2 | 48.2 | 44.2 | 231.6 | 116.0 | 123.1 | 342.5 |
| 15 | 99.0 | 92.2 | 81.9 | 98.8 | 86.5 | 99.6 | 83.0 | 83.5 | 92.3 |
| 18 | 113.1 | 100.8 | 80.4 | 126.9 | 86.4 | 92.3 | 77.9 | 76.9 | |
| 21 | 24.7 | 24.3 | 21.9 | 25.0 | 19.5 | 20.4 | 16.8 | 18.9 | |
| 24 | 69.8 | 65.1 | 55.3 | 69.1 | 53.3 | 56.3 | 49.1 | 51.9 | |
| 27 | 5.8 | 5.4 | 4.7 | 6.3 | 5.6 | 5.8 | 5.9 | 5.1 | |
| 30 | 40.7 | 45.4 | 42.6 | 44.2 | 44.6 | 42.4 | 43.3 | 40.3 | 40.8 |
| 45 | 29.3 | 10.5 | 14.8 | 12.9 | 18.2 | 11.6 | 18.6 | 16.4 | |
| 46 | | | | | | | | | |
| 53 | 2.1 | 2.7 | 0.9 | 1.1 | 1.0 | 5.5 | 2.7 | 3.1 | 8.4 |

Table 25: Provided are the values of each of the parameters (as described above) measured in *Sorghum* accessions (Seed ID) under normal, low N and drought conditions. Growth conditions are specified in the experimental procedure section.

TABLE 26

Correlation between the expression level of selected genes of some embodiments of the invention in various tissues and the phenotypic performance under normal or low nitrogen fertilization conditions across *sorghum* accessions

| Gene Name | R | P value | Exp. set | Cor. Set ID | Gene Name | R | P value | Exp. set | Cor. Set ID |
|---|---|---|---|---|---|---|---|---|---|
| LAB101 | 0.895 | 4.69E-04 | 6 | 32 | LAB101 | 0.862 | 1.33E-03 | 6 | 38 |
| LAB101 | 0.821 | 3.56E-03 | 9 | 32 | LAB101 | 0.745 | 1.34E-02 | 9 | 40 |
| LAB101 | 0.928 | 1.07E-04 | 9 | 38 | LAB101 | 0.725 | 1.77E-02 | 9 | 36 |
| LAB101 | 0.748 | 1.28E-02 | 9 | 34 | LAB101 | 0.704 | 2.31E-02 | 2 | 31 |
| LAB101 | 0.720 | 1.89E-02 | 3 | 17 | LAB572 | 0.771 | 9.01E-03 | 6 | 48 |
| LAB572 | 0.762 | 1.04E-02 | 6 | 3 | LAB572 | 0.914 | 2.15E-04 | 2 | 41 |
| LAB572 | 0.782 | 7.57E-03 | 2 | 22 | LAB572 | 0.701 | 2.38E-02 | 2 | 42 |
| LAB572 | 0.850 | 1.86E-03 | 2 | 51 | LAB572 | 0.882 | 7.34E-04 | 2 | 16 |
| LAB572 | 0.845 | 2.08E-03 | 8 | 2 | LAB572 | 0.735 | 1.55E-02 | 3 | 44 |
| WNU100 | 0.813 | 4.24E-03 | 9 | 17 | WNU100 | 0.904 | 3.34E-04 | 2 | 16 |
| WNU100 | 0.723 | 1.83E-02 | 8 | 16 | WNU101 | 0.730 | 1.66E-02 | 6 | 48 |
| WNU101 | 0.789 | 6.65E-03 | 2 | 47 | WNU101 | 0.715 | 2.00E-02 | 2 | 28 |
| WNU101 | 0.784 | 7.31E-03 | 3 | 48 | WNU105 | 0.819 | 3.78E-03 | 6 | 52 |
| WNU105 | 0.797 | 5.76E-03 | 6 | 49 | WNU105 | 0.762 | 1.04E-02 | 2 | 51 |
| WNU105 | 0.825 | 3.28E-03 | 5 | 2 | WNU3 | 0.708 | 2.20E-02 | 2 | 7 |
| WNU3 | 0.862 | 1.33E-03 | 2 | 41 | WNU3 | 0.827 | 3.15E-03 | 2 | 22 |
| WNU3 | 0.790 | 6.52E-03 | 2 | 42 | WNU3 | 0.788 | 6.73E-03 | 2 | 51 |
| WNU3 | 0.804 | 5.08E-03 | 2 | 16 | WNU3 | 0.749 | 1.27E-02 | 5 | 2 |
| WNU3 | 0.916 | 5.19E-04 | 3 | 52 | WNU3 | 0.703 | 2.32E-02 | 3 | 6 |
| WNU3 | 0.915 | 5.37E-04 | 3 | 49 | WNU3 | 0.712 | 2.09E-02 | 1 | 4 |
| WNU90 | 0.788 | 6.81E-03 | 2 | 47 | WNU90 | 0.726 | 1.75E-02 | 2 | 28 |
| WNU91 | 0.749 | 1.26E-02 | 6 | 44 | WNU91 | 0.886 | 6.38E-04 | 4 | 53 |
| WNU91 | 0.753 | 1.20E-02 | 4 | 4 | WNU91 | 0.887 | 6.30E-04 | 4 | 12 |
| WNU91 | 0.738 | 1.48E-02 | 5 | 5 | WNU91 | 0.718 | 1.95E-02 | 5 | 54 |
| WNU91 | 0.777 | 8.20E-03 | 5 | 50 | WNU91 | 0.804 | 5.10E-03 | 5 | 13 |

TABLE 26-continued

Correlation between the expression level of selected genes of some embodiments of the invention in various tissues and the phenotypic performance under normal or low nitrogen fertilization conditions across *sorghum* accessions

| Gene Name | R | P value | Exp. set | Cor. Set ID | Gene Name | R | P value | Exp. set | Cor. Set ID |
|---|---|---|---|---|---|---|---|---|---|
| WNU92 | 0.823 | 3.44E-03 | 6 | 14 | WNU93 | 0.722 | 1.85E-02 | 6 | 17 |
| WNU93 | 0.771 | 9.09E-03 | 6 | 40 | WNU93 | 0.834 | 2.68E-03 | 6 | 44 |
| WNU93 | 0.726 | 1.75E-02 | 6 | 36 | WNU93 | 0.813 | 4.23E-03 | 6 | 34 |
| WNU93 | 0.721 | 1.87E-02 | 2 | 33 | WNU93 | 0.729 | 1.68E-02 | 2 | 39 |
| WNU93 | 0.806 | 4.84E-03 | 2 | 37 | WNU93 | 0.741 | 1.41E-02 | 2 | 16 |
| WNU93 | 0.789 | 6.65E-03 | 8 | 33 | WNU93 | 0.717 | 1.97E-02 | 8 | 41 |
| WNU93 | 0.713 | 2.05E-02 | 8 | 39 | WNU93 | 0.829 | 3.04E-03 | 8 | 35 |
| WNU93 | 0.817 | 3.91E-03 | 8 | 42 | WNU93 | 0.737 | 1.49E-02 | 8 | 51 |
| WNU93 | 0.898 | 4.12E-04 | 8 | 37 | WNU93 | 0.751 | 1.22E-02 | 5 | 33 |
| WNU93 | 0.713 | 2.06E-02 | 5 | 39 | WNU93 | 0.747 | 1.31E-02 | 5 | 35 |
| WNU93 | 0.786 | 7.02E-03 | 5 | 42 | WNU93 | 0.876 | 9.01E-04 | 1 | 15 |
| WNU94 | 0.742 | 1.40E-02 | 6 | 11 | WNU94 | 0.759 | 1.08E-02 | 6 | 44 |
| WNU94 | 0.785 | 7.11E-03 | 4 | 15 | WNU94 | 0.736 | 1.53E-02 | 5 | 16 |
| WNU96 | 0.717 | 1.97E-02 | 6 | 44 | WNU97 | 0.749 | 1.26E-02 | 6 | 17 |
| WNU97 | 0.736 | 2.36E-02 | 9 | 52 | WNU97 | 0.773 | 1.46E-02 | 9 | 49 |
| WNU97 | 0.961 | 9.57E-06 | 4 | 53 | WNU97 | 0.878 | 8.35E-04 | 4 | 4 |
| WNU97 | 0.965 | 6.14E-06 | 4 | 12 | WNU97 | 0.700 | 2.42E-02 | 5 | 50 |
| WNU97 | 0.780 | 7.85E-03 | 5 | 13 | WNU98 | 0.843 | 2.17E-03 | 6 | 17 |
| WNU98 | 0.818 | 3.85E-03 | 6 | 44 | WNU98 | 0.877 | 8.62E-04 | 4 | 53 |
| WNU98 | 0.847 | 1.98E-03 | 4 | 4 | WNU98 | 0.888 | 6.09E-04 | 4 | 12 |
| WNU99 | 0.826 | 3.22E-03 | 6 | 17 | WNU99 | 0.778 | 8.06E-03 | 6 | 44 |
| WNU99 | 0.823 | 3.45E-03 | 4 | 53 | WNU99 | 0.741 | 1.42E-02 | 4 | 4 |
| WNU99 | 0.838 | 2.48E-03 | 4 | 12 | | | | | |

Table 26. "Corr. ID"—correlation set ID according to the correlated parameters Table above.
"Exp. Set"—Expression set.
"R" = Pearson correlation coefficient;
"P" = p value.

Example 8

Production of *Sorghum* Transcriptome and High Throughput Correlation Analysis with Biomass, Nue, and Abst Related Parameters Measured in Semi-Hydroponics Conditions Using 44K Sorguhm Oligonucleotide Micro-Arrays

*Sorghum* Vigor Related Parameters Under Low Nitrogen, 100 mM NaCl, Low Temperature (10±2° C.) and Normal Growth Conditions—Ten *Sorghum* hybrids were grown in 3 repetitive plots, each containing 17 plants, at a net house under semi-hydroponics conditions. Briefly, the growing protocol was as follows: *Sorghum* seeds were sown in trays filled with a mix of vermiculite and peat in a 1:1 ratio. Following germination, the trays were transferred to the high salinity solution (100 mM NaCl in addition to the Full Hoagland solution), low temperature (10±2° C. in the presence of Full Hoagland solution), low nitrogen solution (the amount of total nitrogen was reduced in 90% from the full Hoagland solution (i.e., to a final concentration of 10% from full Hoagland solution, final amount of 1.2 mM N) or at Normal growth solution (Full Hoagland containing 16 mM N solution, at 28±2° C.). Plants were grown at 28±2° C.

Full Hoagland solution consists of: $KNO_3$ —0.808 grams/liter, $MgSO_4$ —0.12 grams/liter, $KH_2PO_4$ —0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

Analyzed *Sorghum* tissues—All 10 selected *Sorghum* hybrids were sampled per each treatment. Three tissues [leaves, meristems and roots] growing at 100 mM NaCl, low temperature (10±2° C.), low Nitrogen (1.2 mM N) or under Normal conditions were sampled and RNA was extracted as described above. Each micro-array expression information tissue type has received a Set ID as summarized in Table 27 below.

TABLE 27

*Sorghum* transcriptome expression sets under semi hydroponics conditions

| Expression Set | Set ID |
|---|---|
| *Sorghum* roots under cold | 1 |
| *Sorghum* roots under Normal Growth | 2 |
| *Sorghum* roots under Low Nitrogen | 3 |
| *Sorghum* roots under 100 mM NaCl | 4 |
| *Sorghum* meristems under cold | 5 |
| *Sorghum* meristems under Low Nitrogen | 6 |
| *Sorghum* meristems under 100 mM NaCl | 7 |
| *Sorghum* meristems under Normal Growth | 8 |

Table 27: Provided are the *Sorghum* transcriptome expression sets. Cold conditions = 10 ± 2° C.; NaCl = 100 mM NaCl; low nitrogen = 1.2 mM Nitrogen; Normal conditions = 16 mM Nitrogen.

Experimental Results 10 different *Sorghum* hybrids were grown and characterized for the following parameters: "Leaf No"=leaf number per plant (average of five plants); "Plant Height"=plant height [cm] (average of five plants); "DW Root/Plant"—root dry weight per plant (average of five plants); DW Shoot/Plant—shoot dry weight per plant (average of five plants) (Table 28). The average for each of the measured parameter was calculated using the JMP software and values are summarized in Table 29 below. Subsequent correlation analysis was performed (Table 30). Results were then integrated to the database.

TABLE 28

Sorghum correlated parameters (vectors)

| Correlated parameter with | Correlation ID |
|---|---|
| DW Root/Plant-100 mM NaCl [gr] | 1 |
| DW Root/Plant-Cold [gr] | 2 |
| DW Root/Plant-Low Nitrogen [gr] | 3 |
| DW Root/Plant-Normal [gr] | 4 |
| DW Shoot/Plant-Low Nitrogen [gr] | 5 |
| DW Shoot/Plant-100 mM NaCl [gr] | 6 |
| DW Shoot/Plant-Cold [gr] | 7 |
| DW Shoot/Plant-Normal [gr] | 8 |
| Leaf TP1-100 mM NaCl | 9 |
| Leaf TP1-Cold | 10 |
| Leaf TP1-Low Nitrogen | 11 |
| Leaf TP1-Normal | 12 |
| Leaf TP2-100 mM NaCl | 13 |
| Leaf TP2-Cold | 14 |
| Leaf TP2-Low Nitrogen | 15 |
| Leaf TP2-Normal | 16 |
| Leaf TP3-100 mM NaCl | 17 |
| Leaf TP3-Cold | 18 |
| Leaf TP3-Low Nitrogen | 19 |
| Leaf TP3-Normal | 20 |
| Low N-NUE total biomass | 21 |
| Low N-Shoot/Root | 22 |
| Low N-NUE roots | 23 |
| Low N-NUE shoots | 24 |
| Low N-percent-root biomass compared to normal | 25 |
| Low N-percent-shoot biomass compared to normal | 26 |
| Low N-percent-total biomass reduction compared to normal | 27 |
| N level/Leaf [Low Nitrogen] | 28 |
| N level/Leaf [100 mM NaCl] | 29 |
| N level/Leaf [Cold] | 30 |
| N level/Leaf [Normal] | 31 |
| Normal-Shoot/Root | 32 |
| Normal-NUE roots | 33 |
| Normal-NUE shoots | 34 |
| Normal-NUE total biomass | 35 |
| Plant Height TP1-100 mM NaCl [cm$^2$] | 36 |
| Plant Height TP1-Cold [cm$^2$] | 37 |
| Plant Height TP1-Low Nitrogen [cm$^2$] | 38 |
| Plant Height TP1-Normal [cm$^2$] | 39 |
| Plant Height TP2-Cold [cm$^2$] | 40 |
| Plant Height TP2-Low Nitrogen [cm$^2$] | 41 |
| Plant Height TP2-Normal [cm$^2$] | 42 |
| Plant Height TP2-100 mM NaCl [cm$^2$] | 43 |
| Plant Height TP3-100 mM NaCl [cm$^2$] | 44 |
| Plant Height TP3-Low Nitrogen [cm$^2$] | 45 |
| GR Leaf Num Normal [number/days] | 46 |
| Root Biomass [DW-gr.]/SPAD [100 mM NaCl] | 47 |
| Root Biomass [DW-gr.]/SPAD [Cold] | 48 |
| Root Biomass [DW-gr.]/SPAD [Low Nitrogen] | 49 |
| Root Biomass [DW-gr.]/SPAD [Normal] | 50 |
| SPAD-Cold | 51 |
| SPAD-Low Nitrogen | 52 |
| SPAD-Normal | 53 |
| SPAD 100-mM NaCl | 54 |
| Shoot Biomass [DW-gr.]/SPAD [100 mM NaCl] | 55 |
| Shoot Biomass [DW-gr.]/SPAD [Cold] | 56 |
| Shoot Biomass [DW-gr.]/SPAD [Low Nitrogen] | 57 |
| Shoot Biomass [DW-gr.]/SPAD [Normal] | 58 |
| Total Biomass-Root + Shoot [DW-gr.]/SPAD [100 mM NaCl] | 59 |
| Total Biomass-Root + Shoot [DW-gr.]/SPAD [Cold] | 60 |
| Total Biomass-Root + Shoot [DW-gr.]/SPAD [Low Nitrogen] | 61 |
| Total Biomass-Root + Shoot [DW-gr.]/SPAD [Normal] | 62 |

Table 28: Provided are the *Sorghum* correlated parameters. Cold conditions = 10 ± 2° C.; NaCl = 100 mM NaCl; low nitrogen = 1.2 mM Nitrogen; Normal conditions = 16 mM Nitrogen * TP1-2-3 refers to time points 1, 2 and 3. The time period between TP1 and TP2 is 8 days and between TP2 and TP3 is 7 days (between TP1 and TP3 is 15 days).

TABLE 29

Sorghum accessions, measured parameters under different conditions (as described above)

| Corr. ID/Seed ID | L-1 | L-2 | L-3 | L-4 | L-5 | L-6 | L-7 | L-8 | L-9 | L-10 |
|---|---|---|---|---|---|---|---|---|---|---|
| 4 | 0.053 | 0.134 | 0.173 | 0.103 | 0.107 | 0.120 | 0.139 | 0.124 | 0.099 | 0.115 |
| 8 | 0.101 | 0.236 | 0.313 | 0.158 | 0.194 | 0.188 | 0.241 | 0.244 | 0.185 | 0.242 |
| 12 | 3.000 | 3.067 | 3.800 | 3.200 | 3.233 | 3.233 | 3.133 | 3.433 | 3.000 | 3.000 |
| 16 | 4.167 | 4.500 | 4.800 | 4.600 | 4.533 | 4.967 | 4.600 | 4.933 | 4.500 | 4.567 |
| 20 | 5.333 | 5.867 | 6.200 | 5.800 | 5.800 | 5.733 | 5.733 | 6.000 | 5.600 | 6.067 |
| 39 | 7.467 | 9.300 | 12.867 | 8.567 | 8.933 | 8.533 | 10.667 | 10.267 | 7.867 | 8.767 |
| 42 | 14.967 | 18.233 | 22.100 | 17.600 | 18.067 | 18.533 | 22.833 | 22.033 | 20.033 | 21.800 |
| 46 | 0.155 | 0.186 | 0.159 | 0.173 | 0.171 | 0.168 | 0.174 | 0.171 | 0.174 | 0.204 |
| 53 | 26.700 | 29.333 | 29.856 | 29.089 | 24.978 | 24.622 | 30.789 | 25.500 | 32.889 | 33.544 |
| 3 | 0.044 | 0.108 | 0.202 | 0.104 | 0.078 | 0.086 | 0.130 | 0.094 | 0.086 | 0.092 |
| 5 | 0.082 | 0.187 | 0.328 | 0.163 | 0.163 | 0.156 | 0.259 | 0.199 | 0.130 | 0.184 |
| 11 | 3.000 | 3.133 | 3.867 | 3.533 | 3.200 | 3.133 | 3.133 | 3.300 | 3.067 | 3.067 |
| 15 | 4.000 | 4.580 | 4.967 | 4.733 | 4.600 | 4.700 | 4.967 | 4.867 | 4.667 | 4.567 |
| 19 | 3.900 | 4.267 | 4.700 | 4.233 | 4.300 | 4.567 | 4.633 | 4.667 | 3.967 | 4.100 |
| 38 | 6.733 | 9.767 | 12.700 | 8.667 | 9.767 | 9.233 | 10.267 | 10.100 | 7.933 | 8.233 |
| 41 | 13.300 | 20.633 | 23.700 | 18.033 | 19.333 | 19.200 | 21.867 | 22.133 | 18.200 | 21.000 |
| 45 | 22.233 | 31.067 | 34.667 | 30.033 | 30.833 | 29.867 | 30.867 | 32.400 | 29.367 | 30.700 |
| 52 | 26.878 | 28.022 | 29.644 | 31.522 | 29.611 | 26.822 | 28.478 | 28.213 | 30.478 | 27.633 |
| 1 | 0.050 | 0.104 | 0.124 | 0.069 | 0.076 | 0.075 | 0.135 | 0.095 | 0.165 | 0.139 |
| 6 | 0.094 | 0.186 | 0.202 | 0.137 | 0.130 | 0.133 | 0.154 | 0.189 | 0.099 | 0.124 |
| 9 | 3.000 | 3.133 | 3.400 | 3.067 | 3.333 | 3.067 | 3.067 | 3.267 | 3.000 | 3.067 |
| 13 | 4.000 | 4.367 | 4.867 | 4.600 | 4.500 | 4.533 | 4.500 | 4.767 | 4.320 | 4.200 |
| 17 | 4.000 | 4.133 | 4.567 | 4.433 | 4.067 | 4.333 | 4.133 | 4.500 | 3.780 | 4.200 |
| 36 | 7.900 | 9.500 | 10.933 | 7.933 | 9.700 | 8.533 | 8.900 | 10.367 | 7.000 | 7.833 |
| 43 | 14.200 | 16.267 | 20.367 | 13.333 | 15.900 | 16.533 | 15.467 | 18.933 | 13.680 | 15.767 |
| 44 | 21.800 | 23.167 | 30.367 | 22.833 | 23.700 | 23.300 | 22.467 | 26.833 | 20.280 | 23.567 |
| 54 | 32.733 | 35.144 | 27.967 | 30.933 | 34.533 | 29.989 | 32.089 | 31.856 | 32.513 | 34.322 |
| 2 | 0.068 | 0.108 | 0.163 | 0.093 | 0.084 | 0.114 | 0.137 | 0.127 | 0.108 | 0.139 |
| 7 | 0.078 | 0.154 | 0.189 | 0.112 | 0.130 | 0.165 | 0.152 | 0.150 | 0.112 | 0.141 |
| 10 | 3.000 | 3.000 | 3.500 | 3.167 | 3.400 | 3.200 | 3.133 | 3.067 | 3.067 | 3.000 |

TABLE 29-continued

Sorghum accessions, measured parameters under different conditions (as described above)

| Corr. ID/Seed ID | L-1 | L-2 | L-3 | L-4 | L-5 | L-6 | L-7 | L-8 | L-9 | L-10 |
|---|---|---|---|---|---|---|---|---|---|---|
| 14 | 3.900 | 4.133 | 4.633 | 4.167 | 4.267 | 4.233 | 4.200 | 4.300 | 4.167 | 4.000 |
| 18 | 4.733 | 5.333 | 5.433 | 5.500 | 5.333 | 5.067 | 4.500 | 5.400 | 5.367 | 5.182 |
| 37 | 6.500 | 8.767 | 10.400 | 6.800 | 9.033 | 9.000 | 7.967 | 9.167 | 6.500 | 7.227 |
| 40 | 11.167 | 15.867 | 18.433 | 12.200 | 16.033 | 14.633 | 14.600 | 17.267 | 13.433 | 13.909 |
| 51 | 28.622 | 30.311 | 27.044 | 32.278 | 28.278 | 29.889 | 32.467 | 28.633 | 31.711 | 29.557 |
| 30 | 6.047 | 5.683 | 4.978 | 5.869 | 5.302 | 5.899 | 7.215 | 5.302 | 5.909 | 5.704 |
| 48 | 0.002 | 0.004 | 0.006 | 0.003 | 0.003 | 0.004 | 0.004 | 0.004 | 0.003 | 0.005 |
| 56 | 0.003 | 0.005 | 0.007 | 0.003 | 0.005 | 0.006 | 0.005 | 0.005 | 0.004 | 0.005 |
| 60 | 0.005 | 0.009 | 0.013 | 0.006 | 0.008 | 0.009 | 0.009 | 0.010 | 0.007 | 0.009 |
| 21 | 27.528 | 64.124 | 115.231 | 58.017 | 52.219 | 35.103 | 84.575 | 63.728 | 47.029 | 59.998 |
| 22 | 1.875 | 1.707 | 1.731 | 1.568 | 2.096 | 1.815 | 2.062 | 2.097 | 1.504 | 1.999 |
| 23 | 9.647 | 23.538 | 43.877 | 22.580 | 16.886 | 12.440 | 28.194 | 20.528 | 18.756 | 20.086 |
| 24 | 17.881 | 40.586 | 71.354 | 35.436 | 35.333 | 22.663 | 56.381 | 43.200 | 28.273 | 39.912 |
| 25 | 84.528 | 80.954 | 117.004 | 100.519 | 72.538 | 71.777 | 93.472 | 76.051 | 86.820 | 80.511 |
| 26 | 81.573 | 79.164 | 104.754 | 103.497 | 83.707 | 83.215 | 107.689 | 81.386 | 70.300 | 75.859 |
| 27 | 82.585 | 79.812 | 109.104 | 102.317 | 79.737 | 78.767 | 102.492 | 79.588 | 76.073 | 77.355 |
| 28 | 6.892 | 6.568 | 6.307 | 7.446 | 6.886 | 5.873 | 6.146 | 6.046 | 7.683 | 6.740 |
| 49 | 0.002 | 0.004 | 0.007 | 0.003 | 0.003 | 0.003 | 0.005 | 0.003 | 0.003 | 0.003 |
| 57 | 0.003 | 0.007 | 0.011 | 0.005 | 0.005 | 0.006 | 0.009 | 0.007 | 0.004 | 0.007 |
| 61 | 0.005 | 0.011 | 0.018 | 0.008 | 0.008 | 0.009 | 0.014 | 0.010 | 0.007 | 0.010 |
| 29 | 8.183 | 8.503 | 6.124 | 6.977 | 8.492 | 6.921 | 7.763 | 7.079 | 8.601 | 8.172 |
| 47 | 0.002 | 0.003 | 0.004 | 0.002 | 0.002 | 0.003 | 0.004 | 0.003 | 0.005 | 0.004 |
| 55 | 0.003 | 0.005 | 0.007 | 0.004 | 0.004 | 0.004 | 0.005 | 0.006 | 0.003 | 0.004 |
| 59 | 0.004 | 0.008 | 0.012 | 0.007 | 0.006 | 0.007 | 0.009 | 0.009 | 0.008 | 0.008 |
| 31 | 5.006 | 5.000 | 4.815 | 5.015 | 4.307 | 4.295 | 5.370 | 4.250 | 5.873 | 5.529 |
| 32 | 1.984 | 1.936 | 1.897 | 1.586 | 1.813 | 1.579 | 1.759 | 1.988 | 1.895 | 2.198 |
| 33 | 0.861 | 2.193 | 2.828 | 1.694 | 1.755 | 1.960 | 2.275 | 2.036 | 1.086 | 1.881 |
| 34 | 1.653 | 3.866 | 5.137 | 2.582 | 3.183 | 3.081 | 3.948 | 4.003 | 2.022 | 3.968 |
| 35 | 2.514 | 6.059 | 7.964 | 4.276 | 4.939 | 5.041 | 6.223 | 6.038 | 3.108 | 5.849 |
| 50 | 0.002 | 0.005 | 0.006 | 0.004 | 0.004 | 0.005 | 0.005 | 0.005 | 0.003 | 0.003 |
| 58 | 0.004 | 0.008 | 0.010 | 0.005 | 0.008 | 0.008 | 0.008 | 0.010 | 0.006 | 0.007 |
| 62 | 0.006 | 0.013 | 0.016 | 0.009 | 0.012 | 0.012 | 0.012 | 0.014 | 0.009 | 0.011 |

Table 29: Provided are the values of each of the parameters (as described above) measured in Sorghum accessions (Seed ID) under low nitrogen, cold, salinity and normal conditions. Growth conditions are specified in the experimental procedure section.

TABLE 30

Correlation between the expression level of selected genes of some embodiments of the invention in various tissues and the phenotypic performance under different conditions as described above across sorghum accessions

| Gene Name | R | P value | Exp. set | Cor. Set ID | Gene Name | R | P value | Exp. set | Cor. Set ID |
|---|---|---|---|---|---|---|---|---|---|
| LAB101 | 0.720 | 6.82E−02 | 3 | 26 | LAB572 | 0.749 | 5.25E−02 | 3 | 25 |
| WNU100 | 0.854 | 1.45E−02 | 3 | 49 | WNU100 | 0.783 | 3.75E−02 | 3 | 3 |
| WNU100 | 0.741 | 5.70E−02 | 3 | 15 | WNU100 | 0.890 | 7.31E−03 | 3 | 5 |
| WNU100 | 0.858 | 1.34E−02 | 3 | 45 | WNU100 | 0.835 | 1.95E−02 | 3 | 23 |
| WNU100 | 0.905 | 5.03E−03 | 3 | 61 | WNU100 | 0.903 | 5.32E−03 | 3 | 24 |
| WNU100 | 0.899 | 5.89E−03 | 3 | 21 | WNU100 | 0.895 | 6.44E−03 | 3 | 57 |
| WNU100 | 0.874 | 1.01E−02 | 3 | 41 | WNU101 | 0.864 | 1.23E−02 | 3 | 49 |
| WNU101 | 0.767 | 4.41E−02 | 3 | 3 | WNU101 | 0.762 | 4.67E−02 | 3 | 5 |
| WNU101 | 0.846 | 1.65E−02 | 3 | 61 | WNU101 | 0.800 | 3.06E−02 | 3 | 57 |
| WNU101 | 0.819 | 6.89E−03 | 2 | 50 | WNU101 | 0.833 | 5.25E−03 | 2 | 35 |
| WNU101 | 0.823 | 6.41E−03 | 2 | 34 | WNU101 | 0.730 | 2.55E−02 | 2 | 8 |
| WNU101 | 0.815 | 7.45E−03 | 2 | 20 | WNU101 | 0.745 | 2.13E−02 | 2 | 4 |
| WNU101 | 0.844 | 4.26E−03 | 2 | 58 | WNU101 | 0.847 | 4.00E−03 | 2 | 62 |
| WNU101 | 0.827 | 5.97E−03 | 2 | 33 | WNU101 | 0.831 | 5.51E−03 | 5 | 7 |
| WNU101 | 0.712 | 3.14E−02 | 5 | 48 | WNU101 | 0.707 | 3.31E−02 | 5 | 2 |
| WNU101 | 0.787 | 1.19E−02 | 5 | 56 | WNU101 | 0.773 | 1.46E−02 | 5 | 60 |
| WNU101 | 0.750 | 1.98E−02 | 8 | 50 | WNU101 | 0.759 | 1.77E−02 | 8 | 35 |
| WNU101 | 0.756 | 1.85E−02 | 8 | 34 | WNU101 | 0.767 | 1.58E−02 | 8 | 20 |
| WNU101 | 0.759 | 1.78E−02 | 8 | 58 | WNU101 | 0.763 | 1.68E−02 | 8 | 62 |
| WNU101 | 0.747 | 2.06E−02 | 8 | 33 | WNU101 | 0.729 | 1.68E−02 | 1 | 7 |
| WNU101 | 0.704 | 2.31E−02 | 1 | 60 | WNU105 | 0.749 | 2.02E−02 | 5 | 30 |
| WNU3 | 0.741 | 5.67E−02 | 3 | 15 | WNU3 | 0.729 | 6.32E−02 | 3 | 45 |
| WNU3 | 0.763 | 1.68E−02 | 2 | 12 | WNU3 | 0.778 | 1.35E−02 | 2 | 39 |
| WNU91 | 0.703 | 7.80E−02 | 3 | 49 | WNU91 | 0.802 | 2.99E−02 | 3 | 3 |
| WNU91 | 0.737 | 5.87E−02 | 3 | 15 | WNU91 | 0.833 | 2.01E−02 | 3 | 5 |
| WNU91 | 0.853 | 1.46E−02 | 3 | 45 | WNU91 | 0.889 | 7.46E−03 | 3 | 23 |
| WNU91 | 0.710 | 7.39E−02 | 3 | 61 | WNU91 | 0.933 | 2.18E−03 | 3 | 24 |
| WNU91 | 0.939 | 1.74E−03 | 3 | 21 | WNU91 | 0.779 | 3.90E−02 | 3 | 41 |

TABLE 30-continued

Correlation between the expression level of selected genes of some embodiments of the invention in various tissues and the phenotypic performance under different conditions as described above across *sorghum* accessions

| Gene Name | R | P value | Exp. set | Cor. Set ID | Gene Name | R | P value | Exp. set | Cor. Set ID |
|---|---|---|---|---|---|---|---|---|---|
| WNU91 | 0.763 | 1.69E−02 | 7 | 54 | WNU91 | 0.769 | 1.55E−02 | 8 | 31 |
| WNU91 | 0.813 | 7.69E−03 | 8 | 53 | WNU93 | 0.729 | 6.28E−02 | 3 | 25 |
| WNU94 | 0.879 | 9.08E−03 | 3 | 52 | WNU94 | 0.862 | 1.27E−02 | 3 | 28 |
| WNU94 | 0.886 | 1.49E−03 | 7 | 1 | WNU94 | 0.904 | 8.23E−04 | 7 | 59 |
| WNU94 | 0.902 | 8.90E−04 | 7 | 47 | WNU96 | 0.711 | 7.33E−02 | 3 | 28 |
| WNU96 | 0.716 | 3.02E−02 | 7 | 47 | WNU97 | 0.930 | 2.42E−03 | 3 | 49 |
| WNU97 | 0.828 | 2.14E−02 | 3 | 3 | WNU97 | 0.940 | 1.62E−03 | 3 | 5 |
| WNU97 | 0.838 | 1.86E−02 | 3 | 45 | WNU97 | 0.986 | 4.67E−05 | 3 | 61 |
| WNU97 | 0.788 | 3.53E−02 | 3 | 38 | WNU97 | 0.702 | 7.88E−02 | 3 | 19 |
| WNU97 | 0.975 | 1.94E−04 | 3 | 57 | WNU97 | 0.912 | 4.17E−03 | 3 | 41 |
| WNU97 | 0.704 | 3.44E−02 | 6 | 49 | WNU97 | 0.735 | 2.41E−02 | 6 | 3 |
| WNU97 | 0.727 | 2.64E−02 | 6 | 15 | WNU97 | 0.743 | 2.18E−02 | 6 | 5 |
| WNU97 | 0.735 | 2.40E−02 | 6 | 11 | WNU97 | 0.735 | 2.41E−02 | 6 | 23 |
| WNU97 | 0.708 | 3.30E−02 | 6 | 61 | WNU97 | 0.743 | 2.18E−02 | 6 | 24 |
| WNU97 | 0.749 | 2.03E−02 | 6 | 21 | WNU98 | 0.777 | 3.99E−02 | 3 | 52 |
| WNU98 | 0.733 | 6.09E−02 | 3 | 28 | WNU98 | 0.742 | 2.21E−02 | 7 | 47 |
| WNU99 | 0.706 | 7.63E−02 | 3 | 3 | WNU99 | 0.785 | 3.66E−02 | 3 | 15 |
| WNU99 | 0.716 | 7.06E−02 | 3 | 45 | WNU99 | 0.756 | 4.90E−02 | 3 | 23 |
| WNU99 | 0.815 | 2.56E−02 | 3 | 52 | WNU99 | 0.750 | 1.99E−02 | 5 | 7 |
| WNU99 | 0.742 | 2.20E−02 | 5 | 48 | WNU99 | 0.796 | 1.03E−02 | 5 | 56 |
| WNU99 | 0.793 | 1.08E−02 | 5 | 60 | WNU99 | 0.732 | 2.51E−02 | 5 | 37 |
| WNU99 | 0.835 | 5.09E−03 | 5 | 40 | WNU99 | 0.705 | 3.38E−02 | 5 | 14 |

Table 30 "Corr. ID"—correlation set ID according to the correlated parameters Table above.
"Exp. Set"—Expression set.
"R" = Pearson correlation coefficient;
"P" = p value.

Example 9

Production of Maize Transcriptome and High Throughput Correlation Analysis with Yield and Nue Related Parameters when Grown Under Normal or Reduced Nitrogen Fertilization Using 60K Maize Oligonucleotide Micro-Arrays In order to produce a high throughput correlation analysis between plant phenotype and gene expression level, the present inventors utilized a maize oligonucleotide microarray, produced by Agilent Technologies [chem. (dot) agilent (dot) com/Scripts/PDS (dot) asp?1Page=50879]. The array oligonucleotide represents about 44,000 maize genes and transcripts.

Correlation of Maize Hybrids Across Ecotypes Grown Under Low Nitrogen Conditions Experimental Procedures 12 Maize hybrids were grown in 3 repetitive plots, in field. Maize seeds were planted and plants were grown in the field using commercial fertilization and irrigation protocols (485 metric cubes of water per dunam, 30 units of uran 21% fertilization per entire growth period) and 50% of commercial fertilization for low N treatment. In order to define correlations between the levels of RNA expression with NUE and yield components or vigor related parameters, the 12 different maize hybrids were analyzed. Among them, 11 hybrids encompassing the observed variance were selected for RNA expression analysis. The correlation between the RNA levels and the characterized parameters was analyzed using Pearson correlation test [davidmlane (dot) com/hyperstat/A34739 (dot) html].

Analyzed Maize tissues—All 11 selected maize hybrids were sampled per each treatment (low N and normal conditions), in three time points (TP2=V6-V8 (six to eight collar leaf are visible, rapid growth phase and kernel row determination begins), TP5=R1-R2 (silking-blister), TP6=R3-R4 (milk-dough). Four types of plant tissues [Ear, flag leaf indicated in Tables 31-32 as leaf, grain distal part, and internode] were sampled and RNA was extracted as described above. Each micro-array expression information tissue type has received a Set ID as summarized in Tables 31-32 below.

TABLE 31

Maize transcriptome expression sets under normal conditions

| Expression Set | Set ID |
|---|---|
| Maize field Normal Ear R1-R2 | 1 |
| Maize field Normal Grain Distal R4-R5 | 2 |
| Maize field Normal Internode R3-R4 | 3 |
| Maize field Normal Leaf R1-R2 | 4 |
| Maize field Normal Ear R3-R4 | 5 |
| Maize field Normal Internode R1-R2 | 6 |
| Maize field Normal Internode V6-V8 | 7 |
| Maize field Normal Leaf V6-V8 | 8 |

Table 31: Provided are the maize transcriptome expression sets. Leaf = the leaf below the main ear; Internodes = internodes located above and below the main ear in the plant.

TABLE 32

Maize transcriptome expression sets under low N conditions

| Expression Set | Set ID |
|---|---|
| Maize field Low N Ear TP5 | 1 |
| Maize field Low N Ear TP6 | 2 |
| Maize field Low N Internodes TP2 | 3 |

TABLE 32-continued

Maize transcriptome expression sets under low N conditions

| Expression Set | Set ID |
|---|---|
| Maize field Low N Internodes TP5 | 4 |
| Maize field Low N Internodes TP6 | 5 |
| Maize field Low N Leaf TP2 | 6 |
| Maize field Low N Leaf TP5 | 7 |
| Maize field Low N Leaf TP6 | 8 |

Table 32.

The following parameters were collected using digital imaging system:

Grain Area ($cm^2$)—At the end of the growing period the grains were separated from the ear. A sample of ~200 grains were weighted, photographed and images were processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—At the end of the growing period 5 ears were, photographed and images were processed using the below described image processing system. The Ear area was measured from those images and was divided by the number of Ears.

Ear Length and Ear Width (cm)—At the end of the growing period 5 ears were, photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

The following parameters were collected were collected either by sampling 6 plants per plot or by measuring the parameter across all the plants within the plot.

Seed yield per plant (Kg.)—At the end of the experiment all ears from plots within blocks A-C were collected. 6 ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear weight per plot (gr.)—At the end of the experiment (when ears were harvested) total and 6 selected ears per plots within blocks were collected separately. The plants with (total and 6) were weighted (gr.) separately and the average ear per plant was calculated for Ear weight per plot (total of 42 plants per plot).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located Leaf number per plant—Plants were characterized for leaf number during growing period at 5 time points. In each measure, plants were measured for their leaf number by counting all the leaves of 3 selected plants per plot.

SPAD—Chlorophyll content was determined using a Minolta SPAD 502 chlorophyll meter and measurement was performed 64 days post sowing. SPAD meter readings were done on young fully developed leaf. Seven measurements per leaf were taken per plot. Data were taken after once per weeks after sowing.

Dry weight per plant—At the end of the experiment (when Inflorescence were dry) all vegetative material from plots within blocks A-C were collected.

Dry weight=total weight of the vegetative portion above ground (excluding roots) after drying at 70° C. in oven for 48 hours;

Ear length of Filled Ear [cm]—it was calculated as the length of the ear with grains out of the total ear.

Ear length and width [cm]—it was calculated as the length and width of the ear in the filled. Measurement was performed in 6 plants per each plot.

Kernel Row Number per Ear—The number of rows in each ear was counted.

Stalk width [cm]—The diameter of the stalk was measured in the internode located below the main ear. Measurement was performed in 6 plants per each plot.

Leaf area index [LAI]—total leaf area of all plants in a plot. Measurement was performed using a Leaf area-meter.

NUE [kg/kg]—is the ratio between total grain yield per total N applied in soil.

NUpE [kg/kg]—is the ratio between total plant biomass per total N applied in soil.

Yield/stalk width [kg/cm]—is the ratio between total grain yields and the width of the stalk.

Yield/LAI [kg]—is the ratio between total grain yields and total leaf area index.

Experimental Results 11 different maize hybrids were grown and characterized for different parameters. Tables 33-34 describe the Maize correlated parameters. The average for each of the measured parameters (Tables 35-36) was calculated using the JMP software and a subsequent correlation analysis was performed (Tables 37-38). Results were then integrated to the database.

TABLE 33

Maize correlated parameters (vectors) under normal conditions

| Correlated parameter with | Correlation ID |
|---|---|
| Normal-Final Plant DW [kg] | 1 |
| Normal-Ear Length [cm] | 2 |
| Normal-Ear length of filled area [cm] | 3 |
| Normal-Ear width [mm] | 4 |
| Normal-Final Leaf Number | 5 |
| Normal-Final Main Ear Height [cm] | 6 |
| Normal-Final Plant Height [cm] | 7 |
| Normal-Leaf No TP5 | 8 |
| Normal-Leaf No TP2 | 9 |
| Normal-Leaf No TP3 | 10 |
| Normal-Leaf No TP4 | 11 |

TABLE 33-continued

Maize correlated parameters (vectors) under normal conditions

| Correlated parameter with | Correlation ID |
|---|---|
| Normal-No of rows per ear | 12 |
| Normal-Plant Height TP4 [cm] | 13 |
| Normal-Plant Height TP5 [cm] | 14 |
| Normal-Plant Height TP1 [cm] | 15 |
| Normal-Plant Height TP2 [cm] | 16 |
| Normal-Plant Height TP3 [cm] | 17 |
| Normal-SPAD TP6 R1-2 | 18 |
| Normal-SPAD TP3 | 19 |
| Normal-SPAD TP4 Most of the Plants at flowering | 20 |
| Normal-SPAD TP5 | 21 |
| Normal-SPAD TP1 | 22 |
| Normal-SPAD TP2 | 23 |
| Normal-SPAD TP7 R3-R4 | 24 |
| Normal-SPAD TP8 R3-R4 | 25 |
| Normal-Stalk width TP7 [cm] | 26 |
| Normal-Ear weight per plot (42 plants per plot) [0-RH] [kg] | 27 |
| Normal-LAI | 28 |
| Normal-NUE yield kg/N applied in soil kg | 29 |
| Normal-NUE at early grain filling [R1-R2] yield Kg/N in plant SPAD | 30 |
| Normal-NUE at grain filling [R3-R4] yield Kg/ N in plant SPAD | 31 |
| Normal-NUpE [biomass/N applied] | 32 |
| Normal-Seed yield per dunam [kg] | 33 |
| Normal-Yield/LAI | 34 |
| Normal-Yield/stalk width | 35 |
| Normal-seed yield per 1 plant rest of the plot [0-RH] [kg] | 36 |

Table 33. "cm" = centimeters' "mm" = millimeters; "kg" = kilograms; SPAD at R1-R2 and SPAD R3-R4: Chlorophyll level after early and late stages of grain filling; "NUE" = nitrogen use efficiency; "NUE" = nitrogen uptake efficiency; "LAI" =leaf area; "N" = nitrogen; Low N = under low Nitrogen conditions; "Normal" = under normal conditions; "dunam" = 1000 m². "TP" = time point.

TABLE 34

Maize correlated parameters (vectors) under low N conditions

| Correlated parameter with | Correlation ID |
|---|---|
| Low N-Ear Length [cm] | 1 |
| Low N-Ear length of filled area [cm] | 2 |
| Low N-Ear width [mm] | 3 |
| Low N-Final Leaf Number | 4 |
| Low N-Final Main Ear Height [cm] | 5 |
| Low N-Final Plant Height [cm] | 6 |
| Low N-Leaf No TP5 | 7 |
| Low N-Leaf No TP1 | 8 |
| Low N-Leaf No TP2 | 9 |
| Low N-Leaf No TP3 | 10 |
| Low N-Leaf No TP4 | 11 |
| Low N-No of rows per ear | 12 |
| Low N-Plant Height TP4 [cm] | 13 |
| Low N-Plant Height TP5 [cm] | 14 |
| Low N-Plant Height TP1 [cm] | 15 |
| Low N-Plant Height TP2 [cm] | 16 |
| Low N-Plant Height TP3 [cm] | 17 |
| Low N-SPAD TP6 R1-2 | 18 |
| Low N-SPAD TP3 | 19 |
| Low N-SPAD TP4 Most of the Plants at flowering | 20 |
| Low N-SPAD TP5 | 21 |
| Low N-SPAD TP1 | 22 |
| Low N-SPAD TP2 | 23 |
| Low N-SPAD TP8 R3-R4 | 24 |
| Low N-Stalk width TP7 [cm] | 25 |
| Low N-Ear weight per plot (42 plants per plot) [0-RH] | 26 |
| Low N-Final Plant DW [kg] | 27 |
| Low N-LAI | 28 |
| Low N-NUE yield kg/N applied in soil kg | 29 |
| Low N-NUE at early grain filling [R1-R2] yield Kg/N in plant SPAD | 30 |
| Low N-NUE at grain filling [R3-R4] yield Kg/N in plant SPAD | 31 |
| Low N-NUpE [biomass/N applied] | 32 |
| Low N-Seed yield per dunam [kg] | 33 |
| Low N-Yield/LAI | 34 |
| Low N-Yield/stalk width | 35 |
| Low N-seed yield per 1 plant rest of the plot [0-RH] [kg] | 36 |

Table 34. Provided are the values of each of the parameters (as described above) measured in maize accessions (Seed ID) under low nitrogen fertilization. Growth conditions are specified in the experimental procedure section. "TP" = time point.

TABLE 35

Measured parameters in Maize accessions under normal fertilization

| Cor. ID/L | L-1 | L-2 | L-3 | L-4 | L-5 | L-6 | L-7 | L-8 | L-9 | L-10 | L-11 |
|---|---|---|---|---|---|---|---|---|---|---|---|
| 1 | 1.3 | 1.3 | 1.3 | 1.5 | 1.3 | 1.6 | 1.4 | 1.4 | 11.4 | 1.7 | 0.4 |
| 2 | 19.9 | 20.2 | 18.1 | 19.9 | 19.5 | 17.7 | 17.7 | 17.3 | 20.5 | 17.5 | 19.9 |
| 3 | 16.2 | 17.5 | 17.7 | 18.4 | 15.7 | 14.7 | 12.9 | 14.0 | 18.8 | 12.3 | 16.1 |
| 4 | 51.1 | 46.3 | 45.9 | 47.6 | 51.4 | 47.4 | 47.3 | 46.8 | 49.3 | 48.3 | 41.8 |
| 5 | 11.8 | 11.1 | 11.8 | 11.9 | 12.3 | 12.4 | 12.2 | 12.6 | 11.7 | 9.3 | |
| 6 | 130.3 | 122.3 | 127.7 | 113.0 | 135.3 | 94.3 | 120.9 | 107.7 | 112.5 | 139.7 | 60.4 |
| 7 | 273.5 | 260.5 | 288.0 | 238.5 | 286.9 | 224.8 | 264.4 | 251.6 | 278.4 | 279.0 | 163.8 |
| 8 | 12.4 | 12.8 | 14.2 | 13.4 | 12.8 | 14.0 | 13.3 | 14.3 | 14.6 | 12.8 | 11.6 |
| 9 | 7.3 | 8.8 | 9.5 | 8.9 | 7.1 | 10.1 | 9.2 | 9.7 | 9.2 | 7.4 | 8.9 |
| 10 | 8.4 | 10.3 | 10.8 | 10.4 | 7.9 | 11.8 | 10.8 | 11.5 | 11.3 | 8.7 | 10.6 |
| 11 | 9.4 | 11.1 | 11.8 | 11.3 | 9.0 | 11.4 | 11.2 | 11.8 | 12.0 | 9.3 | 10.8 |
| 12 | 16.1 | 14.7 | 15.4 | 15.9 | 16.2 | 15.2 | 16.0 | 14.8 | 15.4 | 17.7 | 14.3 |
| 13 | 74.3 | 33.4 | 75.8 | 55.9 | 72.3 | 58.1 | 62.2 | 58.7 | 51.6 | 75.7 | 64.3 |
| 14 | 100.9 | 168.5 | 182.7 | 159.7 | 102.3 | 173.5 | 156.7 | 185.2 | 178.2 | 121.9 | 152.8 |
| 15 | 27.0 | 70.7 | 70.3 | 67.5 | 23.8 | 63.2 | 59.4 | 65.1 | 58.7 | 25.1 | 61.2 |
| 16 | 10.6 | 24.4 | 25.1 | 25.8 | 8.7 | 34.2 | 21.2 | 24.5 | 22.4 | 9.1 | 24.4 |
| 17 | 19.8 | 45.3 | 48.0 | 45.7 | 16.9 | 44.9 | 38.8 | 48.6 | 45.4 | 17.9 | 40.9 |
| 18 | 56.9 | 57.2 | 59.3 | 61.6 | 58.6 | 61.2 | 60.2 | 61.1 | 62.2 | 57.5 | 52.0 |
| 19 | 60.3 | 55.8 | 60.3 | 58.6 | 60.4 | 53.7 | 56.2 | 55.2 | 52.8 | 57.3 | 57.2 |
| 20 | 54.6 | 57.2 | 56.0 | 58.7 | 54.8 | 59.1 | 58.0 | 60.4 | 61.1 | 53.3 | 51.4 |
| 21 | 50.6 | 55.7 | 53.2 | 58.0 | 51.7 | 58.7 | 55.9 | 56.8 | 59.7 | 51.1 | 51.8 |
| 22 | 49.6 | 48.4 | 45.7 | 49.8 | 48.3 | 48.2 | 45.4 | 47.9 | 46.2 | 48.9 | 42.4 |
| 23 | 50.9 | 46.7 | 43.7 | 50.5 | 51.0 | 49.0 | 46.5 | 46.7 | 49.4 | 50.9 | 45.9 |

TABLE 35-continued

Measured parameters in Maize accessions under normal fertilization

| Cor. ID/L | L-1 | L-2 | L-3 | L-4 | L-5 | L-6 | L-7 | L-8 | L-9 | L-10 | L-11 |
|---|---|---|---|---|---|---|---|---|---|---|---|
| 24 | 59.9 | 60.9 | 56.9 | 58.7 | 58.7 | 63.2 | 59.8 | 62.4 | 61.9 | 57.2 | 49.3 |
| 25 | 2.9 | 2.6 | 2.7 | 2.9 | 2.7 | 2.6 | 2.9 | 2.7 | 2.8 | 2.7 | 2.3 |
| 26 | 5.7 | 7.8 | 7.6 | 7.1 | 5.1 | 7.9 | 7.5 | 8.0 | 7.7 | 5.3 | 7.1 |
| 27 | 8.9 | 7.0 | 7.5 | 8.0 | 8.5 | 5.6 | 6.1 | 6.7 | 8.4 | 8.2 | 1.9 |
| 29 | 4.5 | 3.6 | 4.0 | 4.2 | 4.0 | 3.1 | 3.3 | 3.5 | 4.6 | 4.1 | 1.0 |
| 30 | 23.4 | 19.1 | 20.3 | 20.7 | 20.5 | 15.4 | 16.4 | 17.2 | 22.0 | 21.0 | 5.7 |
| 31 | 25.0 | 17.8 | 20.3 | 20.0 | 19.0 | 13.9 | 16.2 | 17.2 | 21.0 | 21.5 | 5.5 |
| 32 | 0.0 | 0.0 | 0.0 | 0.0 | 0.0 | 0.0 | 0.0 | 0.0 | 0.1 | 0.0 | 0.0 |
| 33 | 1335.6 | 1087.1 | 1202.5 | 1271.2 | 1203.0 | 937.1 | 985.9 | 1050.1 | 1365.3 | 1226.1 | 300.9 |
| 35 | 456.7 | 412.4 | 443.4 | 438.7 | 446.7 | 357.0 | 337.5 | 385.8 | 481.9 | 471.6 | 139.7 |
| 36 | 0.2 | 0.1 | 0.2 | 0.2 | 0.2 | 0.1 | 0.1 | 0.1 | 0.2 | 0.2 | 0.0 |
| 28 | 3.2 | 3.9 | 3.3 | 4.0 | 3.9 | 4.2 | 4.0 | 4.3 | 2.9 | 4.3 | |
| 34 | 426.1 | 313.0 | 307.3 | 362.4 | 314.1 | 224.6 | 266.4 | 261.7 | 482.3 | | |

TABLE 36

Measured parameters in Maize accessions under low Nitrogen fertilization

| Cor. ID/L | L-1 | L-2 | L-3 | L-4 | L-5 | L-6 | L-7 | L-8 | L-9 | L-10 | L-11 |
|---|---|---|---|---|---|---|---|---|---|---|---|
| 1 | 20.6 | 21.0 | 20.2 | 20.1 | 20.1 | 18.5 | 19.1 | 18.3 | 20.1 | 17.8 | 21.3 |
| 2 | 18.4 | 18.4 | 19.8 | 18.8 | 16.2 | 16.0 | 15.3 | 15.7 | 16.8 | 14.1 | 19.6 |
| 3 | 46.7 | 48.2 | 48.3 | 49.9 | 52.9 | 47.4 | 49.6 | 48.6 | 52.4 | 42.6 | 50.0 |
| 4 | 15.0 | 11.6 | 13.5 | 11.6 | 11.8 | 11.9 | 12.6 | 11.7 | 12.4 | 9.3 | 13.2 |
| 5 | 158.1 | 136.2 | 128.4 | 133.1 | 137.8 | 99.6 | 130.2 | 114.6 | 143.9 | 61.6 | 114.4 |
| 6 | 305.8 | 270.9 | 290.6 | 252.2 | 260.2 | 227.2 | 271.7 | 248.6 | 279.3 | 171.3 | 269.8 |
| 7 | 12.7 | 12.4 | 14.4 | 13.1 | 12.2 | 14.3 | 13.6 | 14.9 | 11.6 | 11.7 | 14.9 |
| 8 | 6.5 | 7.9 | 7.7 | 7.2 | 5.0 | 8.6 | 7.5 | 8.4 | 5.2 | 7.4 | 7.8 |
| 9 | 8.2 | 8.3 | 8.6 | 8.2 | 7.6 | 10.4 | 8.1 | 8.6 | 6.6 | 8.1 | 8.8 |
| 10 | 9.7 | 10.3 | 10.4 | 10.4 | 7.9 | 11.2 | 10.1 | 11.6 | 7.7 | 10.4 | 10.9 |
| 11 | 11.2 | 11.6 | 12.1 | 11.5 | 8.9 | 11.8 | 11.4 | 12.3 | 8.9 | 11.1 | 12.1 |
| 12 | 14.2 | 15.2 | 15.0 | 15.7 | 16.0 | 15.9 | 15.6 | 14.5 | 16.4 | 14.4 | 15.7 |
| 13 | 71.5 | 75.6 | 59.7 | 68.3 | 69.0 | 48.8 | 72.7 | 79.5 | 65.5 | 42.6 | 68.6 |
| 14 | 132.9 | 193.7 | 183.8 | 162.6 | 96.8 | 177.6 | 161.6 | 191.7 | 94.5 | 170.1 | 184.6 |
| 15 | 34.5 | 72.9 | 70.5 | 65.6 | 21.2 | 60.4 | 58.4 | 67.5 | 21.3 | 64.3 | 60.4 |
| 16 | 16.2 | 24.5 | 23.4 | 24.1 | 8.9 | 22.2 | 20.7 | 23.6 | 8.1 | 24.0 | 22.6 |
| 17 | 30.1 | 49.2 | 47.3 | 46.4 | 19.8 | 46.2 | 38.1 | 52.6 | 15.6 | 43.1 | 44.7 |
| 18 | 60.2 | 57.9 | 58.8 | 59.5 | 58.5 | 64.0 | 56.4 | 60.0 | 58.3 | 53.1 | 61.7 |
| 19 | 52.4 | 55.4 | 56.1 | 58.7 | 53.7 | 55.2 | 56.7 | 60.1 | 54.9 | 52.8 | 57.8 |
| 20 | 54.0 | 56.4 | 56.8 | 59.8 | 53.9 | 60.2 | 57.8 | 60.1 | 53.5 | 51.5 | 59.9 |
| 21 | 53.8 | 55.0 | 52.7 | 56.6 | 50.4 | 59.1 | 56.1 | 58.4 | 50.5 | 51.3 | 56.4 |
| 22 | 52.6 | 48.1 | 43.4 | 47.0 | 47.0 | 49.8 | 49.0 | 50.0 | 49.7 | 44.3 | 61.3 |
| 23 | 55.8 | 46.7 | 45.4 | 48.8 | 48.6 | 50.9 | 47.2 | 47.9 | 51.2 | 45.5 | 49.0 |
| 24 | 59.3 | 57.6 | 58.4 | 59.2 | 58.2 | 62.7 | 61.0 | 59.9 | 57.5 | 49.6 | 61.9 |
| 25 | 2.8 | 2.4 | 2.7 | 2.8 | 2.7 | 2.6 | 3.0 | 2.6 | 2.7 | 2.3 | 2.8 |
| 26 | 6.6 | 8.0 | 9.6 | 9.2 | 7.6 | 7.2 | 7.9 | 29.0 | 7.8 | 2.4 | 9.8 |
| 27 | 1.6 | 1.4 | 1.5 | 2.0 | 1.5 | 1.6 | 1.1 | 1.3 | 1.5 | 0.4 | 1.5 |
| 29 | 7.2 | 8.4 | 10.3 | 10.0 | 7.6 | 7.7 | 8.0 | 8.3 | 7.6 | 2.6 | 10.6 |
| 30 | 18.0 | 21.8 | 26.3 | 25.1 | 19.5 | 18.0 | 21.4 | 20.8 | 19.7 | 7.2 | 25.7 |
| 31 | 18.4 | 21.9 | 26.5 | 25.3 | 19.7 | 18.5 | 19.8 | 20.9 | 19.9 | 7.7 | 25.9 |
| 32 | 0.0 | 0.0 | 0.0 | 0.0 | 0.0 | 0.0 | 0.0 | 0.0 | 0.0 | 0.0 | 0.0 |
| 33 | 1083.7 | 1261.6 | 1549.2 | 1497.9 | 1143.9 | 1159.3 | 1207.4 | 1250.1 | 1146.0 | 383.2 | 1589.9 |
| 35 | 416.5 | 528.4 | 583.5 | 541.0 | 428.1 | 444.3 | 407.2 | 477.4 | 445.6 | 167.9 | 562.3 |
| 36 | 0.1 | 0.2 | 0.2 | 0.2 | 0.1 | 0.1 | 0.2 | 0.2 | 0.1 | 0.0 | 0.2 |
| 28 | 2.9 | 3.2 | 3.3 | 2.9 | 2.8 | 3.8 | 3.5 | 5.0 | | | 3.2 |
| 34 | 341.5 | 408.1 | 464.8 | 522.3 | 439.5 | 312.6 | 345.9 | 287.7 | | | 501.2 |

Table 36: Provided are the values of each of the parameters (as described above) measured in maize accessions (Seed ID) under low nitrogen fertilization. Growth conditions are specified in the experimental procedure section.

TABLE 37

Correlation between the expression level of selected genes of some embodiments of the invention in various tissues and the phenotypic performance under normal fertilization conditions across maize accessions

| Gene Name | R | P value | Exp. set | Corr. Set ID | Gene Name | R | P value | Exp. set | Corr. Set ID |
|---|---|---|---|---|---|---|---|---|---|
| LAB290H0 | 0.719 | 1.07E−01 | 1 | 28 | LAB290_H0 | 0.711 | 1.13E−01 | 5 | 20 |
| LAB290_H0 | 0.803 | 5.43E−02 | 5 | 32 | LAB290_H0 | 0.904 | 1.35E−02 | 5 | 8 |

TABLE 37-continued

Correlation between the expression level of selected genes of some embodiments of the invention in various tissues and the phenotypic performance under normal fertilization conditions across maize accessions

| Gene Name | R | P value | Exp. set | Corr. Set ID | Gene Name | R | P value | Exp. set | Corr. Set ID |
|---|---|---|---|---|---|---|---|---|---|
| LAB290_H0 | 0.752 | 8.49E−02 | 5 | 17 | LAB290_H0 | 0.763 | 7.74E−02 | 5 | 14 |
| LAB290_H0 | 0.803 | 5.43E−02 | 5 | 1 | LAB290_H0 | 0.712 | 1.13E−01 | 5 | 18 |
| LAB290_H0 | 0.767 | 7.51E−02 | 5 | 11 | LAB290_H0 | 0.815 | 2.56E−02 | 4 | 16 |
| LAB290_H0 | 0.747 | 3.33E−02 | 3 | 22 | LAB290_H0 | 0.838 | 1.86E−02 | 6 | 20 |
| LAB290_H0 | 0.766 | 4.48E−02 | 6 | 22 | LAB290_H0 | 0.847 | 1.62E−02 | 6 | 21 |
| LAB290_H0 | 0.854 | 1.44E−02 | 6 | 24 | LAB290_H0 | 0.712 | 7.27E−02 | 6 | 8 |
| LAB290_H0 | 0.759 | 4.79E−02 | 6 | 16 | LAB290_H0 | 0.770 | 4.27E−02 | 6 | 4 |
| LAB290_H0 | 0.715 | 7.10E−02 | 6 | 10 | LAB290_H0 | 0.734 | 6.06E−02 | 6 | 9 |
| LAB290_H0 | 0.875 | 9.83E−03 | 6 | 18 | LYM213 | 0.796 | 5.83E−02 | 5 | 5 |
| LYM213 | 0.750 | 8.56E−02 | 5 | 17 | LYM213 | 0.742 | 9.11E−02 | 5 | 14 |
| LYM213 | 0.782 | 6.62E−02 | 5 | 15 | LYM213 | 0.735 | 3.78E−02 | 2 | 20 |
| LYM213 | 0.719 | 4.43E−02 | 2 | 8 | LYM213 | 0.785 | 2.09E−02 | 2 | 18 |
| LYM213 | 0.717 | 1.97E−02 | 8 | 3 | WNU104 | 0.912 | 4.19E−03 | 1 | 26 |
| WNU104 | 0.823 | 2.30E−02 | 1 | 14 | WNU104 | 0.758 | 4.81E−02 | 1 | 9 |
| WNU104 | 0.943 | 4.71E−03 | 5 | 28 | WNU104 | 0.778 | 6.87E−02 | 5 | 24 |
| WNU104 | 0.715 | 1.10E−01 | 5 | 9 | WNU104 | 0.735 | 3.79E−02 | 2 | 4 |
| WNU104 | 0.702 | 7.87E−02 | 4 | 24 | WNU104 | 0.964 | 4.62E−04 | 4 | 26 |
| WNU104 | 0.857 | 1.37E−02 | 4 | 14 | WNU104 | 0.802 | 1.67E−02 | 3 | 25 |
| WNU104 | 0.838 | 1.85E−02 | 6 | 26 | WNU104 | 0.840 | 1.79E−02 | 6 | 14 |
| WNU104 | 0.746 | 2.11E−02 | 7 | 3 | WNU75 | 0.827 | 2.18E−02 | 1 | 3 |
| WNU75 | 0.730 | 9.93E−02 | 1 | 34 | WNU75 | 0.762 | 2.81E−02 | 2 | 5 |
| WNU75 | 0.834 | 2.70E−03 | 8 | 25 | WNU75 | 0.707 | 2.22E−02 | 8 | 4 |
| WNU75 | 0.891 | 5.34E−04 | 8 | 12 | WNU75 | 0.801 | 3.03E−02 | 4 | 25 |
| WNU75 | 0.788 | 3.53E−02 | 4 | 3 | WNU75 | 0.784 | 3.69E−02 | 4 | 33 |
| WNU75 | 0.751 | 5.17E−02 | 4 | 35 | WNU75 | 0.784 | 3.70E−02 | 4 | 27 |
| WNU75 | 0.788 | 3.53E−02 | 4 | 30 | WNU75 | 0.784 | 3.69E−02 | 4 | 29 |
| WNU75 | 0.774 | 4.12E−02 | 4 | 31 | WNU75 | 0.738 | 5.83E−02 | 4 | 6 |
| WNU75 | 0.869 | 1.11E−02 | 4 | 12 | WNU75 | 0.784 | 3.69E−02 | 4 | 36 |
| WNU75 | 0.855 | 1.42E−02 | 6 | 22 | WNU75 | 0.721 | 6.77E−02 | 6 | 25 |
| WNU75 | 0.768 | 4.37E−02 | 6 | 12 | WNU76 | 0.897 | 6.14E−03 | 1 | 7 |
| WNU76 | 0.827 | 2.18E−02 | 1 | 20 | WNU76 | 0.745 | 5.49E−02 | 1 | 22 |
| WNU76 | 0.818 | 2.47E−02 | 1 | 25 | WNU76 | 0.824 | 2.27E−02 | 1 | 21 |
| WNU76 | 0.763 | 4.60E−02 | 1 | 24 | WNU76 | 0.800 | 3.07E−02 | 1 | 33 |
| WNU76 | 0.785 | 3.65E−02 | 1 | 35 | WNU76 | 0.805 | 2.88E−02 | 1 | 27 |
| WNU76 | 0.800 | 3.07E−02 | 1 | 30 | WNU76 | 0.800 | 3.07E−02 | 1 | 29 |
| WNU76 | 0.862 | 1.26E−02 | 1 | 4 | WNU76 | 0.837 | 1.88E−02 | 1 | 31 |
| WNU76 | 0.861 | 1.28E−02 | 1 | 6 | WNU76 | 0.800 | 3.07E−02 | 1 | 36 |
| WNU76 | 0.713 | 7.19E−02 | 1 | 18 | WNU76 | 0.725 | 1.03E−01 | 5 | 24 |
| WNU76 | 0.834 | 3.92E−02 | 5 | 23 | WNU76 | 0.755 | 3.05E−02 | 2 | 4 |
| WNU76 | 0.778 | 3.95E−02 | 4 | 7 | WNU76 | 0.750 | 5.20E−02 | 4 | 20 |
| WNU76 | 0.779 | 3.92E−02 | 4 | 24 | WNU76 | 0.701 | 7.90E−02 | 4 | 33 |
| WNU76 | 0.733 | 6.08E−02 | 4 | 26 | WNU76 | 0.731 | 6.19E−02 | 4 | 35 |
| WNU76 | 0.723 | 6.62E−02 | 4 | 27 | WNU76 | 0.713 | 7.19E−02 | 4 | 30 |
| WNU76 | 0.701 | 7.90E−02 | 4 | 29 | WNU76 | 0.852 | 1.49E−02 | 4 | 17 |
| WNU76 | 0.728 | 6.38E−02 | 4 | 31 | WNU76 | 0.761 | 4.68E−02 | 4 | 6 |
| WNU76 | 0.789 | 3.47E−02 | 4 | 14 | WNU76 | 0.701 | 7.90E−02 | 4 | 36 |
| WNU76 | 0.915 | 3.91E−03 | 6 | 20 | WNU76 | 0.853 | 1.46E−02 | 6 | 22 |
| WNU76 | 0.795 | 3.28E−02 | 6 | 25 | WNU76 | 0.916 | 3.72E−03 | 6 | 21 |
| WNU76 | 0.902 | 5.42E−03 | 6 | 24 | WNU76 | 0.714 | 7.17E−02 | 6 | 3 |
| WNU76 | 0.753 | 5.06E−02 | 6 | 33 | WNU76 | 0.711 | 7.34E−02 | 6 | 23 |
| WNU76 | 0.746 | 5.43E−02 | 6 | 35 | WNU76 | 0.750 | 5.24E−02 | 6 | 27 |
| WNU76 | 0.739 | 5.75E−02 | 6 | 30 | WNU76 | 0.753 | 5.06E−02 | 6 | 29 |
| WNU76 | 0.900 | 5.70E−03 | 6 | 4 | WNU76 | 0.769 | 4.31E−02 | 6 | 31 |
| WNU76 | 0.876 | 9.66E−03 | 6 | 12 | WNU76 | 0.753 | 5.06E−02 | 6 | 36 |
| WNU76 | 0.813 | 2.62E−02 | 6 | 18 | WNU76 | 0.774 | 1.43E−02 | 7 | 25 |
| WNU76 | 0.751 | 1.96E−02 | 7 | 24 | WNU76 | 0.796 | 1.03E−02 | 7 | 8 |
| WNU76 | 0.746 | 2.10E−02 | 7 | 5 | WNU78 | 0.753 | 3.11E−02 | 2 | 13 |
| WNU78 | 0.716 | 3.02E−02 | 8 | 28 | WNU78 | 0.840 | 1.79E−02 | 4 | 15 |
| WNU78 | 0.833 | 1.99E−02 | 6 | 23 | WNU80 | 0.841 | 3.57E−02 | 1 | 28 |
| WNU80 | 0.835 | 1.94E−02 | 1 | 22 | WNU80 | 0.900 | 5.80E−03 | 1 | 26 |
| WNU80 | 0.803 | 2.96E−02 | 1 | 17 | WNU80 | 0.752 | 5.13E−02 | 1 | 10 |
| WNU80 | 0.784 | 3.71E−02 | 1 | 14 | WNU80 | 0.881 | 8.88E−03 | 1 | 9 |
| WNU80 | 0.800 | 5.60E−02 | 5 | 28 | WNU80 | 0.835 | 9.95E−03 | 2 | 8 |
| WNU80 | 0.717 | 4.51E−02 | 2 | 26 | WNU80 | 0.846 | 8.07E−03 | 2 | 5 |
| WNU80 | 0.755 | 3.05E−02 | 2 | 10 | WNU80 | 0.766 | 2.68E−02 | 2 | 14 |
| WNU80 | 0.778 | 2.31E−02 | 2 | 9 | WNU80 | 0.727 | 4.12E−02 | 2 | 11 |
| WNU80 | 0.894 | 6.56E−03 | 4 | 16 | WNU80 | 0.850 | 1.54E−02 | 4 | 10 |
| WNU80 | 0.861 | 1.27E−02 | 4 | 9 | WNU80 | 0.736 | 3.74E−02 | 3 | 22 |
| WNU80 | 0.790 | 6.15E−02 | 6 | 28 | WNU80 | 0.765 | 4.49E−02 | 6 | 7 |
| WNU80 | 0.702 | 7.89E−02 | 6 | 25 | WNU80 | 0.717 | 7.00E−02 | 6 | 33 |
| WNU80 | 0.867 | 1.16E−02 | 6 | 8 | WNU80 | 0.725 | 6.54E−02 | 6 | 26 |
| WNU80 | 0.733 | 6.08E−02 | 6 | 35 | WNU80 | 0.869 | 1.12E−02 | 6 | 16 |
| WNU80 | 0.713 | 7.22E−02 | 6 | 27 | WNU80 | 0.913 | 4.13E−03 | 6 | 5 |

TABLE 37-continued

Correlation between the expression level of selected genes of some embodiments of the invention in various tissues and the phenotypic performance under normal fertilization conditions across maize accessions

| Gene Name | R | P value | Exp. set | Corr. Set ID | Gene Name | R | P value | Exp. set | Corr. Set ID |
|---|---|---|---|---|---|---|---|---|---|
| WNU80 | 0.705 | 7.67E−02 | 6 | 30 | WNU80 | 0.717 | 7.00E−02 | 6 | 29 |
| WNU80 | 0.970 | 3.02E−04 | 6 | 17 | WNU80 | 0.742 | 5.64E−02 | 6 | 31 |
| WNU80 | 0.739 | 5.78E−02 | 6 | 6 | WNU80 | 0.860 | 1.30E−02 | 6 | 14 |
| WNU80 | 0.717 | 7.00E−02 | 6 | 36 | WNU80 | 0.797 | 3.19E−02 | 6 | 9 |
| WNU80 | 0.775 | 4.06E−02 | 6 | 18 | WNU80 | 0.783 | 3.74E−02 | 6 | 11 |
| WNU80 | 0.791 | 1.94E−02 | 7 | 28 | WNU81 | 0.775 | 4.08E−02 | 1 | 16 |
| WNU81 | 0.734 | 6.04E−02 | 1 | 10 | WNU81 | 0.886 | 7.94E−03 | 1 | 9 |
| WNU81 | 0.787 | 6.29E−02 | 5 | 12 | WNU81 | 0.866 | 5.47E−03 | 2 | 24 |
| WNU81 | 0.829 | 2.11E−02 | 4 | 16 | WNU82 | 0.778 | 3.96E−02 | 1 | 13 |
| WNU82 | 0.906 | 1.29E−02 | 5 | 25 | WNU82 | 0.830 | 4.08E−02 | 5 | 12 |
| WNU82 | 0.732 | 3.90E−02 | 2 | 23 | WNU82 | 0.809 | 1.50E−02 | 2 | 4 |
| WNU82 | 0.889 | 1.77E−02 | 6 | 28 | WNU83 | 0.716 | 1.10E−01 | 5 | 5 |
| WNU83 | 0.729 | 4.03E−02 | 2 | 12 | WNU83 | 0.704 | 5.11E−02 | 2 | 9 |
| WNU83 | 0.710 | 4.87E−02 | 2 | 11 | | | | | |

Table 37. "Corr. ID"— correlation set ID according to the correlated parameters Table above.
"Exp. Set"—Expression set.
"R" = Pearson correlation coefficient;
"P" =p value.

TABLE 38

Correlation between the expression level of WNU selected genes of some embodiments of the invention in various tissues and the phenotypic performance under low nitrogen fertilization conditions across maize accessions

| Gene Name | R | P value | Exp. set | Cor. Set ID | Gene Name | R | P value | Exp. set | Cor. Set ID |
|---|---|---|---|---|---|---|---|---|---|
| LAB290_H0 | 0.831 | 5.55E−03 | 5 | 23 | LAB290_H0 | 0.741 | 9.19E−02 | 6 | 28 |
| LAB290_H0 | 0.745 | 8.94E−02 | 6 | 20 | LAB290_H0 | 0.727 | 1.02E−01 | 6 | 19 |
| LAB290_H0 | 0.702 | 1.20E−01 | 6 | 21 | LAB290_H0 | 0.849 | 3.23E−02 | 6 | 13 |
| LAB290_H0 | 0.728 | 1.01E−01 | 6 | 26 | LAB290_H0 | 0.773 | 4.17E−02 | 7 | 28 |
| LAB290_H0 | 0.784 | 2.13E−02 | 7 | 8 | LAB290_H0 | 0.701 | 5.29E−02 | 7 | 17 |
| LAB290_H0 | 0.816 | 1.34E−02 | 7 | 21 | LAB290_H0 | 0.735 | 3.78E−02 | 2 | 8 |
| LAB290_H0 | 0.889 | 7.43E−03 | 4 | 16 | LAB290_H0 | 0.720 | 6.80E−02 | 4 | 18 |
| LYM213 | 0.758 | 8.05E−02 | 6 | 3 | LYM213 | 0.813 | 4.94E−02 | 6 | 22 |
| LYM213 | 0.887 | 7.81E−03 | 2 | 28 | LYM213 | 0.794 | 3.30E−02 | 4 | 25 |
| LYM213 | 0.805 | 2.88E−02 | 4 | 3 | WNU104 | 0.702 | 1.20E−01 | 1 | 28 |
| WNU104 | 0.931 | 2.31E−03 | 1 | 8 | WNU104 | 0.725 | 6.54E−02 | 1 | 21 |
| WNU104 | 0.733 | 6.08E−02 | 1 | 7 | WNU104 | 0.758 | 4.84E−02 | 1 | 18 |
| WNU104 | 0.958 | 6.89E−04 | 1 | 9 | WNU104 | 0.708 | 7.53E−02 | 1 | 23 |
| WNU104 | 0.876 | 9.64E−03 | 1 | 10 | WNU104 | 0.850 | 7.54E−03 | 5 | 28 |
| WNU104 | 0.736 | 2.37E−02 | 5 | 26 | WNU104 | 0.808 | 5.19E−02 | 6 | 11 |
| WNU104 | 0.703 | 1.19E−01 | 6 | 5 | WNU104 | 0.806 | 5.28E−02 | 6 | 34 |
| WNU104 | 0.702 | 1.20E−01 | 6 | 2 | WNU104 | 0.801 | 5.57E−02 | 6 | 1 |
| WNU104 | 0.857 | 2.91E−02 | 6 | 18 | WNU104 | 0.793 | 5.96E−02 | 6 | 9 |
| WNU104 | 0.854 | 3.03E−02 | 6 | 6 | WNU104 | 0.718 | 1.08E−01 | 6 | 30 |
| WNU104 | 0.704 | 2.31E−02 | 3 | 8 | WNU104 | 0.833 | 2.75E−03 | 3 | 20 |
| WNU104 | 0.785 | 7.18E−03 | 3 | 7 | WNU104 | 0.731 | 1.64E−02 | 3 | 9 |
| WNU104 | 0.765 | 4.52E−02 | 2 | 28 | WNU104 | 0.861 | 6.01E−03 | 2 | 21 |
| WNU104 | 0.706 | 5.03E−02 | 2 | 9 | WNU104 | 0.754 | 5.00E−02 | 4 | 20 |
| WNU104 | 0.722 | 6.71E−02 | 4 | 24 | WNU104 | 0.896 | 6.38E−03 | 4 | 22 |
| WNU104 | 0.889 | 7.42E−03 | 4 | 6 | WNU75 | 0.873 | 2.33E−02 | 1 | 34 |
| WNU75 | 0.913 | 5.93E−04 | 5 | 22 | WNU75 | 0.849 | 3.27E−02 | 6 | 25 |
| WNU75 | 0.764 | 1.02E−02 | 3 | 25 | WNU75 | 0.767 | 2.65E−02 | 8 | 25 |
| WNU75 | 0.794 | 1.86E−02 | 8 | 5 | WNU75 | 0.888 | 3.23E−03 | 8 | 32 |
| WNU75 | 0.708 | 4.92E−02 | 8 | 6 | WNU75 | 0.888 | 3.23E−03 | 8 | 27 |
| WNU75 | 0.758 | 4.84E−02 | 4 | 13 | WNU76 | 0.704 | 7.77E−02 | 1 | 33 |
| WNU76 | 0.704 | 7.77E−02 | 1 | 29 | WNU76 | 0.948 | 1.16E−03 | 1 | 20 |
| WNU76 | 0.821 | 2.36E−02 | 1 | 35 | WNU76 | 0.881 | 8.79E−03 | 1 | 21 |
| WNU76 | 0.905 | 5.11E−03 | 1 | 2 | WNU76 | 0.879 | 9.10E−03 | 1 | 1 |
| WNU76 | 0.704 | 7.77E−02 | 1 | 36 | WNU76 | 0.740 | 5.72E−02 | 1 | 31 |
| WNU76 | 0.883 | 8.35E−03 | 1 | 24 | WNU76 | 0.839 | 1.83E−02 | 1 | 32 |
| WNU76 | 0.726 | 6.45E−02 | 1 | 3 | WNU76 | 0.927 | 2.63E−03 | 1 | 18 |
| WNU76 | 0.736 | 5.95E−02 | 1 | 15 | WNU76 | 0.731 | 6.21E−02 | 1 | 12 |
| WNU76 | 0.858 | 1.34E−02 | 1 | 23 | WNU76 | 0.839 | 1.83E−02 | 1 | 27 |
| WNU76 | 0.744 | 2.17E−02 | 5 | 25 | WNU76 | 0.815 | 7.50E−03 | 5 | 22 |
| WNU76 | 0.733 | 9.71E−02 | 6 | 33 | WNU76 | 0.884 | 1.95E−02 | 6 | 25 |
| WNU76 | 0.733 | 9.71E−02 | 6 | 29 | WNU76 | 0.843 | 3.49E−02 | 6 | 34 |
| WNU76 | 0.777 | 6.89E−02 | 6 | 2 | WNU76 | 0.733 | 9.71E−02 | 6 | 36 |

TABLE 38-continued

Correlation between the expression level of WNU selected genes of some embodiments of the invention in various tissues and the phenotypic performance under low nitrogen fertilization conditions across maize accessions

| Gene Name | R | P value | Exp. set | Cor. Set ID | Gene Name | R | P value | Exp. set | Cor. Set ID |
|---|---|---|---|---|---|---|---|---|---|
| WNU76 | 0.806 | 5.26E−02 | 6 | 4 | WNU76 | 0.776 | 6.96E−02 | 6 | 3 |
| WNU76 | 0.716 | 1.98E−02 | 3 | 25 | WNU76 | 0.872 | 4.76E−03 | 8 | 25 |
| WNU76 | 0.776 | 2.36E−02 | 8 | 4 | WNU76 | 0.817 | 1.33E−02 | 8 | 22 |
| WNU76 | 0.770 | 2.53E−02 | 2 | 25 | WNU76 | 0.811 | 1.46E−02 | 2 | 5 |
| WNU76 | 0.704 | 5.15E−02 | 2 | 13 | WNU76 | 0.716 | 4.56E−02 | 2 | 24 |
| WNU76 | 0.726 | 4.14E−02 | 2 | 32 | WNU76 | 0.859 | 6.33E−03 | 2 | 4 |
| WNU76 | 0.740 | 3.59E−02 | 2 | 18 | WNU76 | 0.773 | 2.45E−02 | 2 | 6 |
| WNU76 | 0.833 | 1.02E−02 | 2 | 23 | WNU76 | 0.726 | 4.14E−02 | 2 | 27 |
| WNU76 | 0.701 | 7.91E−02 | 4 | 33 | WNU76 | 0.701 | 7.91E−02 | 4 | 29 |
| WNU76 | 0.878 | 9.34E−03 | 4 | 35 | WNU76 | 0.814 | 2.60E−02 | 4 | 16 |
| WNU76 | 0.773 | 4.17E−02 | 4 | 2 | WNU76 | 0.701 | 7.91E−02 | 4 | 36 |
| WNU76 | 0.777 | 4.00E−02 | 4 | 31 | WNU77 | 0.808 | 2.80E−02 | 1 | 5 |
| WNU77 | 0.852 | 1.49E−02 | 1 | 1 | WNU77 | 0.839 | 1.82E−02 | 1 | 7 |
| WNU77 | 0.825 | 2.23E−02 | 1 | 6 | WNU77 | 0.782 | 1.27E−02 | 5 | 22 |
| WNU77 | 0.818 | 4.66E−02 | 6 | 13 | WNU77 | 0.810 | 4.46E−03 | 3 | 25 |
| WNU77 | 0.763 | 4.59E−02 | 7 | 28 | WNU77 | 0.810 | 1.49E−02 | 2 | 25 |
| WNU77 | 0.729 | 4.01E−02 | 2 | 20 | WNU77 | 0.867 | 5.28E−03 | 2 | 21 |
| WNU77 | 0.891 | 2.99E−03 | 2 | 24 | WNU77 | 0.719 | 4.42E−02 | 2 | 3 |
| WNU77 | 0.714 | 4.65E−02 | 2 | 18 | WNU77 | 0.753 | 5.08E−02 | 4 | 16 |
| WNU78 | 0.874 | 2.07E−03 | 5 | 25 | WNU78 | 0.827 | 4.21E−02 | 6 | 25 |
| WNU78 | 0.794 | 5.93E−02 | 6 | 3 | WNU78 | 0.769 | 2.57E−02 | 8 | 25 |
| WNU78 | 0.714 | 4.68E−02 | 7 | 25 | WNU80 | 0.869 | 2.46E−02 | 1 | 28 |
| WNU80 | 0.719 | 6.85E−02 | 1 | 33 | WNU80 | 0.837 | 1.88E−02 | 1 | 11 |
| WNU80 | 0.749 | 5.25E−02 | 1 | 5 | WNU80 | 0.719 | 6.85E−02 | 1 | 29 |
| WNU80 | 0.831 | 2.06E−02 | 1 | 14 | WNU80 | 0.896 | 6.27E−03 | 1 | 20 |
| WNU80 | 0.776 | 4.01E−02 | 1 | 35 | WNU80 | 0.826 | 2.21E−02 | 1 | 21 |
| WNU80 | 0.719 | 6.85E−02 | 1 | 36 | WNU80 | 0.885 | 8.17E−03 | 1 | 24 |
| WNU80 | 0.903 | 5.41E−03 | 1 | 4 | WNU80 | 0.755 | 4.96E−02 | 1 | 3 |
| WNU80 | 0.894 | 6.70E−03 | 1 | 7 | WNU80 | 0.853 | 1.48E−02 | 1 | 18 |
| WNU80 | 0.783 | 3.75E−02 | 1 | 26 | WNU80 | 0.869 | 1.12E−02 | 1 | 6 |
| WNU80 | 0.728 | 6.39E−02 | 1 | 30 | WNU80 | 0.721 | 2.83E−02 | 5 | 33 |
| WNU80 | 0.931 | 2.64E−04 | 5 | 11 | WNU80 | 0.721 | 2.83E−02 | 5 | 29 |
| WNU80 | 0.712 | 3.15E−02 | 5 | 20 | WNU80 | 0.759 | 1.77E−02 | 5 | 35 |
| WNU80 | 0.759 | 1.77E−02 | 5 | 19 | WNU80 | 0.721 | 2.83E−02 | 5 | 36 |
| WNU80 | 0.726 | 2.68E−02 | 5 | 31 | WNU80 | 0.806 | 8.74E−03 | 5 | 7 |
| WNU80 | 0.710 | 3.21E−02 | 5 | 9 | WNU80 | 0.807 | 8.58E−03 | 5 | 26 |
| WNU80 | 0.703 | 3.46E−02 | 5 | 30 | WNU80 | 0.719 | 2.91E−02 | 5 | 10 |
| WNU80 | 0.938 | 5.64E−03 | 6 | 28 | WNU80 | 0.934 | 6.37E−03 | 6 | 8 |
| WNU80 | 0.741 | 9.22E−02 | 6 | 21 | WNU80 | 0.734 | 9.64E−02 | 6 | 9 |
| WNU80 | 0.723 | 1.04E−01 | 6 | 26 | WNU80 | 0.730 | 9.93E−02 | 6 | 10 |
| WNU80 | 0.725 | 1.76E−02 | 3 | 26 | WNU80 | 0.857 | 1.37E−02 | 8 | 28 |
| WNU80 | 0.884 | 3.61E−03 | 8 | 8 | WNU80 | 0.728 | 4.07E−02 | 8 | 17 |
| WNU80 | 0.775 | 2.38E−02 | 8 | 21 | WNU80 | 0.790 | 1.98E−02 | 8 | 18 |
| WNU80 | 0.944 | 4.18E−04 | 8 | 9 | WNU80 | 0.724 | 4.22E−02 | 8 | 26 |
| WNU80 | 0.783 | 2.16E−02 | 8 | 10 | WNU80 | 0.924 | 2.90E−03 | 7 | 28 |
| WNU80 | 0.874 | 4.53E−03 | 7 | 8 | WNU80 | 0.711 | 4.80E−02 | 7 | 17 |
| WNU80 | 0.722 | 4.30E−02 | 7 | 9 | WNU80 | 0.862 | 1.14E−02 | 7 | 26 |
| WNU80 | 0.876 | 4.33E−03 | 7 | 10 | WNU80 | 0.721 | 4.36E−02 | 2 | 24 |
| WNU80 | 0.800 | 1.71E−02 | 2 | 32 | WNU80 | 0.800 | 1.71E−02 | 2 | 27 |
| WNU80 | 0.891 | 7.02E−03 | 4 | 28 | WNU80 | 0.779 | 3.88E−02 | 4 | 8 |
| WNU80 | 0.791 | 3.43E−02 | 4 | 21 | WNU80 | 0.796 | 3.21E−02 | 4 | 26 |
| WNU80 | 0.915 | 3.89E−03 | 4 | 10 | WNU81 | 0.746 | 5.41E−02 | 1 | 11 |
| WNU81 | 0.886 | 7.99E−03 | 1 | 17 | WNU81 | 0.712 | 7.25E−02 | 1 | 1 |
| WNU81 | 0.765 | 4.51E−02 | 1 | 10 | WNU81 | 0.953 | 3.26E−03 | 6 | 33 |
| WNU81 | 0.740 | 9.24E−02 | 6 | 5 | WNU81 | 0.953 | 3.26E−03 | 6 | 29 |
| WNU81 | 0.837 | 3.75E−02 | 6 | 35 | WNU81 | 0.915 | 1.06E−02 | 6 | 34 |
| WNU81 | 0.858 | 2.87E−02 | 6 | 2 | WNU81 | 0.819 | 4.60E−02 | 6 | 1 |
| WNU81 | 0.953 | 3.26E−03 | 6 | 36 | WNU81 | 0.960 | 2.42E−03 | 6 | 31 |
| WNU81 | 0.745 | 8.91E−02 | 6 | 4 | WNU81 | 0.770 | 7.30E−02 | 6 | 6 |
| WNU81 | 0.968 | 1.53E−03 | 6 | 30 | WNU81 | 0.823 | 3.44E−03 | 3 | 3 |
| WNU81 | 0.750 | 3.20E−02 | 7 | 1 | WNU81 | 0.708 | 7.53E−02 | 4 | 21 |
| WNU81 | 0.825 | 2.25E−02 | 4 | 24 | WNU81 | 0.723 | 6.62E−02 | 4 | 9 |
| WNU82 | 0.792 | 3.38E−02 | 1 | 19 | WNU82 | 0.707 | 7.59E−02 | 1 | 13 |
| WNU82 | 0.767 | 4.42E−02 | 1 | 26 | WNU82 | 0.840 | 4.64E−03 | 5 | 22 |
| WNU82 | 0.719 | 1.07E−01 | 6 | 5 | WNU82 | 0.849 | 1.89E−03 | 3 | 25 |
| WNU82 | 0.771 | 4.54E−02 | 8 | 5 | WNU82 | 0.757 | 2.98E−02 | 2 | 25 |
| WNU82 | 0.803 | 1.63E−02 | 2 | 3 | WNU82 | 0.709 | 4.89E−02 | 2 | 12 |
| WNU83 | 0.928 | 7.54E−03 | 6 | 5 | WNU83 | 0.854 | 3.04E−02 | 6 | 6 |
| WNU83 | 0.818 | 2.44E−02 | 4 | 28 | WNU83 | 0.812 | 2.66E−02 | 4 | 5 |

TABLE 38-continued

Correlation between the expression level of WNU selected genes of some embodiments of the invention in various tissues and the phenotypic performance under low nitrogen fertilization conditions across maize accessions

| Gene Name | R | P value | Exp. set | Cor. Set ID | Gene Name | R | P value | Exp. set | Cor. Set ID |
|---|---|---|---|---|---|---|---|---|---|
| WNU83 | 0.708 | 7.51E−02 | 4 | 20 | WNU83 | 0.700 | 7.98E−02 | 4 | 21 |
| WNU83 | 0.812 | 2.64E−02 | 4 | 26 | WNU83 | 0.704 | 7.74E−02 | 4 | 6 |
| WNU83 | 0.863 | 1.24E−02 | 4 | 10 | | | | | |

Table 38. "Corr. ID"— correlation set ID according to the correlated parameters Table above.
"Exp. Set"—Expression set.
"R" = Pearson correlation coefficient;
"P" = p value.

Example 10

Production of Maize 60K Transcriptome Oligonucleotide Micro-Arrays

Genes Under Differential Display Associating with Agronomical Nitrogen Use Efficiency Two maize commercial hybrids and 2 maize inbred lines were grown in 5 repetitive plots in the field under six different N fertilization regimes. Maize seeds were planted and plants were grown in the field using commercial fertilization and irrigation protocols (485 cubic meters of irrigation per dunam, 30 units of 21% uran (N fertilization) per entire growth period-Normal conditions 100% Nitrogen). In addition, the rest of 5 Nitrogen treatments included: 140% of Normal, 50%, 30%, 10% and 0%. In order to define association between the levels of RNA expression with yield components, biomass related parameters and NUE various indices including Agronomical NUE, two maize hybrids and one maize inbred line were selected for RNA expression analysis. The genes up-regulated under certain N fertilization with highest Agronomical NUE or yield or biomass parameters were considered as associated with Agronomical NUE, NUE and yield.

Analyzed Maize tissues—At total 3 maize lines were sampled at V12 developmental stage (tasseling) and R3 (milky) developmental stage. Plant tissues [leaves, lower and upper internodes, flower] were sampled and RNA was extracted as described above. Each micro-array expression information tissue type has received a Set ID as summarized in Table 39 below.

TABLE 39

Maize transcriptome expression sets

| Expression Set | Set ID |
|---|---|
| flower: V12: | 1 |
| leaf: R3: | 2 |

TABLE 39-continued

Maize transcriptome expression sets

| Expression Set | Set ID |
|---|---|
| leaf: V12: | 3 |
| lower internode: R3: | 4 |
| lower internode: V12: | 5 |
| upper internode: R3: | 6 |
| upper internode: V12: | 7 |

Table 39: Provided are the maize transcriptome expression sets

The following parameters were collected either by sampling 6 plants per plot or by measuring the parameter across all the plants within the plot.

Grain weight (yield) per plant (kg.)—At the end of the experiment all ears from plots were collected. All ears from the plot were separately threshed and grains were weighted, all additional ears were threshed together and weighted as well. The average grain weight per ear was calculated by dividing the total grain weight by number of total ears per plot (based on plot).

Agronomical NUE (Agronomical Nitrogen Use Efficiency)—Agronomical NUE coefficient measures the ability of plant to efficiently use the each additional unit of Nitrogen added as fertilizer and was calculated using Formula XXXVI (Agronomical NUE, described above).

TABLE 40

Correlated parameters in Maize accessions throughout all N levels (e.g., 140%, 100%, 50%, 30%, 10% and 0%)

| Correlated parameter with | Correlation ID |
|---|---|
| N harvest index calculated | 1 |

Table 40. "NHI (N harvest index)" = the ratio between total grain N and total plant N (=total shoot N + total grain N).

TABLE 41

Measured parameters in Maize accessions

| Corr. ID Line | L-1 | L-2 | L-3 | L-4 | L-5 | L-6 | L-7 | L-8 | L-9 | L-10 | L-11 | L-12 |
|---|---|---|---|---|---|---|---|---|---|---|---|---|
| 1 | 38.0 | 37.1 | 36.2 | 31.5 | 33.7 | 35.0 | 34.8 | 42.8 | 36.2 | 44.2 | 29.1 | 37.6 |

TABLE 42

Correlation between the expression level of selected genes of some embodiments of the invention in various tissues and the phenotypic performance under normal or low nitrogen fertilization conditions across *Arabidopsis* accessions

| Gene Name | R | P value | Exp. set | Corr. ID |
|---|---|---|---|---|
| WNU83 | 0.702 | 1.09E–02 | 2 | 1 |

Table 42. "Con. ID" correlation set ID according to the correlated parameters Table above. "Exp. Set"—Expression set. "R" = Pearson correlation coefficient; "P" = p value.

Example 11

Production of *Brachypodium* Transcriptome and High Throughput Correlation Analysis Using 60K *Brachypodium* Oligonucleotide Micro-Array In order to produce a high throughput correlation analysis comparing between plant phenotype and gene expression level, the present inventors utilized a *brachypodium* oligonucleotide micro-array, produced by Agilent Technologies [chem. (dot) agilent (dot) com/Scripts/PDS (dot) asp?1Page=50879]. The array oligonucleotide represents about 60K *brachypodium* genes and transcripts. In order to define correlations between the levels of RNA expression and yield or vigor related parameters, various plant characteristics of 24 different *brachypodium* accessions were analyzed. Among them, 22 accessions encompassing the observed variance were selected for RNA expression analysis and comparative genomic hybridization (CGH) analysis.

The correlation between the RNA levels and the characterized parameters was analyzed using Pearson correlation test [davidmlane (dot) com/hyperstat/A34739 (dot) html].

Additional correlation analysis was done by comparing plant phenotype and gene copy number. The correlation between the normalized copy number hybridization signal and the characterized parameters was analyzed using Pearson correlation test [davidmlane (dot) com/hyperstat/A34739 (dot) html].

Experimental Procedures

Twenty four *brachypodium* accessions were grown in 4-6 repetitive plots (8 plant per plot) in a green house. The growing protocol was as follows: *brachypodium* seeds were sown in plots and grown under normal condition (6 mM of Nitrogen as ammonium nitrate) or reduced N level (low N, 35% of normal nitrogen fertilization).

Analyzed *Brachypodium* tissues—two tissues [leaf and spike] were sampled and RNA was extracted as described above. Each micro-array expression information tissue type has received a Set ID as summarized in Tables 43-44 below.

TABLE 43

*Brachypodium* transcriptome expression sets under low N conditions

| Expression Set | Set ID |
|---|---|
| flower: low N: flowering: | 1 |
| leaf: low N: flowering: | 2 |

Table 43. Provided are the *brachypodium* transcriptome expression sets under low N conditions.

TABLE 44

*Brachypodium* transcriptome expression sets under Normal conditions

| Expression Set | Set ID |
|---|---|
| leaf: flowering: normal: | 1 |
| spike: flowering: normal: | 2 |

Table 44. Provided are the *brachypodium* transcriptome expression sets under normal conditions

*Brachypodium* yield components and vigor related parameters assessment—Plants were continuously phenotyped during the growth period and at harvest (Table 45-46, below). The image analysis system included a personal desktop computer (Intel P4 3.0 GHz processor) and a public domain program—ImageJ 1.37 [Java based image processing program, which was developed at the U.S. National Institutes of Health and freely available on the internet rsbweb (dot) nih (dot) gov/]. Next, analyzed data was saved to text files and processed using the JMP statistical analysis software (SAS institute).

At the end of the growing period the grains were separated from the spikes and the following parameters were measured using digital imaging system and collected:

No. of tillering—all tillers were counted per plant at harvest (mean per plot).

Head number—At the end of the experiment, heads were harvested from each plot and were counted.

Total Grains weight per plot (gr.)—At the end of the experiment (plant 'Heads') heads from plots were collected, the heads were threshed and grains were weighted. In addition, the average grain weight per head was calculated by dividing the total grain weight by number of total heads per plot (based on plot).

Highest number of spikelets—The highest spikelet number per head was calculated per plant (mean per plot).

Mean number of spikelets—The mean spikelet number per head was calculated per plot.

Plant height—Each of the plants was measured for its height using measuring tape. Height was measured from ground level to spike base of the longest spike at harvest.

Spikelets weight (gr.)—The biomass and spikes weight of each plot was separated, measured per plot.

Average head weight—calculated by dividing spikelets weight with head number (gr.).

Harvest Index—The harvest index was calculated using Formula XXXVII (Harvest Index for *brachypodium*, described above).

Spikelets Index—The Spikelets index was calculated using Formula XXXI (above).

Percent number of heads with spikelets—The number of heads with more than one spikelet per plant were counted and the percent from all heads per plant was calculated.

Total dry mater per plot—Calculated as Vegetative portion above ground plus all the spikelet dry weight per plot.

1000 grain weight—At the end of the experiment all grains from all plots were collected and weighted and the weight of 1000 were calculated.

The following parameters were collected using digital imaging system:

At the end of the growing period the grains were separated from the spikes and the following parameters were measured and collected:

(i) Average Grain Area ($cm^2$)—A sample of ~200 grains was weighted, photographed and images were processed using the below described image processing system. The grain area was measured from those images and was divided by the number of grains.

(ii) Average Grain Length, perimeter and width (cm)—A sample of ~200 grains was weighted, photographed and images were processed using the below described image processing system. The sum of grain lengths and width (longest axis) was measured from those images and was divided by the number of grains.

The image processing system used consisted of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Maintenance of performance under low N conditions: Expressed as ratio of the specific parameter under low N condition divided by Normal conditions results (maintenance of phenotype under low N in comparison to normal conditions).

TABLE 45

Brachypodium correlated parameters under low N conditions (vectors)

| Correlation set | Correlation ID |
|---|---|
| % Number of heads with spikelets | 1 |
| 1000 grain weight [gr] | 2 |
| Avr head weight [gr] | 3 |
| Grain Perimeter [mm] | 4 |
| Grain area [mm$^2$] | 5 |
| Grains weight per plant [gr] | 6 |
| Grains weight per plot [gr] | 7 |
| Harvest index | 8 |
| Heads per plant | 9 |
| Heads per plot | 10 |
| Mean number of spikelets per plot | 11 |
| Number of heads with spikelets per plant | 12 |
| Plant Vegetative DW [gr] | 13 |
| Plant height [cm] | 14 |
| Spikelets DW per plant [gr] | 15 |
| Spikelets weight[gr] | 16 |
| Tillering | 17 |
| Total dry mater per plant [gr] | 18 |

TABLE 45-continued

Brachypodium correlated parameters under low N conditions (vectors)

| Correlation set | Correlation ID |
|---|---|
| Total dry mater per plot[gr] | 19 |
| Vegetative DW [gr] | 20 |

Table 45. Provided are the brachypodium correlated parameters. "Avr" = average; "gr" = grams; "cm" = centimeter; "mm" = millimeter.

TABLE 46

Brachypodium correlated parameters under normal conditions (vectors)

| Correlated parameter with | Correlation ID |
|---|---|
| 1000 grain weight [gr] | 1 |
| Avr head weight [gr] | 2 |
| Grain Perimeter [mm] | 3 |
| Grain area [mm$^2$] | 4 |
| Grain length [mm] | 5 |
| Grain width [mm] | 6 |
| Grains weight per plant [gr] | 7 |
| Grains weight per plot [gr] | 8 |
| Harvest index | 9 |
| Heads per plant | 10 |
| Heads per plot | 11 |
| Highest num of spikelets per plot | 12 |
| Mean num of spikelets per plot | 13 |
| Num of heads with spikelets per plant | 14 |
| Percent Num of heads with spikelets [%] | 15 |
| Plant Vegetative DW [gr] | 16 |
| Plant height [cm] | 17 |
| Plants num | 18 |
| Spikelets DW per plant [gr] | 19 |
| Spikelets weight [gr] | 20 |
| Spikes index | 21 |
| Tillering | 22 |
| Total dry mater per plant [gr] | 23 |
| Total dry mater per plot [gr] | 24 |
| Vegetative DW [gr] | 25 |

Table 46. Provided are the brachypodium correlated parameters. "Avr" = average; "gr" = grams; "cm" = centimeter; "mm" = millimeter.

Experimental Results

Twenty five different Brachypodium accessions were grown and characterized for different parameters as described above. The average for each of the measured parameter was calculated using the JMP software and values are summarized in Tables 47-48 below. Subsequent correlation analysis between the various transcriptome sets and the average parameters was conducted (Tables 53-55). Follow, results were integrated to the database.

TABLE 47

Measured parameters of correlation IDs in Brachypodium accessions under low N conditions

| Cor. ID Line | L-1 | L-2 | L-3 | L-4 | L-5 | L-6 | L-7 | L-8 | L-9 | L-10 | L-11 | L-12 |
|---|---|---|---|---|---|---|---|---|---|---|---|---|
| 1 | 15.93 | 32.43 | 31.49 | 13.33 | 12.76 | 6.48 | 7.38 | 5.39 | 7.04 | 48.22 | 4.74 | 8.55 |
| 2 | 4.00 | 3.88 | 4.31 | 3.23 | 4.70 | 5.98 | 5.12 | 4.33 | 5.67 | 4.08 | 4.95 | 4.66 |
| 3 | 0.04 | 0.06 | 0.04 | 0.05 | 0.05 | 0.04 | 0.04 | 0.03 | 0.04 | 0.05 | 0.05 | 0.03 |
| 4 | 1.73 | 1.57 | 1.62 | 1.68 | 1.71 | 1.86 | 1.91 | 1.79 | 1.86 | 1.70 | 1.83 | 1.66 |
| 5 | 0.11 | 0.09 | 0.09 | 0.09 | 0.09 | 0.11 | 0.12 | 0.10 | 0.10 | 0.10 | 0.11 | 0.09 |
| 6 | 0.08 | 0.15 | 0.05 | 0.09 | 0.17 | 0.16 | 0.05 | 0.06 | 0.14 | 0.06 | 0.07 | 0.05 |
| 7 | 0.64 | 0.51 | 0.39 | 0.37 | 1.39 | 1.27 | 0.38 | 0.47 | 1.02 | 0.47 | 0.54 | 0.41 |
| 8 | 0.15 | 0.27 | 0.15 | 0.31 | 0.20 | 0.28 | 0.12 | 0.14 | 0.39 | 0.10 | 0.17 | 0.09 |
| 9 | 10.48 | 7.17 | 6.03 | 4.75 | 11.28 | 8.45 | 7.04 | 10.93 | 5.80 | 8.09 | 6.56 | 13.00 |
| 10 | 81.80 | 26.00 | 48.25 | 19.00 | 90.25 | 67.60 | 53.50 | 85.83 | 41.67 | 60.25 | 50.00 | 104.00 |
| 11 | 1.66 | 2.08 | 1.91 | 1.50 | 1.66 | 1.45 | 1.44 | 1.49 | 1.37 | 2.55 | 1.18 | 1.58 |
| 12 | 1.89 | 2.83 | 1.84 | 0.75 | 1.63 | 0.63 | 0.63 | 0.66 | 0.39 | 3.80 | 0.37 | 1.18 |
| 13 | 0.19 | 0.15 | 0.10 | 0.07 | 0.28 | 0.21 | 0.14 | 0.18 | 0.12 | 0.25 | 0.15 | 0.23 |
| 14 | 24.70 | 23.58 | 22.53 | 16.88 | 27.13 | 30.14 | 22.66 | 22.27 | 23.92 | 27.97 | 22.99 | 25.64 |

TABLE 47-continued

Measured parameters of correlation IDs in *Brachypodium* accessions under low N conditions

| Cor. ID Line | L-1 | L-2 | L-3 | L-4 | L-5 | L-6 | L-7 | L-8 | L-9 | L-10 | L-11 | L-12 |
|---|---|---|---|---|---|---|---|---|---|---|---|---|
| 15 | 0.37 | 0.45 | 0.25 | 0.23 | 0.57 | 0.34 | 0.26 | 0.29 | 0.25 | 0.41 | 0.30 | 0.42 |
| 16 | 2.90 | 1.39 | 2.04 | 0.91 | 4.59 | 2.70 | 2.02 | 2.31 | 1.83 | 3.07 | 2.29 | 3.34 |
| 17 | 10.97 | 6.92 | 6.72 | 5.50 | 11.31 | 9.03 | 7.54 | 11.06 | 6.24 | 8.32 | 6.89 | 13.08 |
| 18 | 0.57 | 0.59 | 0.35 | 0.30 | 0.85 | 0.55 | 0.40 | 0.47 | 0.37 | 0.66 | 0.45 | 0.65 |
| 19 | 4.42 | 1.86 | 2.81 | 1.18 | 6.84 | 4.39 | 3.09 | 3.75 | 2.67 | 4.99 | 3.41 | 5.21 |
| 20 | 1.52 | 0.47 | 0.78 | 0.27 | 2.24 | 1.69 | 1.07 | 1.44 | 0.84 | 1.92 | 1.13 | 1.87 |

Correlation (Cor.) IDs: 1, 2, 3, 4, 5, . . . etc. refer to those described in Table 45 above [*Brachypodium* correlated parameters (vectors)]. The *Brachypodium* accession numbers are Line 12, Line 13, Line 13, etc.

TABLE 48

Measured parameters of correlation IDs in additional *brachypodium* accessions under low N conditions

| Cor. ID Line | L-13 | L-14 | L-15 | L-16 | L-17 | L-18 | L-19 | L-20 | L-21 | L-22 | L-23 | L-24 |
|---|---|---|---|---|---|---|---|---|---|---|---|---|
| 1 | 10.09 | 10.82 | 39.53 | 37.28 | 37.56 | 21.19 | 48.70 | 15.07 | 11.01 | 40.29 | 34.70 | 10.09 |
| 2 | 5.24 | 4.94 | 4.38 | 4.09 | 5.93 | 4.63 | 3.53 | 3.92 | 4.73 | 6.24 | 5.29 | 5.24 |
| 3 | 0.04 | 0.05 | 0.08 | 0.07 | 0.07 | 0.05 | 0.05 | 0.04 | 0.06 | 0.08 | 0.09 | 0.04 |
| 4 | 1.79 | 1.74 | 1.84 | 1.70 | 1.84 | 1.71 | 1.68 | 1.65 | 1.85 | 1.88 | 1.88 | 1.79 |
| 5 | 0.12 | 0.10 | 0.10 | 0.08 | 0.12 | 0.09 | 0.09 | 0.09 | 0.11 | 0.12 | 0.11 | 0.12 |
| 6 | 0.14 | 0.09 | 0.17 | 0.35 | 0.13 | 0.18 | 0.20 | 0.20 | 0.27 | 0.06 | 0.48 | 0.14 |
| 7 | 1.07 | 0.71 | 1.34 | 2.49 | 0.91 | 1.33 | 1.58 | 1.55 | 2.16 | 0.45 | 3.65 | 1.07 |
| 8 | 0.15 | 0.13 | 0.10 | 0.23 | 0.17 | 0.18 | 0.18 | 0.25 | 0.20 | 0.05 | 0.28 | 0.15 |
| 9 | 12.11 | 9.03 | 12.23 | 12.80 | 7.95 | 12.20 | 10.73 | 15.81 | 13.22 | 2.38 | 12.16 | 12.11 |
| 10 | 93.25 | 69.75 | 97.83 | 91.00 | 57.83 | 92.33 | 85.80 | 125.00 | 105.75 | 19.00 | 91.88 | 93.25 |
| 11 | 1.64 | 1.52 | 2.17 | 2.04 | 1.93 | 1.89 | 2.10 | 1.87 | 1.72 | 0.81 | 2.35 | 1.64 |
| 12 | 1.37 | 1.11 | 5.04 | 4.99 | 3.04 | 2.64 | 5.38 | 2.18 | 1.66 | 0.94 | 3.89 | 1.37 |
| 13 | 0.39 | 0.22 | 0.58 | 0.50 | 0.27 | 0.37 | 0.33 | 0.30 | 0.33 | 1.03 | 0.73 | 0.39 |
| 14 | 34.98 | 21.27 | 38.35 | 36.24 | 30.23 | 28.96 | 34.70 | 21.94 | 29.59 | 21.63 | 41.92 | 34.98 |
| 15 | 0.53 | 0.47 | 0.98 | 0.92 | 0.54 | 0.59 | 0.58 | 0.61 | 0.76 | 0.18 | 1.01 | 0.53 |
| 16 | 4.10 | 3.56 | 7.87 | 6.56 | 3.92 | 4.41 | 4.67 | 4.83 | 6.07 | 1.43 | 7.51 | 4.10 |
| 17 | 12.21 | 9.42 | 12.48 | 13.74 | 7.99 | 12.74 | 10.80 | 16.72 | 13.19 | 14.67 | 12.98 | 12.21 |
| 18 | 0.92 | 0.68 | 1.57 | 1.42 | 0.82 | 0.95 | 0.91 | 0.91 | 1.09 | 1.21 | 1.74 | 0.92 |
| 19 | 7.10 | 5.23 | 12.54 | 10.08 | 5.86 | 7.07 | 7.31 | 7.20 | 8.71 | 9.67 | 12 89 | 7.10 |
| 20 | 3.00 | 1.67 | 4.67 | 3.53 | 1.94 | 2.66 | 2.64 | 2.37 | 2.64 | 8.24 | 5.38 | 3.00 |

Correlation (Cor.) IDs: 1, 2, 3, 4, 5, . . . etc. refer to those described in Table 45 above [*Brachypodium* correlated parameters (vectors)]. The *Brachypodium* accession numbers are Line 13, Line 14, etc.

TABLE 49

Measured parameters of correlation IDs in *Brachypodium* accessions under normal conditions

| Cor. ID Line | L-1 | L-2 | L-3 | L-4 | L-5 | L-6 | L-7 | L-8 | L-9 | L-10 | L-11 | L-12 |
|---|---|---|---|---|---|---|---|---|---|---|---|---|
| 1 | 3.75 | 3.78 | 3.35 | 4.89 | 5.54 | 4.98 | 4.83 | 5.54 | 3.84 | 4.76 | 4.73 | 5.24 |
| 2 | 0.06 | 0.04 | 0.05 | 0.08 | 0.04 | 0.06 | 0.05 | 0.04 | 0.08 | 0.06 | 0.05 | 0.05 |
| 3 | 1.67 | 1.62 | 1.62 | 1.69 | 1.82 | 1.83 | 1.75 | 1.93 | 1.68 | 1.82 | 1.69 | 1.91 |
| 4 | 0.10 | 0.10 | 0.09 | 0.09 | 0.11 | 0.11 | 0.10 | 0.11 | 0.10 | 0.11 | 0.10 | 0.12 |
| 5 | 0.73 | 0.72 | 0.72 | 0.74 | 0.83 | 0.82 | 0.78 | 0.90 | 0.75 | 0.79 | 0.75 | 0.86 |
| 6 | 0.18 | 0.17 | 0.17 | 0.16 | 0.16 | 0.17 | 0.17 | 0.16 | 0.17 | 0.18 | 0.17 | 0.19 |
| 7 | 0.14 | 0.06 | 0.08 | 0.26 | 0.14 | 0.14 | 0.14 | 0.11 | 0.08 | 0.07 | 0.39 | 0.14 |
| 8 | 1.05 | 0.44 | 0.61 | 1.96 | 1.11 | 1.07 | 1.09 | 0.84 | 0.50 | 0.39 | 3.07 | 1.09 |
| 9 | 0.13 | 0.14 | 0.15 | 0.21 | 0.20 | 0.16 | 0.14 | 0.26 | 0.07 | 0.11 | 0.22 | 0.09 |
| 10 | 16.30 | 7.08 | 6.59 | 11.63 | 10.48 | 9.09 | 14.13 | 5.88 | 11.89 | 8.02 | 23.75 | 16.06 |
| 11 | 121.75 | 56.60 | 52.75 | 83.40 | 82.40 | 70.13 | 110.33 | 47.00 | 81.50 | 48.60 | 185.50 | 125.00 |
| 12 | 3.00 | 2.60 | 3.00 | 2.20 | 2.00 | 2.25 | 1.83 | 2.00 | 3.50 | 2.00 | 2.50 | 2.40 |
| 13 | 2.10 | 2.10 | 1.72 | 1.69 | 1.38 | 1.65 | 1.43 | 1.25 | 2.41 | 1.56 | 1.76 | 1.83 |
| 14 | 5.27 | 2.50 | 2.06 | 2.08 | 0.71 | 1.94 | 1.08 | 0.35 | 7.59 | 1.87 | 4.98 | 3.70 |
| 15 | 27.62 | 35.33 | 21.67 | 14.00 | 5.42 | 15.42 | 6.40 | 4.51 | 55.41 | 16.51 | 15.52 | 20.34 |
| 16 | 0.42 | 0.12 | 0.13 | 0.38 | 0.32 | 0.32 | 0.39 | 0.13 | 0.44 | 0.31 | 0.87 | 0.69 |
| 17 | 31.65 | 23.44 | 22.75 | 31.95 | 34.36 | 28.65 | 28.88 | 24.74 | 31.40 | 29.15 | 37.30 | 45.09 |
| 18 | 7.50 | 8.00 | 8.00 | 7.20 | 7.80 | 7.75 | 7.83 | 8.00 | 6.50 | 6.40 | 7.75 | 8.00 |
| 19 | 0.96 | 0.31 | 0.33 | 0.88 | 0.44 | 0.56 | 0.67 | 0.26 | 0.92 | 0.45 | 1.14 | 0.83 |
| 20 | 7.18 | 2.50 | 2.68 | 6.42 | 3.45 | 4.29 | 5.29 | 2.04 | 6.25 | 2.66 | 8.89 | 6.65 |

TABLE 49-continued

Measured parameters of correlation IDs in *Brachypodium* accessions under normal conditions

| Cor. ID Line | L-1 | L-2 | L-3 | L-4 | L-5 | L-6 | L-7 | L-8 | L-9 | L-10 | L-11 | L-12 |
|---|---|---|---|---|---|---|---|---|---|---|---|---|
| 21 | 0.71 | 0.72 | 0.73 | 0.71 | 0.58 | 0.66 | 0.64 | 0.66 | 0.69 | 0.61 | 0.59 | 0.54 |
| 22 | 16.84 | 7.20 | 7.00 | 11.97 | 10.67 | 9.38 | 14.58 | 6.35 | 12.38 | 8.61 | 25.50 | 16.56 |
| 23 | 1.38 | 0.43 | 0.47 | 1.25 | 0.76 | 0.88 | 1.06 | 0.38 | 1.36 | 0.76 | 2.01 | 1.53 |
| 24 | 10.26 | 3.45 | 3.74 | 9.12 | 6.00 | 6.78 | 8.34 | 3.04 | 9.21 | 4.47 | 15.79 | 12.20 |
| 25 | 3.08 | 0.95 | 1.06 | 2.69 | 2.55 | 2.48 | 3.05 | 1.00 | 2.96 | 1.81 | 6.89 | 5.55 |

Correlation (Cor.) IDs: 1, 2, 3, 4, 5, . . . etc. refer to those described in Table 46 above [*Brachypodium* correlated parameters (vectors)]. The *Brachypodium* accession numbers are Line 12, Line 13, Line 13, etc.

TABLE 50

Measured parameters of correlation IDs in additional *brachypodium* accessions normal conditions

| Cor. ID Line | L-13 | L-14 | L-15 | L-16 | L-17 | L-18 | L-19 | L-20 | L-21 | L-22 |
|---|---|---|---|---|---|---|---|---|---|---|
| 1 | 4.96 | 4.00 | 4.26 | 5.99 | 4.34 | 3.70 | 3.90 | 4.82 | 4.87 | 3.76 |
| 2 | 0.06 | 0.10 | 0.08 | 0.08 | 0.06 | 0.09 | 0.04 | 0.06 | 0.09 | 0.09 |
| 3 | 1.71 | 1.81 | 1.76 | 1.87 | 1.66 | 1.65 | 1.60 | 1.80 | 1.90 | 1.68 |
| 4 | 0.10 | 0.10 | 0.09 | 0.12 | 0.09 | 0.09 | 0.09 | 0.11 | 0.11 | 0.09 |
| 5 | 0.74 | 0.84 | 0.80 | 0.84 | 0.74 | 0.75 | 0.72 | 0.79 | 0.87 | 0.76 |
| 6 | 0.17 | 0.15 | 0.14 | 0.18 | 0.16 | 0.15 | 0.15 | 0.17 | 0.17 | 0.15 |
| 7 | 0.13 | 0.37 | 0.49 | 0.31 | 0.20 | 0.35 | 0.27 | 0.32 | 0.44 | 0.30 |
| 8 | 1.07 | 2.99 | 3.52 | 2.41 | 1.47 | 2.58 | 2.04 | 2.58 | 3.40 | 1.92 |
| 9 | 0.18 | 0.09 | 0.16 | 0.18 | 0.11 | 0.21 | 0.17 | 0.15 | 0.18 | 0.09 |
| 10 | 9.74 | 22.19 | 24.32 | 13.25 | 19.22 | 16.11 | 21.40 | 25.88 | 17.05 | 25.54 |
| 11 | 80.75 | 177.5 | 172.8 | 98.6 | 143.2 | 123.5 | 156.8 | 207 | 135 | 177 |
| 12 | 2.00 | 3.50 | 3.80 | 2.80 | 2.83 | 2.83 | 2.33 | 2.60 | 4.50 | 3.17 |
| 13 | 1.42 | 2.71 | 2.61 | 2.12 | 2.16 | 2.17 | 1.85 | 1.93 | 2.85 | 2.79 |
| 14 | 0.89 | 12.58 | 12.13 | 6.35 | 7.15 | 9.44 | 5.02 | 4.90 | 7.72 | 15.36 |
| 15 | 8.11 | 53.21 | 47.81 | 42.81 | 34.92 | 52.41 | 20.84 | 17.55 | 47.73 | 59.01 |
| 16 | 0.34 | 1.72 | 1.32 | 0.48 | 0.63 | 0.82 | 0.68 | 0.87 | 1.05 | 1.73 |
| 17 | 22.39 | 55.04 | 45.34 | 40.20 | 39.18 | 45.35 | 29.41 | 38.39 | 46.74 | 58.82 |
| 18 | 8.25 | 8.00 | 7.00 | 7.60 | 7.33 | 7.50 | 7.33 | 8.00 | 7.88 | 6.83 |
| 19 | 0.59 | 2.27 | 1.91 | 1.09 | 1.26 | 1.46 | 0.96 | 1.56 | 1.42 | 2.25 |
| 20 | 4.92 | 18.15 | 13.49 | 8.35 | 9.42 | 11.31 | 7.16 | 12.44 | 11.05 | 15.55 |
| 21 | 0.68 | 0.56 | 0.59 | 0.70 | 0.66 | 0.68 | 0.60 | 0.65 | 0.58 | 0.57 |
| 22 | 10.54 | 27.15 | 26.30 | 13.56 | 20.79 | 16.99 | 23.61 | 27.20 | 18.25 | 29.09 |
| 23 | 0.94 | 3.99 | 3.23 | 1.57 | 1.89 | 2.28 | 1.63 | 2.43 | 2.47 | 3.98 |
| 24 | 7.76 | 31.94 | 22.78 | 12.04 | 14.14 | 17.78 | 12.29 | 19.40 | 19.27 | 27.67 |
| 25 | 2.84 | 13.80 | 9.28 | 3.70 | 4.72 | 6.47 | 5.13 | 6.96 | 8.23 | 12.12 |

Correlation (Cor.) IDs: 1, 2, 3, 4, 5, . . . etc. refer to those described in Table 46 above [*Brachypodium* correlated parameters (vectors)]. The *Brachypodium* accession numbers are Line 12, Line 13, Line 13, etc.

TABLE 51

Measured parameters of correlation IDs in *Brachypodium* accessions under low N vs. normal conditions

| Cor. ID Line | L-1 | L-2 | L-3 | L-4 | L-5 | L-6 | L-7 | L-8 | L-9 | L-10 | L-11 |
|---|---|---|---|---|---|---|---|---|---|---|---|
| 1 | 0.58 | 0.89 | 0.62 | 0.91 | 1.19 | 0.48 | 0.84 | 1.56 | 0.87 | 0.29 | 0.55 |
| 2 | 1.07 | 1.14 | 0.97 | 0.96 | 1.08 | 1.03 | 0.90 | 1.02 | 1.06 | 1.04 | 0.98 |
| 3 | 0.62 | 0.97 | 0.97 | 0.67 | 0.98 | 0.68 | 0.55 | 1.06 | 0.66 | 0.83 | 0.66 |
| 4 | 1.04 | 1.00 | 1.03 | 1.01 | 1.02 | 1.04 | 1.03 | 0.96 | 1.01 | 1.01 | 0.98 |
| 5 | 1.03 | 0.94 | 0.99 | 0.99 | 1.03 | 1.04 | 0.95 | 0.95 | 1.02 | 1.01 | 0.94 |
| 6 | 0.58 | 0.88 | 1.20 | 0.68 | 1.13 | 0.36 | 0.43 | 1.37 | 0.83 | 1.05 | 0.13 |
| 7 | 0.61 | 0.88 | 0.60 | 0.71 | 1.14 | 0.36 | 0.43 | 1.22 | 0.94 | 1.39 | 0.13 |
| 8 | 1.13 | 1.05 | 2.10 | 1.00 | 1.42 | 0.76 | 1.01 | 1.52 | 1.50 | 1.58 | 0.40 |
| 9 | 0.64 | 0.85 | 0.72 | 0.97 | 0.81 | 0.77 | 0.77 | 0.99 | 0.68 | 0.82 | 0.55 |
| 10 | 0.67 | 0.85 | 0.36 | 1.08 | 0.82 | 0.76 | 0.78 | 0.89 | 0.74 | 1.03 | 0.56 |
| 11 | 0.79 | 0.91 | 0.87 | 0.98 | 1.05 | 0.88 | 1.04 | 1.10 | 1.06 | 0.75 | 0.89 |
| 12 | 0.36 | 0.74 | 0.36 | 0.78 | 0.88 | 0.32 | 0.61 | 1.13 | 0.50 | 0.20 | 0.24 |
| 13 | 0.47 | 0.82 | 0.51 | 0.75 | 0.65 | 0.43 | 0.47 | 0.94 | 0.58 | 0.48 | 0.27 |
| 14 | 0.78 | 0.96 | 0.74 | 0.85 | 0.88 | 0.79 | 0.77 | 0.97 | 0.89 | 0.79 | 0.69 |
| 15 | 0.39 | 0.82 | 0.68 | 0.66 | 0.77 | 0.47 | 0.43 | 1.00 | 0.44 | 0.67 | 0.37 |
| 16 | 0.40 | 0.82 | 0.34 | 0.71 | 0.78 | 0.47 | 0.44 | 0.90 | 0.49 | 0.86 | 0.38 |

TABLE 51-continued

Measured parameters of correlation IDs in *Brachypodium* accessions under low N vs. normal conditions

| Cor. ID Line | L-1 | L-2 | L-3 | L-4 | L-5 | L-6 | L-7 | L-8 | L-9 | L-10 | L-11 |
|---|---|---|---|---|---|---|---|---|---|---|---|
| 17 | 0.65 | 0.93 | 0.79 | 0.95 | 0.85 | 0.80 | 0.76 | 0.98 | 0.67 | 0.80 | 0.51 |
| 18 | 0.41 | 0.82 | 0.63 | 0.68 | 0.72 | 0.46 | 0.45 | 0.98 | 0.49 | 0.59 | 0.32 |
| 19 | 0.43 | 0.82 | 0.32 | 0.75 | 0.73 | 0.46 | 0.45 | 0.88 | 0.54 | 0.76 | 0.33 |
| 20 | 0.49 | 0.82 | 0.25 | 0.83 | 0.66 | 0.43 | 0.47 | 0.84 | 0.65 | 0.62 | 0.27 |

Correlation IDs 1, 2, 3, 4, 5 . . . etc. refer to those described in Table 45 above [*Brachypodium* correlated parameters (vectors)]. The *Brachypodium* accession numbers are Line 1, Line 2, etc. Phenotypic ratio of low N versus normal conditions (Maintenance of performance under low N conditions) was calculated and correlation of this ratio with expression under low N conditions was calculated.

TABLE 52

Measured parameters of correlation IDs in additional *brachypodium* accessions under low N vs. normal conditions

| Corr. ID Line | L-12 | L-13 | L-14 | L-15 | L-16 | L-17 | L-18 | L-19 | L-20 | L-21 | L-22 |
|---|---|---|---|---|---|---|---|---|---|---|---|
| 1 | 0.50 | 1.33 | 0.74 | 0.78 | 0.88 | 0.61 | 0.93 | 0.72 | 0.63 | 0.73 | 0.91 |
| 2 | 1.00 | 1.00 | 1.09 | 0.96 | 0.99 | 1.07 | 0.95 | 1.00 | 0.98 | 1.09 | 1.08 |
| 3 | 0.84 | 0.90 | 0.78 | 0.92 | 0.83 | 0.76 | 0.62 | 0.95 | 0.93 | 0.98 | 0.93 |
| 4 | 0.94 | 1.02 | 1.02 | 0.97 | 0.98 | 1.03 | 1.02 | 1.03 | 1.03 | 0.99 | 0.98 |
| 5 | 0.94 | 1.03 | 1.01 | 0.93 | 0.98 | 1.04 | 1.04 | 1.03 | 1.03 | 0.99 | 0.97 |
| 6 | 1.02 | 0.75 | 0.45 | 0.70 | 0.42 | 0.88 | 0.57 | 0.74 | 0.84 | 1.11 | 0.38 |
| 7 | 0.98 | 0.66 | 0.45 | 0.71 | 0.38 | 0.90 | 0.61 | 0.76 | 0.84 | 1.07 | 0.46 |
| 8 | 1.64 | 0.74 | 1.11 | 1.47 | 0.93 | 1.59 | 0.85 | 1.44 | 1.32 | 1.57 | 0.63 |
| 9 | 0.75 | 0.93 | 0.55 | 0.53 | 0.60 | 0.63 | 0.67 | 0.74 | 0.51 | 0.71 | 0.60 |
| 10 | 0.75 | 0.86 | 0.55 | 0.53 | 0.59 | 0.64 | 0.69 | 0.80 | 0.51 | 0.68 | 0.64 |
| 11 | 0.90 | 1.07 | 0.80 | 0.78 | 0.91 | 0.88 | 0.97 | 1.01 | 0.89 | 0.82 | 0.82 |
| 12 | 0.37 | 1.25 | 0.40 | 0.41 | 0.48 | 0.37 | 0.57 | 0.43 | 0.34 | 0.50 | 0.54 |
| 13 | 0.56 | 0.63 | 0.34 | 0.38 | 0.57 | 0.58 | 0.40 | 0.44 | 0.38 | 0.70 | 0.51 |
| 14 | 0.78 | 0.95 | 0.70 | 0.80 | 0.75 | 0.74 | 0.77 | 0.75 | 0.77 | 0.90 | 0.69 |
| 15 | 0.64 | 0.79 | 0.43 | 0.48 | 0.50 | 0.47 | 0.40 | 0.64 | 0.49 | 0.71 | 0.57 |
| 16 | 0.62 | 0.72 | 0.43 | 0.49 | 0.47 | 0.47 | 0.41 | 0.67 | 0.49 | 0.68 | 0.61 |
| 17 | 0.74 | 0.89 | 0.46 | 0.52 | 0.59 | 0.61 | 0.64 | 0.71 | 0.48 | 0.71 | 0.53 |
| 18 | 0.60 | 0.73 | 0.39 | 0.44 | 0.52 | 0.51 | 0.40 | 0.56 | 0.45 | 0.71 | 0.54 |
| 19 | 0.58 | 0.67 | 0.39 | 0.44 | 0.49 | 0.50 | 0.41 | 0.59 | 0.45 | 0.67 | 0.57 |
| 20 | 0.54 | 0.59 | 0.34 | 0.38 | 0.52 | 0.56 | 0.41 | 0.46 | 0.38 | 0.65 | 0.53 |

Correlation IDs 1, 2, 3, 4, 5 . . . etc. refer to those described in Table 45 above [*Brachypodium* correlated parameters (vectors)]. The *Brachypodium* accession numbers are Line 12, Line 13, etc. Phenotypic ratio of low N versus normal conditions (Maintenance of performance under low N conditions) was calculated and correlation of this ratio with expression under low N conditions was calculated.

TABLE 53

Correlation between the expression level of selected genes of some embodiments of the invention in various tissues and the phenotypic performance under low nitrogen fertilization conditions across *brachypodium* accessions

| Gene Name | R | P value | Exp. set | Cor. Set ID | Gene Name | R | P value | Exp. set | Cor. Set ID |
|---|---|---|---|---|---|---|---|---|---|
| WNU45 | 0.705 | 1.05E−02 | 1 | 19 | WNU45 | 0.727 | 7.40E−03 | 1 | 15 |
| WNU45 | 0.718 | 8.54E−03 | 1 | 13 | WNU45 | 0.704 | 1.06E−02 | 1 | 16 |
| WNU45 | 0.727 | 7.33E−03 | 1 | 18 | WNU46 | 0.828 | 8.80E−04 | 1 | 10 |
| WNU46 | 0.870 | 2.32E−04 | 1 | 17 | WNU46 | 0.905 | 5.28E−05 | 1 | 19 |
| WNU46 | 0.907 | 4.75E−05 | 1 | 15 | WNU46 | 0.712 | 9.41E−03 | 1 | 1 |
| WNU46 | 0.899 | 6.89E−05 | 1 | 20 | WNU46 | 0.908 | 4.46E−05 | 1 | 13 |
| WNU46 | 0.805 | 1.57E−03 | 1 | 12 | WNU46 | 0.900 | 6.73E−05 | 1 | 16 |
| WNU46 | 0.851 | 4.49E−04 | 1 | 11 | WNU46 | 0.732 | 6.77E−03 | 1 | 14 |
| WNU46 | 0.858 | 3.51E−04 | 1 | 9 | WNU46 | 0.792 | 2.15E−03 | 1 | 3 |
| WNU46 | 0.913 | 3.46E−05 | 1 | 18 | WNU47 | 0.801 | 1.74E−03 | 2 | 1 |
| WNU47 | 0.813 | 1.29E−03 | 2 | 12 | WNU47 | 0.747 | 5.28E−03 | 2 | 11 |
| WNU47 | 0.712 | 9.40E−03 | 1 | 10 | WNU47 | 0.704 | 1.07E−02 | 1 | 17 |
| WNU47 | 0.745 | 5.42E−03 | 1 | 9 | WNU50 | 0.790 | 2.22E−03 | 2 | 10 |
| WNU49 | 0.785 | 2.47E−03 | 1 | 2 | WNU50 | 0.816 | 1.20E−03 | 2 | 19 |
| WNU50 | 0.749 | 5.01E−03 | 2 | 17 | WNU50 | 0.855 | 3.95E−04 | 2 | 1 |
| WNU50 | 0.791 | 2.20E−03 | 2 | 15 | WNU50 | 0.789 | 2.30E−03 | 2 | 13 |
| WNU50 | 0.808 | 1.48E−03 | 2 | 20 | WNU50 | 0.814 | 1.26E−03 | 2 | 16 |
| WNU50 | 0.901 | 6.40E−05 | 2 | 12 | WNU50 | 0.797 | 1.90E−03 | 2 | 14 |
| WNU50 | 0.852 | 4.28E−04 | 2 | 11 | WNU50 | 0.795 | 2.02E−03 | 2 | 18 |
| WNU50 | 0.773 | 3.18E−03 | 2 | 9 | WNU51 | 0.838 | 6.71E−04 | 2 | 15 |

TABLE 53-continued

Correlation between the expression level of selected genes of some embodiments of the invention in various tissues and the phenotypic performance under low nitrogen fertilization conditions across *brachypodium* accessions

| Gene Name | R | P value | Exp. set | Cor. Set ID | Gene Name | R | P value | Exp. set | Cor. Set ID |
|---|---|---|---|---|---|---|---|---|---|
| WNU51 | 0.864 | 2.93E−04 | 2 | 19 | WNU51 | 0.890 | 1.07E−04 | 2 | 20 |
| WNU51 | 0.841 | 6.06E−04 | 2 | 6 | WNU51 | 0.747 | 5.23E−03 | 2 | 12 |
| WNU51 | 0.893 | 9.39E−05 | 2 | 13 | WNU51 | 0.770 | 3.38E−03 | 2 | 11 |
| WNU51 | 0.837 | 6.89E−04 | 2 | 16 | WNU51 | 0.839 | 6.47E−04 | 2 | 7 |
| WNU51 | 0.798 | 1.88E−03 | 2 | 14 | WNU51 | 0.781 | 2.71E−03 | 2 | 3 |
| WNU51 | 0.704 | 1.06E−02 | 2 | 9 | WNU52 | 0.718 | 8.52E−03 | 1 | 19 |
| WNU51 | 0.866 | 2.72E−04 | 2 | 18 | WNU52 | 0.871 | 2.29E−04 | 1 | 1 |
| WNU52 | 0.722 | 8.04E−03 | 1 | 15 | WNU52 | 0.708 | 9.92E−03 | 1 | 13 |
| WNU52 | 0.706 | 1.03E−02 | 1 | 20 | WNU52 | 0.720 | 8.25E−03 | 1 | 16 |
| WNU52 | 0.853 | 4.19E−04 | 1 | 12 | WNU52 | 0.788 | 2.35E−03 | 1 | 14 |
| WNU52 | 0.852 | 4.32E−04 | 1 | 11 | WNU52 | 0.720 | 8.22E−03 | 1 | 18 |
| WNU52 | 0.712 | 9.45E−03 | 1 | 9 | | | | | |

"Cor. ID"—correlation set ID according to the correlated parameters Table above.
"Exp. Set"—Expression set.
"R" = Pearson correlation coefficient;
"P" = p value.

TABLE 54

Correlation between the expression level of selected genes of some embodiments of the invention in various tissues and the phenotypic performance under normal nitrogen fertilization conditions across *brachypodium* accessions

| Gene Name | R | P value | Exp. set | Cor. Set ID | Gene Name | R | P value | Exp. set | Cor. Set ID |
|---|---|---|---|---|---|---|---|---|---|
| WNU46 | 0.806 | 4.92E−03 | 2 | 21 | WNU52 | 0.725 | 1.76E−02 | 2 | 15 |
| WNU49 | 0.762 | 1.04E−02 | 2 | 18 | WNU52 | 0.754 | 1.17E−02 | 2 | 14 |

"Cor. ID"—correlation set ID according to the correlated parameters Table above.
"Exp. Set"—Expression set.
"R" = Pearson correlation coefficient;
"P" = p value.

TABLE 55

Correlation between the expression level of selected genes of some embodiments of the invention in various tissues and the phenotypic performance under low nitrogen fertilization vs. normal conditions across *brachypodium* accessions

| Gene Name | R | P value | Exp. set | Cor. Set ID | Gene Name | R | P value | Exp. set | Cor. Set ID |
|---|---|---|---|---|---|---|---|---|---|
| WNU49 | 0.777 | 2.94E−03 | 1 | 20 | WNU49 | 0.713 | 9.17E−03 | 1 | 19 |
| WNU49 | 0.718 | 8.56E−03 | 1 | 13 | | | | | |

"Corr. ID"—correlation set ID according to the correlated parameters Table above.
"Exp. Set"—Expression set.
"R" = Pearson correlation coefficient;
"P" = p value.

Example 12

Production of Foxtail Millet Transcriptome and High Throughput Correlation Analysis Using 60K Foxtail Millet Oligonucleotide Micro-Array In order to produce a high throughput correlation analysis comparing between plant phenotype and gene expression level, the present inventors utilized a foxtail millet oligonucleotide micro-array, produced by Agilent Technologies [chem. (dot) agilent (dot) com/Scripts/PDS (dot) asp?1Page=50879]. The array oligonucleotide represents about 60K foxtail millet genes and transcripts. In order to define correlations between the levels of RNA expression and yield or vigor related parameters, various plant characteristics of 14 different foxtail millet accessions were analyzed. Among them, 11 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Fourteen Foxtail millet accessions in 5 repetitive plots, in the field. Foxtail millet seeds were sown in soil and grown under normal condition[15 units of Nitrogen (kg nitrogen per dunam)], reduced nitrogen fertilization (2.5-3.0 units of Nitrogen in the soil (based on soil measurements) and reduced stands in the field [i.e., 8 plants per meter per row as compared to "standard" stands of 17 plants per meter row].

Analyzed Foxtail millet tissues—three tissues at different developmental stages [leaf, flower, and stem], representing different plant characteristics, were sampled and RNA was extracted as described above. Each micro-array expression information tissue type has received a Set ID as summarized in Tables 56-57 below.

TABLE 56

Foxtail millet transcriptome expression sets under normal conditions

| Expression Set | Set ID |
| --- | --- |
| normal/flag leaf: Normal: grainfilling: | 1 |
| normal/flag leaf: Normal: heading: | 2 |
| normal/flower: Normal: heading: | 3 |
| normal/head: Normal: grainfilling: | 4 |
| normal/leaf: Normal: seedling: | 5 |
| normal/low stem: Normal: heading: | 6 |
| normal/mature leaf: Normal: grainfilling: | 7 |
| normal/root: Normal: seedling: | 8 |
| normal/stem: Normal: seedling: | 9 |
| normal/stem node: Normal: grainfilling: | 10 |
| normal/up stem: Normal: grainfilling: | 11 |
| normal/up stem: Normal: heading: | 12 |
| normal/vein: Normal: grainfilling: | 13 |

Table 56. Provided are the foxtail millet transcriptome expression sets under normal conditions

TABLE 57

Foxtail millet transcriptome expression sets under low N conditions

| Expression Set | Set ID |
| --- | --- |
| Low N/flag leaf: Low N: grainfilling: | 1 |
| Low N/flag leaf: Low N: heading: | 2 |
| Low N/flower: Low N: heading: | 3 |
| Low N/head: Low N: grainfilling: | 4 |
| Low N/low stem: Low N: heading: | 5 |
| Low N/mature leaf: Low N: grainfilling: | 6 |
| Low N/stem node: Low N: grainfilling: | 7 |
| Low N/up stem: Low N: grainfilling: | 8 |
| Low N/up stem: Low N: heading: | 9 |
| Low N/vein: Low N: grainfilling: | 10 |

Table 57. Provided are the foxtail millet transcriptome expression sets under low N conditions Foxtail millet yield components and vigor related parameters assessment—Plants were continuously phenotyped during the growth period and at harvest (Tables 58-59, below). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

The following parameters were collected using digital imaging system:

At the end of the growing period the grains were separated from the Plant 'Head' and the following parameters were measured and collected:

(i) Average Grain Area ($cm^2$)—A sample of ~200 grains was weighted, photographed and images were processed using the below described image processing system. The grain area was measured from those images and was divided by the number of grains.

(ii) Average Grain Length and width (cm)—A sample of ~200 grains was weighted, photographed and images were processed using the below described image processing system. The sum of grain lengths and width (longest axis) was measured from those images and was divided by the number of grains.

At the end of the growing period 14 'Heads' were photographed and images were processed using the below described image processing system.

(i) Head Average Area ($cm^2$)—The 'Head' area was measured from those images and was divided by the number of 'Heads'.

(ii) Head Average Length (mm)—The 'Head' length (longest axis) was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot (SP) or by measuring the parameter across all the plants within the plot (RP).

Total Grain Weight (gr.)—At the end of the experiment (plant 'Heads') heads from plots were collected, the heads were threshed and grains were weighted. In addition, the average grain weight per head was calculated by dividing the total grain weight by number of total heads per plot (based on plot).

Head weight and head number—At the end of the experiment, heads were harvested from each plot and were counted and weighted (kg.).

Biomass at harvest—At the end of the experiment the vegetative material from plots was weighted.

Dry weight—total weight of the vegetative portion above ground (excluding roots) after drying at 70° C. in oven for 48 hours at harvest.

Total dry mater per plot—Calculated as Vegetative portion above ground plus all the heads dry weight per plot.

Num days to anthesis—Calculated as the number of days from sowing till 50% of the plot arrives anthesis.

Total No. of tillers—all tillers were counted per plot at two time points at the Vegetative growth (30 days after sowing) and at harvest.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (Gr.), root length (Cm) and No. of lateral roots—one plant per plot (5 repeated plots) were selected for measurement of root weight, root length and for counting the number of lateral roots formed.

Shoot FW (fresh weight)—weight of one plant per plot were recorded at different time-points.

Grain N (H)—% N content of dry matter in the grain at harvest.

Head N (GF)—% N content of dry matter in the head at grainfilling.

Total shoot N—calculated as the % N content multiplied by the weight of plant shoot Total grain N—calculated as the % N content multiplied by the weight of plant grain yield.

NUE [kg/kg]—is the ratio between total grain yield per total N applied in soil.
NUpE [kg/kg]—is the ratio between total plant biomass per total N applied in soil.
Grain NUtE—is the ratio between grain yield per total shoot N.
Total NUtE—is the ratio between grain and shoot biomass per total shoot N.
Stem Volume of lower stem—the calculated volume of the lowest internode.
Stem Volume of upper stem—the calculated volume of the internode just below the head.
Stem density—is the ratio between internode dry weight and internode volume.

Maintenance of performance under low N conditions—Represent ratio for the specified parameter of low N condition results divided by Normal conditions results (maintenance of phenotype under low N in comparison to normal conditions).

Data parameters collected are summarized in Tables 58-59 herein below

TABLE 58

Foxtail millet correlated parameters under normal conditions (vectors)

| Correlation set | Correlation ID |
|---|---|
| Grain N (H) [%] | 1 |
| Grains Yield per plant (RP) [gr] | 2 |
| Grains yield (RP) [gr] | 3 |
| Head N (GF) [%] | 4 |
| Heads FW (RP) [gr] | 5 |
| Heads FW (SP)[gr] | 6 |
| Heads num (SP) | 7 |
| Heads weight (RP) [gr] | 8 |
| Heads weight (SP) [gr] | 9 |
| Heads weight per plant (RP) [gr] | 10 |
| Leaves num 1 | 11 |
| Leaves num 2 | 12 |
| Leaves num 3 | 13 |
| Leaves num 4 | 14 |
| Leaves temperature 1 [C.] | 15 |
| Leaves temperature 2 [C.] | 16 |
| Lower Stem DW (F) [gr] | 17 |
| Lower Stem FW (F) [gr] | 18 |
| Lower Stem length (F) [cm] | 19 |
| Lower Stem width (F) [cm] | 20 |
| Lower stem DW/cm [gr/cm] | 21 |
| Lower stem density [gr/cm$^3$] | 22 |
| NUE | 23 |
| NHI | 24 |
| NUpE | 25 |
| Num days to Heading (field) | 26 |
| Num days to Maturity [days] | 27 |
| Num lateral roots | 28 |
| Plant height growth [cm/day] | 29 |
| Plant height 1 [cm] | 30 |
| Plant height 2 [cm] | 31 |
| Plant height 3 [cm] | 32 |
| Plant height 4 [cm] | 33 |
| Plant num at harvest | 34 |
| Plant weight growth [gr/day] | 35 |
| Root length [cm] | 36 |
| SPAD (F) | 37 |
| SPAD 1 | 38 |
| SPAD 2 | 39 |
| Shoot DW 1 [gr] | 40 |
| Shoot DW 2 [gr] | 41 |
| Shoot DW 3 [gr] | 42 |
| Shoot N (H) [%] | 43 |
| Tillering 1 | 44 |
| Tillering 2 | 45 |
| Tillering 3 | 46 |
| Total grain N (H) [mg] | 47 |
| Total shoot N (H) [mg] | 48 |

TABLE 58-continued

Foxtail millet correlated parameters under normal conditions (vectors)

| Correlation set | Correlation ID |
|---|---|
| Upper Stem DW (F) [gr] | 49 |
| Upper Stem FW (F) [gr] | 50 |
| Upper Stem length (F) [cm] | 51 |
| Upper Stem width (F) [cm] | 52 |
| Upper stem DW/cm [gr/cm] | 53 |
| Upper stem density [gr/cm$^3$] | 54 |
| Vegetative DW (RP) [gr] | 55 |
| Vegetative DW (SP) [gr] | 56 |
| Vegetative DW per plant [gr] | 57 |
| Vegetative FW (RP) [gr] | 58 |
| Vegetative FW (SP) [gr] | 59 |
| grain NUtE | 60 |
| lower stem volume (F) [cm$^3$] | 61 |
| total NUtE | 62 |
| upper stem volume [cm$^3$] | 63 |

Table58. Provided are the foxtail millet collected parameters under normal conditions. "num" = number.

TABLE 59

Foxtail millet correlated parameters under low N conditions (vectors)

| Correlation set | Correlation ID |
|---|---|
| Grain N (H) [%] | 1 |
| Grain N (H) NUE ratio | 2 |
| Grains Yield per plant (RP) [gr] | 3 |
| Grains Yield per plant (RP) NUE ratio | 4 |
| Grains yield (RP) [gr] | 5 |
| Head N (GF) [%] | 6 |
| Head N (GF) NUE ratio | 7 |
| Heads FW (RP) [gr] | 8 |
| Heads FW (SP) [gr] | 9 |
| Heads num (SP) | 10 |
| Heads num (SP) NUE ratio | 11 |
| Heads weight (RP) [gr] | 12 |
| Heads weight (SP) [gr] | 13 |
| Heads weight per plant (RP) [gr] | 14 |
| Heads weight per plant (RP) NUE ratio | 15 |
| Leaves num 1 | 16 |
| Leaves num 2 | 17 |
| Leaves num 3 | 18 |
| Leaves num 4 | 19 |
| Leaves num 4 NUE ratio | 20 |
| Leaves temperature 1 [C.] | 21 |
| Leaves temperature 2 [C.] | 22 |
| Lower Stem DW (F) [gr] | 23 |
| Lower Stem FW (F) [gr] | 24 |
| Lower Stem length (F) [cm] | 25 |
| Lower Stem width (F) [cm] | 26 |
| Lower stem DW/cm [gr/cm] | 27 |
| Lower stem DW/cm NUE ratio | 28 |
| Lower stem density [gr/cm$^3$] | 29 |
| Lower stem density NUE ratio | 30 |
| NUE | 31 |
| NUE NUE ratio | 32 |
| NUI | 33 |
| NUI NUE ratio | 34 |
| NUpE | 35 |
| NUpE NUE ratio | 36 |
| Num days to Heading (field) | 37 |
| Num days to Heading NUE ratio (field) | 38 |
| Num days to Maturity | 39 |
| Num lateral roots | 40 |
| Num lateral roots NUE ratio | 41 |
| Plant height growth [cm/day] | 42 |
| Plant height growth NUE ratio | 43 |
| Plant height 1 [cm] | 44 |
| Plant height 2 [cm] | 45 |
| Plant height 3 [cm] | 46 |
| Plant height 4 [cm] | 47 |
| Plant height 4 NUE ratio | 48 |
| Plant num at harvest | 49 |
| Plant weight growth [gr/day] | 50 |

TABLE 59-continued

Foxtail millet correlated parameters under low N conditions (vectors)

| Correlation set | Correlation ID |
|---|---|
| Plant weight growth NUE ratio | 51 |
| Root length [cm] | 52 |
| Root length NUE ratio | 53 |
| SPAD (F) | 54 |
| SPAD (F) NUE ratio | 55 |
| SPAD 1 | 56 |
| SPAD 2 | 57 |
| Shoot C (H) [%] | 58 |
| Shoot DW 1 [gr] | 59 |
| Shoot DW 2 [gr] | 60 |
| Shoot DW 3 [gr] | 61 |
| Shoot DW 3 NUE ratio | 62 |
| Shoot N (H) [%] | 63 |
| Shoot N (H) NUE ratio | 64 |
| Tillering 1 | 65 |
| Tillering 2 | 66 |
| Tillering 3 | 67 |
| Tillering 3 NUE ratio | 68 |
| Total grain N (H) [mg] | 69 |
| Total grain N (H) NUE ratio | 70 |
| Total shoot N (H) [mg] | 71 |
| Total shoot N (H) NUE ratio | 72 |
| Upper Stem DW (F) [gr] | 73 |
| Upper Stem FW (F) [gr] | 74 |
| Upper Stem length (F) [cm] | 75 |
| Upper Stem width (F) [cm] | 76 |
| Upper stem DW/cm [gr/cm] | 77 |
| Upper stem DW/cm NUE ratio | 78 |
| Upper stem density [gr/cm$^3$] | 79 |
| Upper stem density NUE ratio | 80 |
| Vegetative DW (RP) [gr] | 81 |
| Vegetative DW (SP) [gr] | 82 |
| Vegetative DW per plant [gr] | 83 |
| Vegetative DW per plant NUE ratio | 84 |
| Vegetative FW (RP) [gr] | 85 |
| Vegetative FW (SP) [gr] | 86 |
| grain NUtE | 87 |
| grain NUtE NUE ratio | 88 |
| lower stem volume (F) | 89 |
| lower stem volume (F) NUE ratio | 90 |
| shoot C/N (H) | 91 |
| shoot C/N (H) NUE ratio | 92 |
| total NUtE | 93 |
| total NUtE NUE ratio | 94 |
| upper stem volume [cm$^3$] | 95 |
| upper stem volume NUE ratio | 96 |

Table 59. Provided are the foxtail millet collected parameters under low N conditions.

Experimental Results

Fourteen different foxtail millet accessions were grown and characterized for different parameters as described above. The average for each of the measured parameters was calculated using the JMP software and values are summarized in Tables 60-61 below. Subsequent correlation analysis between the various transcriptome sets and the average parameters was conducted. Follow, results were integrated to the database.

TABLE 60

Measured parameters of correlation IDs in foxtail millet accessions under normal conditions

| Cor. ID Line | L-1 | L-2 | L-3 | L-4 | L-5 | L-6 | L-7 | L-8 | L-9 | L-10 | L-11 | L-12 | L-13 | L-14 |
|---|---|---|---|---|---|---|---|---|---|---|---|---|---|---|
| 1 | 1.77 | 2.36 | NA | 1.98 | 2.07 | 2.13 | 2.13 | NA | 1.79 | 3.05 | NA | 1.85 | NA | 1.97 |
| 2 | 34.71 | 23.00 | 24.84 | 31.07 | 26.64 | 28.32 | 34.92 | 26.40 | 48.35 | 22.35 | 9.38 | 31.53 | 30.10 | 29.98 |
| 3 | 1086.00 | 679.20 | 727.60 | 797.60 | 792.40 | 856.80 | 902.80 | 803.60 | 1120.80 | 584.40 | 268.00 | 818.80 | 800.80 | 818.40 |
| 4 | 1.72 | 2.21 | NA | 2.30 | 1.97 | 2.07 | 2.45 | NA | 1.93 | 1.81 | NA | 2.17 | NA | 2.26 |
| 5 | 1.80 | 1.12 | 1.07 | 1.34 | 1.32 | 1.11 | 1.36 | 1.16 | 1.69 | 1.44 | 0.57 | 1.13 | 1.23 | 1.27 |
| 6 | 0.24 | 0.17 | 0.18 | 0.27 | 0.21 | 0.23 | 0.28 | 0.25 | 0.39 | 0.25 | 0.13 | 0.25 | 0.31 | 0.29 |
| 7 | 7.20 | 94.00 | 87.60 | 295.40 | 114.00 | 122.40 | 29.80 | 129.20 | 11.00 | 13.20 | 53.60 | 32.80 | 60.60 | 323.20 |
| 8 | 1.31 | 0.87 | 0.89 | 1.07 | 1.02 | 0.98 | 1.10 | 0.98 | 1.29 | 1.03 | 0.42 | 1.00 | 0.99 | 1.02 |
| 9 | 0.18 | 0.10 | 0.12 | 0.24 | 0.21 | 0.23 | 0.22 | 0.24 | 0.30 | 0.18 | 0.10 | 0.22 | 0.24 | 0.23 |
| 10 | 41.78 | 29.33 | 30.26 | 41.57 | 34.38 | 32.52 | 41.81 | 32.10 | 60.61 | 39.91 | 14.61 | 38.41 | 37.47 | 37.42 |
| 11 | 4.07 | 5.33 | 4.13 | 5.07 | 5.00 | 4.27 | 3.67 | 3.77 | 3.79 | 3.73 | 4.00 | 3.90 | 4.03 | 5.23 |
| 12 | NA | NA | NA | NA | NA | NA | NA | NA | NA | NA | NA | NA | NA | NA |
| 13 | 5.30 | 2.90 | 2.94 | 3.55 | 3.90 | 4.13 | 4.40 | 4.10 | 3.90 | 4.35 | 3.25 | 3.30 | 3.75 | 3.70 |
| 14 | 7.90 | 4.70 | 4.50 | 5.30 | 6.55 | 6.35 | 7.15 | 7.00 | 6.65 | 5.90 | 4.80 | 5.20 | 5.20 | 9.25 |
| 15 | NA | NA | NA | 27.70 | 28.02 | 28.35 | 28.23 | 27.96 | NA | NA | NA | NA | NA | 27.54 |
| 16 | 30.18 | NA | NA | NA | NA | NA | NA | NA | 30.92 | NA | NA | NA | NA | NA |
| 17 | 0.71 | NA | 0.30 | 0.16 | 0.15 | 0.20 | 0.61 | 0.17 | 0.86 | NA | NA | 0.55 | 0.93 | 0.09 |
| 18 | 4.21 | NA | 1.43 | 0.69 | 0.64 | 0.64 | 2.50 | 0.76 | 3.13 | NA | NA | 3.64 | 5.49 | 0.39 |
| 19 | 8.35 | NA | 10.25 | 8.75 | 6.69 | 7.64 | 8.08 | 7.15 | 9.15 | NA | NA | 10.18 | 12.26 | 8.98 |
| 20 | 7.24 | NA | 4.16 | 3.12 | 3.33 | 3.18 | 5.57 | 3.61 | 6.95 | NA | NA | 6.23 | 6.75 | 2.24 |
| 21 | 0.08 | NA | 0.03 | 0.02 | 0.02 | 0.03 | 0.08 | 0.02 | 0.09 | NA | NA | 0.05 | 0.08 | 0.01 |
| 22 | 0.21 | NA | 0.22 | 0.23 | 0.26 | 0.33 | 0.31 | 0.23 | 0.25 | NA | NA | 0.18 | 0.21 | 0.24 |
| 23 | 1.83 | 1.21 | 1.31 | 1.64 | 1.40 | 1.49 | 1.84 | 1.39 | 2.54 | 1.18 | 0.49 | 1.66 | 1.58 | 1.58 |
| 24 | 0.91 | 0.87 | NA | 0.93 | 0.92 | 0.93 | 0.93 | NA | 0.93 | 0.88 | NA | 0.90 | NA | 0.87 |
| 25 | 35.54 | 32.85 | NA | 34.72 | 31.40 | 33.90 | 41.82 | NA | 48.90 | 40.60 | 0.00 | 34.04 | NA | 35.90 |
| 26 | 54.00 | 63.40 | 59.40 | 39.60 | 46.00 | 40.80 | 50.00 | 39.00 | 54.00 | 71.00 | 61.00 | 63.00 | 61.00 | 42.00 |
| 27 | NA | NA | NA | NA | 75.00 | 75.00 | NA | 75.00 | NA | 98.00 | 109.00 | 98.00 | 98.00 | NA |
| 28 | NA | NA | NA | NA | NA | NA | NA | NA | NA | NA | NA | NA | NA | NA |
| 29 | 2.10 | 1.42 | 1.32 | 2.10 | 1.93 | 2.44 | 1.84 | 2.56 | 1.91 | 0.97 | 1.16 | 1.35 | 1.50 | 2.12 |
| 30 | 3.72 | 2.92 | 3.25 | 3.55 | 3.45 | 3.68 | 2.92 | 3.63 | 4.12 | 2.47 | 3.10 | 3.58 | 3.43 | 3.63 |
| 31 | NA | NA | NA | NA | NA | NA | NA | NA | NA | NA | NA | NA | NA | NA |
| 32 | 26.63 | 17.68 | 18.00 | 25.83 | 23.35 | 28.60 | 21.53 | 30.53 | 26.03 | 16.78 | 17.80 | 19.53 | 20.75 | 24.55 |
| 33 | 45.98 | 31.80 | 29.75 | 46.08 | 42.88 | 53.63 | 40.68 | 55.63 | 42.10 | 20.53 | 25.75 | 30.30 | 33.30 | 47.31 |
| 34 | 31.40 | 29.60 | 29.80 | 26.00 | 30.00 | 30.20 | 27.75 | 30.75 | 23.60 | 26.00 | 29.40 | 26.20 | 27.00 | 27.40 |
| 35 | 2.85 | 3.12 | 5.11 | 4.35 | 2.87 | 3.11 | 2.93 | 3.40 | 4.79 | 3.15 | 3.41 | 3.12 | 2.04 | 4.51 |
| 36 | NA | NA | NA | NA | NA | NA | NA | NA | NA | NA | NA | NA | NA | NA |

TABLE 60-continued

Measured parameters of correlation IDs in foxtail millet accessions under normal conditions

| Cor. ID Line | L-1 | L-2 | L-3 | L-4 | L-5 | L-6 | L-7 | L-8 | L-9 | L-10 | L-11 | L-12 | L-13 | L-14 |
|---|---|---|---|---|---|---|---|---|---|---|---|---|---|---|
| 37 | 60.82 | NA | NA | 54.68 | 49.93 | 57.47 | 58.59 | 55.40 | 55.04 | NA | NA | NA | NA | 55.90 |
| 38 | NA | NA | NA | 54.68 | 49.93 | 57.47 | 58.59 | 55.40 | NA | NA | NA | NA | NA | 55.90 |
| 39 | 60.82 | NA | NA | NA | NA | NA | NA | NA | 554.04 | NA | NA | NA | NA | NA |
| 40 | 12.75 | 19.52 | 14.43 | 20.70 | 20.63 | 21.01 | 14.01 | 18.80 | 14.17 | 11.62 | 19.62 | 18.36 | 10.81 | 17.13 |
| 41 | 57.06 | 65.70 | 54.29 | 59.78 | 60.76 | 71.99 | 53.98 | 71.68 | 87.55 | 52.63 | 52.33 | 77.31 | 63.50 | 66.48 |
| 42 | 88.87 | 97.87 | 162.66 | 135.96 | 100.39 | 103.33 | 97.31 | 118.42 | 142.38 | 98.23 | 116.82 | 103.25 | 72.94 | 143.65 |
| 43 | 1.87 | 1.52 | NA | 1.78 | 1.99 | 1.79 | 1.63 | NA | 1.53 | 1.21 | NA | 1.23 | NA | 2.60 |
| 44 | NA | NA | NA | NA | NA | NA | NA | NA | NA | NA | NA | NA | NA | NA |
| 45 | 1.06 | 21.15 | 16.75 | 34.30 | 17.15 | 10.85 | 3.29 | 11.81 | 2.20 | 3.00 | 9.50 | 6.80 | 4.45 | 39.10 |
| 46 | 1.40 | 10.30 | 7.60 | 10.70 | 6.40 | 9.20 | 2.22 | 4.67 | 2.70 | 3.50 | 6.50 | 5.80 | 6.80 | 16.70 |
| 47 | 612.84 | 543.69 | NA | 613.75 | 551.78 | 602.01 | 742.76 | NA | 865.05 | 682.14 | NA | 583.65 | NA | 590.90 |
| 48 | 62.40 | 80.47 | NA | 45.88 | 44.79 | 42.05 | 51.85 | NA | 64.03 | 89.22 | NA | 63.05 | NA | 91.27 |
| 49 | 0.81 | NA | 0.24 | 0.24 | 0.14 | 0.21 | 0.32 | 0.53 | 0.41 | NA | NA | 0.37 | 0.77 | 0.08 |
| 50 | 3.24 | NA | 0.48 | 0.67 | 0.43 | 0.50 | 1.28 | 0.93 | 1.49 | NA | NA | 0.68 | 0.89 | 0.21 |
| 51 | 33.67 | NA | 17.66 | 36.25 | 19.60 | 27.88 | 26.18 | 38.74 | 24.47 | NA | NA | 21.93 | 16.47 | 21.90 |
| 52 | 3.68 | NA | 1.78 | 1.51 | 1.59 | 1.50 | 2.55 | 1.90 | 3.19 | NA | NA | 1.92 | 2.70 | 0.97 |
| 53 | 0.02 | NA | 0.01 | 0.01 | 0.01 | 0.01 | 0.01 | 0.01 | 0.02 | NA | NA | 0.02 | 0.05 | 0.00 |
| 54 | 0.23 | NA | 0.55 | 0.38 | 0.35 | 0.42 | 0.24 | 0.48 | 0.21 | NA | NA | 0.59 | 0.82 | 0.51 |
| 55 | 1.06 | 1.56 | 1.17 | 0.67 | 0.67 | 0.71 | 0.87 | 0.58 | 0.98 | 1.91 | 2.80 | 1.34 | 1.53 | 0.88 |
| 56 | 0.13 | 0.23 | 0.21 | 0.11 | 0.11 | 0.13 | 0.16 | 0.12 | 0.18 | 0.34 | 0.57 | 0.29 | 0.44 | 0.18 |
| 57 | 33.35 | 52.77 | 41.10 | 25.80 | 22.52 | 23.54 | 31.90 | 18.93 | 41.96 | 73.71 | 101.16 | 51.45 | 57.70 | 35.07 |
| 58 | 3.19 | 3.85 | 2.78 | 1.98 | 2.15 | 1.57 | 2.19 | 1.68 | 2.42 | 5.52 | 5.17 | 3.34 | 3.63 | 2.05 |
| 59 | 0.45 | 0.57 | 0.53 | 0.39 | 0.27 | 0.37 | NA | 0.37 | 0.58 | 0.97 | 1.10 | 0.71 | 1.04 | 0.44 |
| 60 | 0.56 | 0.29 | NA | 0.68 | 0.59 | 0.67 | 0.67 | NA | 0.76 | 0.25 | NA | 0.50 | NA | 0.33 |
| 61 | 3.44 | NA | 1.39 | 0.67 | 0.58 | 0.61 | 1.97 | 0.73 | 3.47 | NA | NA | 3.10 | 4.38 | 0.35 |
| 62 | 0.10 | 0.12 | NA | 0.09 | 0.08 | 0.08 | 0.08 | NA | 0.10 | 0.12 | NA | 0.13 | NA | 0.10 |
| 63 | 3.57 | NA | 0.44 | 0.65 | 0.39 | 0.49 | 1.34 | 1.10 | 1.96 | NA | NA | 0.64 | 0.94 | 0.16 |

Provided are the values of each of the parameters (as described in Table 58 above) measured in Foxtail millet accessions (lines; "L") under normal growth conditions. Growth conditions are specified in the experimental procedure section.
"NA" = not available.

TABLE 61

Additional measured parameters of correlation IDs in foxtail millet accessions under low N conditions

| Cor. ID Line | L-1 | L-2 | L-3 | L-4 | L-5 | L-6 | L-7 | L-8 | L-9 | L-10 | L-11 | L-12 | L-13 | L-14 |
|---|---|---|---|---|---|---|---|---|---|---|---|---|---|---|
| 1 | NA | 2.03 | 1.86 | 1.60 | 1.59 | 1.97 | NA | 2.26 | 1.43 | 1.76 | NA | 1.81 | NA | 1.94 |
| 2 | NA | 0.86 | NA | 0.81 | 0.77 | 0.93 | NA | NA | 0.80 | 0.58 | NA | 0.98 | NA | 0.98 |
| 3 | 29.85 | 20.46 | 34.44 | 29.75 | 22.31 | 23.02 | 22.59 | 20.66 | 37.09 | 25.39 | 20.97 | 33.96 | 34.85 | 26.22 |
| 4 | 0.86 | 0.89 | 1.39 | 0.96 | 0.84 | 0.81 | 0.65 | 0.78 | 0.77 | 1.14 | 2.24 | 1.08 | 1.16 | 0.87 |
| 5 | 936.40 | 622.80 | 923.60 | 819.50 | 726.80 | 683.50 | 622.80 | 636.50 | 944.00 | 693.60 | 644.80 | 866.40 | 896.00 | 662.50 |
| 6 | NA | 1.97 | 1.84 | 1.20 | 1.64 | 1.23 | NA | 1.91 | 1.92 | 1.71 | NA | 2.10 | NA | 2.13 |
| 7 | NA | 0.89 | NA | 0.52 | 0.83 | 0.59 | NA | NA | 1.00 | 0.95 | NA | 0.97 | NA | 0.94 |
| 8 | 1.60 | 1.01 | 1.38 | 1.42 | 1.14 | 0.89 | 0.97 | 0.98 | 1.52 | 1.48 | 0.99 | 1.15 | 1.28 | 0.98 |
| 9 | 0.25 | 0.16 | 0.22 | 0.26 | 0.15 | 0.18 | 0.19 | 0.17 | 0.31 | 0.28 | 0.15 | 0.27 | 0.30 | 0.23 |
| 10 | 8.20 | 57.00 | 64.60 | 214.00 | 69.20 | 117.75 | 31.80 | 99.20 | 7.00 | 14.60 | 30.80 | 28.80 | 68.20 | 215.25 |
| 11 | 1.14 | 0.61 | 0.74 | 0.72 | 0.61 | 0.96 | 1.07 | 0.77 | 0.64 | 1.11 | 0.57 | 0.88 | 1.13 | 0.67 |
| 12 | 1.18 | 0.81 | 1.17 | 1.06 | 0.88 | 0.77 | 0.76 | 0.78 | 1.14 | 1.07 | 0.80 | 1.01 | 1.09 | 0.82 |
| 13 | 0.18 | 0.16 | 0.18 | 0.23 | 0.17 | 0.19 | 0.14 | 0.18 | 0.24 | 0.21 | 0.12 | 0.24 | 0.26 | 0.17 |
| 14 | 37.59 | 26.53 | 37.22 | 38.71 | 26.98 | 25.86 | 27.61 | 25.30 | 45.06 | 39.26 | 26.08 | 39.72 | 42.38 | 32.67 |
| 15 | 0.90 | 0.90 | 1.23 | 0.93 | 0.78 | 0.80 | 0.66 | 0.79 | 0.74 | 0.98 | 1.78 | 1.03 | 1.13 | 0.87 |
| 16 | 4.27 | 2.60 | 2.80 | 2.53 | 2.60 | 2.28 | 3.57 | 3.00 | 3.40 | 3.83 | 2.90 | 3.07 | 3.37 | 3.20 |
| 17 | NA | NA | NA | NA | NA | NA | NA | NA | NA | NA | NA | NA | NA | NA |
| 18 | 5.90 | 3.45 | 3.20 | 3.50 | 3.95 | 4.15 | 4.90 | 5.00 | 3.95 | 4.45 | 3.55 | 3.75 | 3.80 | 3.35 |
| 19 | 6.50 | 3.65 | 3.15 | 3.90 | 3.75 | 5.05 | 6.15 | 5.20 | 4.75 | 5.15 | 3.20 | 3.65 | 4.30 | 3.30 |
| 20 | 0.82 | 0.78 | 0.70 | 0.74 | 0.57 | 0.80 | 0.80 | 0.74 | 0.71 | 0.87 | 0.67 | 0.70 | 0.83 | 0.36 |
| 21 | NA | NA | NA | 26.30 | 27.09 | 27.81 | 27.65 | 27.92 | NA | NA | NA | NA | NA | 27.18 |
| 22 | 30.83 | NA | NA | NA | NA | NA | NA | NA | 30.61 | NA | NA | NA | NA | NA |
| 23 | 0.99 | NA | 0.30 | 0.18 | 0.14 | 0.25 | 0.55 | 0.16 | 0.96 | NA | NA | 0.48 | 0.94 | 0.08 |
| 24 | 3.57 | NA | 1.50 | 0.68 | 0.54 | 0.94 | 1.93 | 0.54 | 2.98 | NA | NA | 3.93 | 4.39 | 0.30 |
| 25 | 6.81 | NA | 10.46 | 8.34 | 6.76 | 7.46 | 6.44 | 7.16 | 8.50 | NA | NA | 9.94 | 11.84 | 8.67 |
| 26 | 6.85 | NA | 3.89 | 2.96 | 3.19 | 3.18 | 5.08 | 3.11 | 6.43 | NA | NA | 6.52 | 6.08 | 2.13 |
| 27 | 0.15 | NA | 0.03 | 0.02 | 0.02 | 0.03 | 0.09 | 0.02 | 0.11 | NA | NA | 0.05 | 0.08 | 0.01 |
| 28 | 1.72 | NA | 0.96 | 1.21 | 0.93 | 1.28 | 1.14 | 0.96 | 1.19 | NA | NA | 0.89 | 1.04 | 0.96 |
| 29 | 0.40 | NA | 0.24 | 0.31 | 0.26 | 0.42 | 0.42 | 0.30 | 0.35 | NA | NA | 0.14 | 0.27 | 0.26 |
| 30 | 1.92 | NA | 1.09 | 1.35 | 1.01 | 1.28 | 1.38 | 1.30 | 1.39 | NA | NA | 0.81 | 1.28 | 1.06 |
| 31 | 29.85 | 20.46 | 34.44 | 29.75 | 22.31 | 23.02 | 22.59 | 20.66 | 37.09 | 25.39 | 20.97 | 33.96 | 34.85 | 26.22 |
| 32 | 16.34 | 16.90 | 26.34 | 18.19 | 15.91 | 15.45 | 12.29 | 14.87 | 14.57 | 21.58 | 42.49 | 20.47 | 22.00 | 16.62 |
| 33 | NA | 0.89 | 0.93 | 0.92 | 0.93 | 0.94 | NA | 0.95 | 0.93 | 0.86 | NA | 0.93 | NA | 0.90 |

TABLE 61-continued

Additional measured parameters of correlation IDs in foxtail millet accessions under low N conditions

| Cor. ID Line | L-1 | L-2 | L-3 | L-4 | L-5 | L-6 | L-7 | L-8 | L-9 | L-10 | L-11 | L-12 | L-13 | L-14 |
|---|---|---|---|---|---|---|---|---|---|---|---|---|---|---|
| 34 | NA | 1.03 | NA | 0.99 | 1.01 | 1.00 | NA | NA | 0.99 | 0.97 | NA | 1.03 | NA | 1.04 |
| 35 | NA | 464.77 | 688.20 | 516.07 | 380.02 | 484.90 | NA | 493.50 | 572.76 | 517.93 | 0.00 | 661.86 | NA | 565.17 |
| 36 | NA | 14.15 | NA | 14.87 | 12.10 | 14.30 | NA | NA | 11.71 | 12.76 | NA | 19.45 | NA | 15.74 |
| 37 | 54.00 | 64.00 | 58.60 | 40.40 | 46.00 | 41.60 | 51.60 | 39.00 | 55.40 | 72.40 | 61.00 | 62.20 | 62.40 | 42.80 |
| 38 | 1.00 | 1.01 | 0.99 | 1.02 | 1.00 | 1.02 | 1.03 | 1.00 | 1.03 | 1.02 | 1.00 | 0.99 | 1.02 | 1.02 |
| 39 | 90.00 | 90.00 | 90.00 | NA | 75.00 | NA | NA | 75.00 | 90.00 | 98.00 | 109.00 | 98.00 | 98.00 | NA |
| 40 | NA | NA | NA | NA | NA | NA | NA | NA | NA | NA | NA | NA | NA | NA |
| 41 | NA | NA | NA | NA | NA | NA | NA | NA | NA | NA | NA | NA | NA | NA |
| 42 | 1.64 | 1.00 | 1.01 | 1.81 | 1.50 | 1.88 | 1.38 | 2.10 | 1.47 | 0.84 | 0.83 | 1.10 | 1.18 | 1.25 |
| 43 | 0.78 | 0.70 | 0.77 | 0.86 | 0.77 | 0.77 | 0.75 | 0.82 | 0.77 | 0.87 | 0.72 | 0.82 | 0.79 | 0.59 |
| 44 | 4.21 | 3.76 | 3.72 | 3.87 | 4.27 | 4.19 | 3.43 | 3.72 | 4.66 | 3.11 | 3.57 | 4.01 | 3.75 | 3.48 |
| 45 | NA | NA | NA | NA | NA | NA | NA | NA | NA | NA | NA | NA | NA | NA |
| 46 | 22.50 | 13.98 | 16.20 | 23.93 | 20.95 | 25.05 | 17.78 | 24.19 | 20.66 | 15.06 | 14.03 | 17.68 | 17.45 | 19.18 |
| 47 | 37.08 | 24.13 | 23.55 | 40.30 | 34.33 | 41.91 | 31.38 | 47.50 | 32.75 | 18.23 | 19.80 | 25.63 | 27.18 | 27.95 |
| 48 | 0.81 | 0.76 | 0.87 | 0.79 | 0.80 | 0.78 | 0.77 | 0.85 | 0.78 | 0.89 | 0.77 | 0.85 | 0.82 | 0.59 |
| 49 | 31.40 | 31.00 | 28.60 | 27.50 | 32.40 | 30.00 | 28.20 | 30.80 | 25.20 | 27.60 | 30.60 | 26.80 | 26.60 | 25.50 |
| 50 | 2.21 | 3.42 | 3.31 | 2.21 | 2.83 | 3.79 | 1.75 | 2.18 | 2.52 | 2.71 | 2.37 | 2.63 | 4.09 | 3.44 |
| 51 | 0.77 | 1.10 | 0.65 | 0.51 | 0.98 | 1.22 | 0.60 | 0.64 | 0.53 | 0.86 | 0.70 | 0.84 | 2.01 | 0.76 |
| 52 | NA | NA | NA | NA | NA | NA | NA | NA | NA | NA | NA | NA | NA | NA |
| 53 | NA | NA | NA | NA | NA | NA | NA | NA | NA | NA | NA | NA | NA | NA |
| 54 | 58.57 | 35.92 | 39.05 | 48.28 | 40.65 | 52.33 | 59.10 | 52.22 | 52.85 | 43.76 | 36.61 | 38.74 | 46.16 | 45.38 |
| 55 | 0.96 | NA | NA | 0.88 | 0.81 | 0.91 | 1.01 | 0.95 | 0.95 | NA | NA | NA | NA | 0.81 |
| 56 | 57.92 | 35.92 | 39.05 | 48.28 | 40.65 | 52.33 | 59.10 | 52.85 | 52.32 | 43.76 | 36.61 | 38.74 | 46.16 | 45.38 |
| 57 | 60.61 | NA | NA | NA | NA | NA | NA | NA | 52.50 | NA | NA | NA | NA | NA |
| 58 | NA | 38.88 | 37.86 | 38.46 | 37.79 | 32.51 | NA | 38.37 | 36.93 | 38.18 | NA | 37.44 | NA | 39.40 |
| 59 | 11.04 | 8.18 | 9.42 | 14.44 | 13.46 | 14.92 | 8.04 | 12.85 | 7.88 | 5.62 | 9.90 | 8.69 | 7.61 | 12.70 |
| 60 | 54.66 | 53.94 | 70.22 | 67.83 | 76.02 | 85.68 | 48.28 | 64.02 | 54.78 | 47.98 | 34.78 | 40.28 | 61.96 | 92.38 |
| 61 | 67.28 | 101.45 | 95.21 | 66.74 | 84.32 | 100.27 | 55.05 | 65.93 | 74.17 | 69.47 | 76.90 | 81.10 | 118.81 | 94.59 |
| 62 | 0.76 | 1.04 | 0.59 | 0.49 | 0.84 | 0.97 | 0.57 | 0.56 | 0.52 | 0.71 | 0.66 | 0.79 | 1.63 | 0.66 |
| 63 | NA | 1.38 | 1.28 | 1.86 | 1.68 | 1.61 | NA | 1.73 | 1.47 | 1.20 | NA | 1.05 | NA | 1.96 |
| 64 | NA | 0.90 | NA | 1.05 | 0.85 | 0.90 | NA | NA | 0.97 | 0.99 | NA | 0.85 | NA | 0.75 |
| 65 | NA | NA | NA | NA | NA | NA | NA | NA | NA | NA | NA | NA | NA | NA |
| 66 | 1.05 | 10.95 | 12.35 | 22.60 | 14.00 | 10.60 | 1.60 | 8.45 | 1.20 | 2.20 | 7.80 | 4.90 | 7.56 | 26.95 |
| 67 | 1.30 | 9.10 | 8.25 | 17.00 | 8.10 | 12.25 | 2.20 | 5.40 | 1.90 | 3.30 | 6.11 | 4.00 | 8.60 | 20.63 |
| 68 | 0.93 | 0.88 | 1.09 | 1.59 | 1.27 | 1.33 | 0.99 | 1.16 | 0.70 | 0.94 | 0.94 | 0.69 | 1.26 | 1.24 |
| 69 | NA | 415.32 | 640.96 | 475.71 | 353.87 | 453.77 | NA | 466.84 | 529.91 | 446.46 | NA | 614.57 | NA | 508.79 |
| 70 | NA | 0.76 | NA | 0.78 | 0.64 | 0.75 | NA | NA | 0.61 | 0.65 | NA | 1.05 | NA | 0.86 |
| 71 | NA | 49.45 | 47.24 | 40.36 | 26.15 | 31.13 | NA | 26.66 | 42.84 | 71.47 | NA | 47.29 | NA | 56.38 |
| 72 | NA | 0.61 | NA | 0.88 | 0.58 | 0.74 | NA | NA | 0.67 | 0.80 | NA | 0.75 | NA | 0.62 |
| 73 | 0.75 | NA | 0.31 | 0.18 | 0.18 | 0.25 | 0.51 | 0.34 | 0.51 | NA | NA | 0.68 | 0.76 | 0.09 |
| 74 | 2.65 | NA | 0.59 | 0.54 | 0.49 | 0.55 | 1.57 | 0.72 | 1.53 | NA | NA | 0.90 | 1.34 | 0.20 |
| 75 | 29.08 | NA | 20.07 | 34.93 | 26.95 | 32.65 | 28.31 | 38.64 | 22.29 | NA | NA | 27.17 | 18.07 | 26.91 |
| 76 | 3.29 | NA | 1.71 | 1.34 | 1.53 | 1.54 | 2.58 | 1.72 | 2.82 | NA | NA | 2.00 | 2.57 | 0.90 |
| 77 | 0.03 | NA | 0.02 | 0.01 | 0.01 | 0.01 | 0.02 | 0.01 | 0.02 | NA | NA | 0.03 | 0.04 | 0.00 |
| 78 | 1.08 | NA | 1.14 | 0.77 | 0.97 | 1.04 | 1.47 | 0.64 | 1.35 | NA | NA | 1.48 | 0.90 | 0.87 |
| 79 | 0.30 | NA | 0.68 | 0.37 | 0.37 | 0.42 | 0.35 | 0.38 | 0.36 | NA | NA | 0.80 | 0.81 | 0.52 |
| 80 | 1.35 | NA | 1.23 | 0.99 | 1.06 | 0.99 | 1.44 | 0.78 | 1.73 | NA | NA | 1.37 | 0.99 | 1.01 |
| 81 | 0.97 | 1.11 | 1.14 | 0.59 | 0.51 | 0.58 | 0.56 | 0.47 | 0.74 | 1.74 | 2.39 | 1.17 | 1.53 | 0.74 |
| 82 | 0.13 | 0.16 | 0.18 | 0.11 | 0.08 | 0.12 | 0.11 | 0.08 | 0.13 | 0.33 | 0.35 | 0.28 | 0.38 | 0.13 |
| 83 | 30.75 | 35.92 | 36.87 | 21.66 | 15.54 | 19.35 | 20.21 | 15.38 | 29.06 | 59.54 | 76.55 | 45.18 | 59.12 | 28.72 |
| 84 | 0.92 | 0.68 | 0.90 | 0.84 | 0.69 | 0.82 | 0.63 | 0.81 | 0.69 | 0.81 | 0.76 | 0.88 | 1.02 | 0.82 |
| 85 | 3.03 | 2.55 | 2.86 | 2.22 | 1.97 | 1.21 | 1.37 | 1.35 | 1.99 | 4.55 | 4.37 | 2.75 | 2.67 | 1.43 |
| 86 | 0.39 | 0.36 | 0.44 | 0.38 | 0.19 | 0.32 | NA | 0.24 | 0.43 | 0.87 | 0.64 | 0.65 | 0.80 | 0.33 |
| 87 | NA | 0.41 | 0.73 | 0.74 | 0.85 | 0.74 | NA | 0.77 | 0.87 | 0.36 | NA | 0.72 | NA | 0.47 |
| 88 | NA | 1.45 | NA | 1.09 | 1.43 | 1.10 | NA | NA | 1.15 | 1.42 | NA | 1.44 | NA | 1.42 |
| 89 | 2.51 | NA | 1.24 | 0.57 | 0.54 | 0.59 | 1.30 | 0.54 | 2.76 | NA | NA | 3.31 | 3.44 | 0.31 |
| 90 | 0.73 | NA | 0.89 | 0.86 | 0.93 | 0.98 | 0.66 | 0.74 | 0.80 | NA | NA | 1.07 | 0.78 | 0.88 |
| 91 | NA | 28.24 | 29.55 | 20.64 | 22.45 | 20.20 | NA | 22.14 | 25.05 | 31.81 | NA | 35.77 | NA | 20.08 |
| 92 | NA | 1.02 | NA | 0.90 | 1.14 | 11.0 | NA | NA | 1.00 | 1.00 | NA | 1.16 | NA | 1.28 |
| 93 | NA | 0.12 | 0.10 | 0.10 | 0.10 | 0.09 | NA | 0.07 | 0.12 | 0.16 | NA | 0.12 | NA | 0.10 |
| 94 | NA | 1.00 | NA | 1.16 | 1.21 | 1.09 | NA | NA | 1.19 | 1.32 | NA | 0.93 | NA | 1.02 |
| 95 | 2.46 | NA | 0.46 | 0.49 | 0.49 | 0.60 | 1.48 | 0.89 | 1.39 | NA | NA | 0.85 | 0.94 | 0.17 |
| 96 | 0.69 | NA | 1.05 | 0.75 | 1.26 | 1.23 | 1.11 | 0.81 | 0.71 | NA | NA | 1.34 | 1.00 | 1.06 |

Provided are the values of each of the parameters (as described in Table 59 above) measured in Foxtail millet accessions (lines; "L") under low N conditions. Growth conditions are specified in the experimental procedure section.
"NA" = not available.

TABLE 62

Correlation between the expression level of selected genes of some embodiments of the invention in various tissues and the phenotypic performance under low nitrogen fertilization conditions across foxtail millet accessions

| Gene Name | R | P value | Exp. set | Cor. Set ID | Gene Name | R | P value | Exp. set | Cor. Set ID |
|---|---|---|---|---|---|---|---|---|---|
| WNU1 | 0.938 | 1.77E−03 | 3 | 34 | WNU1 | 0.742 | 1.40E−02 | 3 | 4 |
| WNU1 | 0.731 | 6.20E−02 | 3 | 2 | WNU1 | 0.841 | 4.46E−03 | 3 | 25 |
| WNU1 | 0.701 | 7.91E−02 | 3 | 92 | WNU1 | 0.893 | 4.72E−03 | 3 | 79 |
| WNU1 | 0.765 | 4.53E−02 | 3 | 36 | WNU1 | 0.762 | 1.04E−02 | 3 | 15 |
| WNU1 | 0.812 | 2.66E−02 | 3 | 70 | WNU1 | 0.747 | 5.35E−02 | 3 | 88 |
| WNU1 | 0.765 | 1.64E−02 | 3 | 71 | WNU1 | 0.742 | 1.40E−02 | 3 | 32 |
| WNU1 | 0.772 | 2.48E−02 | 8 | 91 | WNU1 | 0.744 | 3.43E−02 | 8 | 93 |
| WNU1 | 0.707 | 2.23E−02 | 9 | 81 | WNU1 | 0.721 | 1.86E−02 | 9 | 83 |
| WNU1 | 0.893 | 1.20E−03 | 9 | 71 | WNU1 | 0.731 | 6.18E−02 | 9 | 39 |
| WNU1 | 0.816 | 7.31E−03 | 1 | 90 | WNU1 | 0.865 | 2.63E−03 | 1 | 79 |
| WNU1 | 0.759 | 4.80E−02 | 1 | 36 | WNU1 | 0.747 | 5.39E−02 | 1 | 70 |
| WNU1 | 0.718 | 2.95E−02 | 1 | 96 | WNU1 | 0.729 | 2.57E−02 | 1 | 91 |
| WNU1 | 0.864 | 5.61E−03 | 4 | 90 | WNU1 | 0.820 | 1.27E−02 | 4 | 79 |
| WNU1 | 0.840 | 9.07E−03 | 4 | 96 | WNU1 | 0.726 | 4.14E−02 | 4 | 88 |
| WNU53 | 0.771 | 4.25E−02 | 3 | 34 | WNU53 | 0.770 | 4.29E−02 | 3 | 7 |
| WNU53 | 0.729 | 6.29E−02 | 3 | 2 | WNU53 | 0.711 | 3.18E−02 | 3 | 6 |
| WNU53 | 0.705 | 2.26E−02 | 3 | 82 | WNU53 | 0.858 | 3.08E−03 | 3 | 79 |
| WNU53 | 0.775 | 4.08E−02 | 3 | 36 | WNU53 | 0.806 | 2.85E−02 | 3 | 70 |
| WNU53 | 0.753 | 1.93E−02 | 3 | 91 | WNU53 | 0.709 | 7.43E−02 | 8 | 25 |
| WNU53 | 0.724 | 1.04E−01 | 8 | 92 | WNU53 | 0.702 | 3.49E−02 | 8 | 60 |
| WNU53 | 0.760 | 1.74E−02 | 8 | 15 | WNU53 | 0.869 | 5.11E−03 | 8 | 63 |
| WNU53 | 0.741 | 3.53E−02 | 8 | 91 | WNU53 | 0.746 | 2.10E−02 | 8 | 66 |
| WNU53 | 0.706 | 3.36E−02 | 9 | 73 | WNU53 | 0.765 | 9.96E−03 | 9 | 16 |
| WNU53 | 0.854 | 3.35E−03 | 9 | 76 | WNU53 | 0.754 | 1.17E−02 | 9 | 18 |
| WNU53 | 0.884 | 1.55E−03 | 9 | 95 | WNU53 | 0.782 | 1.27E−02 | 9 | 23 |
| WNU53 | 0.701 | 3.53E−02 | 9 | 26 | WNU53 | 0.859 | 3.03E−03 | 9 | 27 |
| WNU53 | 0.753 | 1.19E−02 | 9 | 19 | WNU53 | 0.881 | 1.69E−03 | 9 | 74 |
| WNU53 | 0.949 | 2.73E−05 | 1 | 4 | WNU53 | 0.850 | 3.71E−03 | 1 | 25 |
| WNU53 | 0.848 | 3.90E−03 | 1 | 79 | WNU53 | 0.927 | 1.16E−04 | 1 | 15 |
| WNU53 | 0.949 | 2.73E−05 | 1 | 32 | WNU53 | 0.791 | 1.12E−02 | 1 | 91 |
| WNU53 | 0.743 | 2.19E−02 | 1 | 69 | WNU53 | 0.768 | 1.56E−02 | 1 | 35 |
| WNU53 | 0.760 | 1.07E−02 | 4 | 4 | WNU53 | 0.878 | 4.14E−03 | 4 | 25 |
| WNU53 | 0.924 | 1.04E−03 | 4 | 79 | WNU53 | 0.808 | 1.52E−02 | 4 | 36 |
| WNU53 | 0.861 | 1.39E−03 | 4 | 15 | WNU53 | 0.778 | 7.99E−03 | 4 | 42 |
| WNU53 | 0.818 | 1.30E−02 | 4 | 70 | WNU53 | 0.776 | 8.34E−03 | 4 | 47 |
| WNU53 | 0.760 | 1.07E−02 | 4 | 32 | WNU53 | 0.873 | 4.69E−03 | 4 | 75 |
| WNU53 | 0.772 | 8.95E−03 | 4 | 46 | WNU53 | 0.862 | 1.26E−02 | 2 | 34 |
| WNU53 | 0.816 | 2.52E−02 | 2 | 2 | WNU53 | 0.862 | 2.79E−03 | 2 | 25 |
| WNU53 | 0.915 | 5.53E−04 | 2 | 79 | WNU53 | 0.864 | 1.22E−02 | 2 | 36 |
| WNU53 | 0.895 | 6.42E−03 | 2 | 70 | WNU53 | 0.865 | 2.61E−03 | 2 | 69 |
| WNU53 | 0.831 | 5.50E−03 | 2 | 35 | WNU54 | 0.711 | 2.11E−02 | 3 | 38 |
| WNU54 | 0.787 | 1.19E−02 | 3 | 75 | WNU54 | 0.835 | 1.94E−02 | 3 | 72 |
| WNU54 | 0.778 | 3.92E−02 | 8 | 73 | WNU54 | 0.718 | 6.92E−02 | 8 | 76 |
| WNU54 | 0.725 | 6.51E−02 | 8 | 28 | WNU54 | 0.776 | 1.39E−02 | 8 | 20 |
| WNU54 | 0.887 | 7.75E−03 | 8 | 30 | WNU54 | 0.772 | 4.20E−02 | 8 | 95 |
| WNU54 | 0.704 | 3.42E−02 | 8 | 86 | WNU54 | 0.838 | 3.74E−02 | 8 | 64 |
| WNU54 | 0.896 | 1.56E−02 | 8 | 55 | WNU54 | 0.748 | 2.04E−02 | 8 | 11 |
| WNU54 | 0.749 | 5.25E−02 | 8 | 74 | WNU54 | 0.811 | 5.03E−02 | 8 | 72 |
| WNU54 | 0.768 | 7.45E−02 | 8 | 39 | WNU54 | 0.831 | 2.92E−03 | 9 | 67 |
| WNU54 | 0.883 | 7.04E−04 | 9 | 10 | WNU54 | 0.766 | 9.86E−03 | 9 | 60 |
| WNU54 | 0.921 | 4.16E−04 | 9 | 63 | WNU54 | 0.878 | 8.46E−04 | 9 | 66 |
| WNU54 | 0.711 | 3.16E−02 | 1 | 73 | WNU54 | 0.773 | 8.69E−03 | 1 | 16 |
| WNU54 | 0.862 | 2.77E−03 | 1 | 76 | WNU54 | 0.815 | 7.39E−03 | 1 | 28 |
| WNU54 | 0.713 | 2.07E−02 | 1 | 12 | WNU54 | 0.763 | 1.02E−02 | 1 | 8 |
| WNU54 | 0.821 | 6.65E−03 | 1 | 30 | WNU54 | 0.884 | 1.57E−03 | 1 | 95 |
| WNU54 | 0.873 | 2.14E−03 | 1 | 23 | WNU54 | 0.720 | 2.86E−02 | 1 | 77 |
| WNU54 | 0.762 | 1.71E−02 | 1 | 26 | WNU54 | 0.913 | 5.89E−04 | 1 | 27 |
| WNU54 | 0.928 | 3.08E−04 | 1 | 74 | WNU54 | 0.718 | 1.95E−02 | 1 | 5 |
| WNU54 | 0.912 | 1.62E−03 | 4 | 25 | WNU54 | 0.938 | 5.77E−04 | 4 | 79 |
| WNU54 | 0.750 | 3.21E−02 | 4 | 36 | WNU54 | 0.726 | 1.75E−02 | 4 | 15 |
| WNU54 | 0.769 | 2.57E−02 | 4 | 70 | WNU54 | 0.803 | 5.16E−03 | 2 | 9 |
| WNU54 | 0.772 | 1.47E−02 | 2 | 76 | WNU54 | 0.779 | 1.34E−02 | 2 | 89 |
| WNU54 | 0.719 | 1.92E−02 | 2 | 14 | WNU54 | 0.731 | 1.63E−02 | 2 | 37 |
| WNU54 | 0.834 | 5.20E−03 | 2 | 23 | WNU54 | 0.748 | 2.05E−02 | 2 | 77 |
| WNU54 | 0.864 | 2.70E−03 | 2 | 80 | WNU54 | 0.733 | 2.48E−02 | 2 | 24 |
| WNU54 | 0.816 | 7.33E−03 | 2 | 26 | WNU54 | 0.755 | 1.86E−02 | 2 | 78 |
| WNU54 | 0.749 | 2.03E−02 | 2 | 27 | WNU54 | 0.739 | 2.30E−02 | 2 | 93 |
| WNU55 | 0.898 | 6.05E−03 | 3 | 34 | WNU55 | 0.757 | 1.13E−02 | 3 | 62 |
| WNU55 | 0.801 | 3.03E−02 | 3 | 88 | WNU55 | 0.918 | 4.85E−04 | 8 | 81 |
| WNU55 | 0.842 | 3.53E−02 | 8 | 7 | WNU55 | 0.882 | 1.66E−03 | 8 | 85 |
| WNU55 | 0.876 | 1.97E−03 | 8 | 83 | WNU55 | 0.940 | 1.63E−04 | 8 | 37 |
| WNU55 | 0.753 | 1.93E−02 | 8 | 4 | WNU55 | 0.822 | 6.53E−03 | 8 | 82 |
| WNU55 | 0.737 | 2.34E−02 | 8 | 86 | WNU55 | 0.732 | 2.49E−02 | 8 | 15 |

TABLE 62-continued

Correlation between the expression level of selected genes of some embodiments of the invention in various tissues and the phenotypic performance under low nitrogen fertilization conditions across foxtail millet accessions

| Gene Name | R | P value | Exp. set | Cor. Set ID | Gene Name | R | P value | Exp. set | Cor. Set ID |
| --- | --- | --- | --- | --- | --- | --- | --- | --- | --- |
| WNU55 | 0.830 | 4.08E−02 | 8 | 88 | WNU55 | 0.730 | 3.97E−02 | 8 | 71 |
| WNU55 | 0.753 | 1.93E−02 | 8 | 32 | WNU55 | 0.985 | 7.96E−06 | 8 | 91 |
| WNU55 | 0.839 | 9.18E−03 | 8 | 93 | WNU55 | 0.926 | 7.98E−03 | 8 | 39 |
| WNU55 | 0.801 | 5.35E−03 | 9 | 81 | WNU55 | 0.788 | 6.79E−03 | 9 | 85 |
| WNU55 | 0.741 | 1.43E−02 | 9 | 83 | WNU55 | 0.720 | 1.89E−02 | 9 | 86 |
| WNU55 | 0.742 | 2.21E−02 | 9 | 71 | WNU55 | 0.790 | 1.12E−02 | 9 | 93 |
| WNU55 | 0.845 | 2.08E−03 | 1 | 81 | WNU55 | 0.889 | 5.74E−04 | 1 | 83 |
| WNU55 | 0.821 | 3.59E−03 | 1 | 37 | WNU55 | 0.751 | 1.24E−02 | 1 | 4 |
| WNU55 | 0.850 | 3.70E−03 | 1 | 25 | WNU55 | 0.945 | 3.82E−05 | 1 | 82 |
| WNU55 | 0.942 | 1.44E−04 | 1 | 79 | WNU55 | 0.872 | 9.90E−04 | 1 | 86 |
| WNU55 | 0.723 | 1.81E−02 | 1 | 15 | WNU55 | 0.726 | 2.67E−02 | 1 | 71 |
| WNU55 | 0.751 | 1.24E−02 | 1 | 32 | WNU55 | 0.942 | 1.44E−04 | 1 | 91 |
| WNU55 | 0.744 | 2.14E−02 | 1 | 93 | WNU55 | 0.770 | 4.30E−02 | 1 | 39 |
| WNU55 | 0.768 | 9.42E−03 | 4 | 37 | WNU55 | 0.714 | 4.68E−02 | 4 | 25 |
| WNU55 | 0.759 | 1.09E−02 | 4 | 91 | WNU55 | 0.740 | 1.44E−02 | 2 | 67 |
| WNU55 | 0.746 | 1.33E−02 | 2 | 10 | WNU55 | 0.909 | 6.77E−04 | 2 | 1 |
| WNU55 | 0.766 | 9.77E−03 | 2 | 66 | WNU56 | 0.701 | 7.94E−02 | 3 | 36 |
| WNU56 | 0.701 | 7.95E−02 | 3 | 70 | WNU56 | 0.706 | 2.25E−02 | 3 | 19 |
| WNU56 | 0.779 | 3.88E−02 | 8 | 73 | WNU56 | 0.727 | 6.40E−02 | 8 | 76 |
| WNU56 | 0.752 | 1.94E−02 | 8 | 56 | WNU56 | 0.806 | 8.67E−03 | 8 | 18 |
| WNU56 | 0.701 | 7.95E−02 | 8 | 30 | WNU56 | 0.790 | 3.46E−02 | 8 | 95 |
| WNU56 | 0.813 | 4.93E−02 | 8 | 2 | WNU56 | 0.710 | 4.83E−02 | 8 | 1 |
| WNU56 | 0.759 | 2.90E−02 | 8 | 33 | WNU56 | 0.717 | 2.96E−02 | 8 | 42 |
| WNU56 | 0.773 | 7.16E−02 | 8 | 55 | WNU56 | 0.758 | 1.80E−02 | 8 | 54 |
| WNU56 | 0.743 | 2.17E−02 | 8 | 47 | WNU56 | 0.701 | 7.93E−02 | 8 | 27 |
| WNU56 | 0.723 | 6.63E−02 | 8 | 74 | WNU56 | 0.705 | 3.39E−02 | 8 | 49 |
| WNU56 | 0.750 | 5.23E−02 | 9 | 34 | WNU56 | 0.882 | 8.57E−03 | 9 | 2 |
| WNU56 | 0.717 | 2.96E−02 | 9 | 77 | WNU56 | 0.732 | 2.49E−02 | 9 | 79 |
| WNU56 | 0.862 | 1.26E−02 | 9 | 36 | WNU56 | 0.745 | 2.12E−02 | 9 | 1 |
| WNU56 | 0.867 | 1.16E−02 | 9 | 70 | WNU56 | 0.848 | 1.58E−02 | 9 | 55 |
| WNU56 | 0.800 | 9.68E−03 | 9 | 69 | WNU56 | 0.726 | 2.68E−02 | 9 | 35 |
| WNU56 | 0.770 | 4.28E−02 | 1 | 2 | WNU56 | 0.803 | 5.15E−03 | 1 | 42 |
| WNU56 | 0.799 | 5.55E−03 | 1 | 47 | WNU56 | 0.755 | 1.16E−02 | 1 | 59 |
| WNU56 | 0.749 | 2.02E−02 | 1 | 75 | WNU56 | 0.794 | 6.09E−03 | 1 | 46 |
| WNU56 | 0.715 | 2.01E−02 | 4 | 56 | WNU56 | 0.757 | 1.12E−02 | 4 | 42 |
| WNU56 | 0.716 | 1.98E−02 | 4 | 54 | WNU56 | 0.747 | 1.30E−02 | 4 | 47 |
| WNU56 | 0.792 | 1.92E−02 | 4 | 75 | WNU56 | 0.776 | 8.35E−03 | 4 | 46 |
| WNU56 | 0.770 | 4.28E−02 | 2 | 2 | WNU56 | 0.817 | 7.15E−03 | 2 | 1 |
| WNU56 | 0.738 | 2.31E−02 | 2 | 75 | WNU57 | 0.799 | 3.10E−02 | 3 | 94 |
| WNU57 | 0.812 | 7.89E−03 | 8 | 42 | WNU57 | 0.807 | 8.56E−03 | 8 | 47 |
| WNU57 | 0.724 | 4.23E−02 | 8 | 63 | WNU57 | 0.736 | 2.39E−02 | 8 | 59 |
| WNU57 | 0.805 | 2.90E−02 | 8 | 75 | WNU57 | 0.745 | 2.14E−02 | 8 | 46 |
| WNU57 | 0.824 | 3.36E−03 | 9 | 67 | WNU57 | 0.889 | 5.87E−04 | 9 | 10 |
| WNU57 | 0.755 | 1.16E−02 | 9 | 60 | WNU57 | 0.901 | 9.13E−04 | 9 | 63 |
| WNU57 | 0.720 | 1.87E−02 | 9 | 59 | WNU57 | 0.797 | 5.76E−03 | 9 | 66 |
| WNU57 | 0.772 | 1.49E−02 | 1 | 96 | WNU57 | 0.709 | 7.45E−02 | 2 | 36 |
| WNU57 | 0.729 | 2.60E−02 | 2 | 69 | WNU58 | 0.711 | 1.13E−01 | 8 | 34 |
| WNU58 | 0.739 | 5.76E−02 | 8 | 90 | WNU58 | 0.856 | 1.40E−02 | 8 | 25 |
| WNU58 | 0.807 | 2.84E−02 | 8 | 79 | WNU58 | 0.796 | 1.03E−02 | 8 | 61 |
| WNU58 | 0.713 | 2.06E−02 | 9 | 67 | WNU58 | 0.767 | 9.66E−03 | 9 | 10 |
| WNU58 | 0.810 | 2.73E−02 | 9 | 2 | WNU58 | 0.719 | 1.92E−02 | 9 | 66 |
| WNU58 | 0.711 | 2.11E−02 | 1 | 10 | WNU58 | 0.717 | 2.97E−02 | 1 | 63 |
| WNU58 | 0.711 | 4.81E−02 | 4 | 90 | WNU58 | 0.840 | 9.03E−03 | 4 | 79 |
| WNU58 | 0.740 | 3.60E−02 | 4 | 88 | WNU58 | 0.768 | 9.42E−03 | 4 | 91 |
| WNU60 | 0.706 | 2.26E−02 | 1 | 10 | WNU60 | 0.918 | 1.76E−04 | 1 | 68 |
| WNU60 | 0.857 | 1.55E−03 | 1 | 59 | WNU60 | 0.726 | 1.74E−02 | 1 | 46 |
| WNU60 | 0.724 | 1.79E−02 | 4 | 42 | WNU60 | 0.727 | 1.73E−02 | 4 | 47 |
| WNU60 | 0.764 | 2.72E−02 | 4 | 75 | WNU60 | 0.714 | 2.03E−02 | 4 | 46 |
| WNU60 | 0.745 | 1.35E−02 | 2 | 82 | WNU60 | 0.721 | 1.86E−02 | 2 | 86 |
| WNU60 | 0.801 | 9.50E−03 | 2 | 91 | WNU61 | 0.762 | 1.04E−02 | 3 | 67 |
| WNU61 | 0.879 | 9.15E−03 | 3 | 34 | WNU61 | 0.723 | 1.81E−02 | 3 | 10 |
| WNU61 | 0.790 | 3.44E−02 | 3 | 2 | WNU61 | 0.872 | 1.04E−02 | 3 | 36 |
| WNU61 | 0.900 | 5.69E−03 | 3 | 70 | WNU61 | 0.801 | 5.55E−02 | 8 | 94 |
| WNU61 | 0.738 | 9.38E−02 | 8 | 2 | WNU61 | 0.746 | 2.09E−02 | 8 | 48 |
| WNU61 | 0.890 | 3.09E−03 | 8 | 33 | WNU61 | 0.730 | 9.95E−02 | 8 | 64 |
| WNU61 | 0.714 | 3.08E−02 | 8 | 43 | WNU61 | 0.735 | 3.78E−02 | 8 | 87 |
| WNU61 | 0.700 | 5.31E−02 | 8 | 91 | WNU61 | 0.929 | 1.03E−04 | 9 | 81 |
| WNU61 | 0.746 | 5.41E−02 | 9 | 7 | WNU61 | 0.813 | 4.21E−03 | 9 | 85 |
| WNU61 | 0.922 | 1.49E−04 | 9 | 83 | WNU61 | 0.825 | 3.27E−03 | 9 | 37 |
| WNU61 | 0.755 | 1.16E−02 | 9 | 4 | WNU61 | 0.734 | 2.43E−02 | 9 | 25 |
| WNU61 | 0.904 | 3.31E−04 | 9 | 82 | WNU61 | 0.845 | 4.14E−03 | 9 | 79 |
| WNU61 | 0.831 | 2.88E−03 | 9 | 86 | WNU61 | 0.716 | 1.98E−02 | 9 | 15 |
| WNU61 | 0.866 | 1.17E−02 | 9 | 88 | WNU61 | 0.866 | 2.54E−03 | 9 | 71 |

TABLE 62-continued

Correlation between the expression level of selected genes of some embodiments of the invention in various tissues and the phenotypic performance under low nitrogen fertilization conditions across foxtail millet accessions

| Gene Name | R | P value | Exp. set | Cor. Set ID | Gene Name | R | P value | Exp. set | Cor. Set ID |
|---|---|---|---|---|---|---|---|---|---|
| WNU61 | 0.755 | 1.16E−02 | 9 | 32 | WNU61 | 0.778 | 1.35E−02 | 9 | 91 |
| WNU61 | 0.785 | 1.22E−02 | 9 | 93 | WNU61 | 0.779 | 3.89E−02 | 9 | 39 |
| WNU61 | 0.852 | 1.48E−02 | 1 | 34 | WNU61 | 0.722 | 1.84E−02 | 1 | 10 |
| WNU61 | 0.959 | 6.40E−04 | 1 | 92 | WNU61 | 0.738 | 1.48E−02 | 1 | 60 |
| WNU61 | 0.703 | 7.80E−02 | 1 | 36 | WNU61 | 0.736 | 2.38E−02 | 1 | 1 |
| WNU61 | 0.720 | 6.78E−02 | 1 | 70 | WNU61 | 0.799 | 3.12E−02 | 1 | 88 |
| WNU61 | 0.779 | 7.88E−03 | 1 | 59 | WNU61 | 0.757 | 1.82E−02 | 1 | 75 |
| WNU61 | 0.720 | 1.88E−02 | 4 | 67 | WNU61 | 0.780 | 2.23E−02 | 4 | 34 |
| WNU61 | 0.737 | 3.70E−02 | 4 | 92 | WNU61 | 0.729 | 6.30E−02 | 2 | 34 |
| WNU61 | 0.806 | 8.74E−03 | 2 | 79 | WNU61 | 0.901 | 5.67E−03 | 2 | 36 |
| WNU61 | 0.904 | 5.17E−03 | 2 | 70 | WNU61 | 0.724 | 2.73E−02 | 2 | 69 |
| WNU61 | 0.716 | 2.99E−02 | 2 | 35 | WNU63 | 0.727 | 6.39E−02 | 3 | 34 |
| WNU63 | 0.819 | 3.77E−03 | 3 | 81 | WNU63 | 0.851 | 1.78E−03 | 3 | 83 |
| WNU63 | 0.824 | 2.26E−02 | 3 | 7 | WNU63 | 0.769 | 1.54E−02 | 3 | 25 |
| WNU63 | 0.756 | 1.14E−02 | 3 | 37 | WNU63 | 0.780 | 1.31E−02 | 3 | 6 |
| WNU63 | 0.783 | 3.72E−02 | 3 | 92 | WNU63 | 0.810 | 8.13E−03 | 3 | 79 |
| WNU63 | 0.757 | 1.12E−02 | 3 | 82 | WNU63 | 0.764 | 1.65E−02 | 3 | 91 |
| WNU63 | 0.726 | 2.67E−02 | 3 | 71 | WNU63 | 0.748 | 5.30E−02 | 8 | 73 |
| WNU63 | 0.742 | 5.60E−02 | 3 | 39 | WNU63 | 0.773 | 4.16E−02 | 8 | 76 |
| WNU63 | 0.879 | 1.82E−03 | 8 | 16 | WNU63 | 0.869 | 1.11E−02 | 8 | 89 |
| WNU63 | 0.738 | 2.31E−02 | 8 | 12 | WNU63 | 0.786 | 1.21E−02 | 8 | 85 |
| WNU63 | 0.976 | 8.26E−04 | 8 | 7 | WNU63 | 0.706 | 3.35E−02 | 8 | 37 |
| WNU63 | 0.763 | 1.68E−02 | 8 | 8 | WNU63 | 0.80 1 | 3.05E−02 | 8 | 23 |
| WNU63 | 0.750 | 5.23E−02 | 8 | 95 | WNU63 | 0.843 | 1.72E−02 | 8 | 80 |
| WNU63 | 0.869 | 1.11E−02 | 8 | 77 | WNU63 | 0.827 | 2.16E−02 | 8 | 26 |
| WNU63 | 0.816 | 2.51E−02 | 8 | 24 | WNU63 | 0.971 | 1.22E−03 | 8 | 88 |
| WNU63 | 0.813 | 2.64E−02 | 8 | 27 | WNU63 | 0.896 | 2.61E−03 | 8 | 91 |
| WNU63 | 0.717 | 4.51E−02 | 8 | 71 | WNU63 | 0.784 | 2.12E−02 | 8 | 93 |
| WNU63 | 0.794 | 3.28E−02 | 8 | 74 | WNU63 | 0.749 | 2.01E−02 | 9 | 73 |
| WNU63 | 0.702 | 1.20E−01 | 8 | 39 | WNU63 | 0.704 | 3.42E−02 | 9 | 76 |
| WNU63 | 0.715 | 2.02E−02 | 9 | 16 | WNU63 | 0.799 | 9.79E−03 | 9 | 95 |
| WNU63 | 0.729 | 2.59E−02 | 9 | 28 | WNU63 | 0.844 | 1.69E−02 | 9 | 36 |
| WNU63 | 0.727 | 1.72E−02 | 9 | 84 | WNU63 | 0.840 | 1.79E−02 | 9 | 70 |
| WNU63 | 0.716 | 3.01E−02 | 9 | 24 | WNU63 | 0.844 | 4.26E−03 | 9 | 69 |
| WNU63 | 0.763 | 1.68E−02 | 9 | 27 | WNU63 | 0.869 | 2.34E−03 | 9 | 35 |
| WNU63 | 0.838 | 4.83E−03 | 9 | 74 | WNU63 | 0.872 | 1.02E−03 | 1 | 82 |
| WNU63 | 0.755 | 1.16E−02 | 1 | 83 | WNU63 | 0.786 | 7.08E−03 | 1 | 86 |
| WNU63 | 0.823 | 6.40E−03 | 1 | 79 | WNU63 | 0.867 | 2.45E−03 | 1 | 91 |
| WNU63 | 0.723 | 2.78E−02 | 1 | 78 | WNU63 | 0.882 | 3.71E−03 | 4 | 73 |
| WNU63 | 0.773 | 4.18E−02 | 1 | 39 | WNU63 | 0.749 | 1.27E−02 | 4 | 37 |
| WNU63 | 0.921 | 1.14E−03 | 4 | 89 | WNU63 | 0.786 | 7.02E−03 | 4 | 82 |
| WNU63 | 0.874 | 4.51E−03 | 4 | 77 | WNU63 | 0.917 | 1.33E−03 | 4 | 24 |
| WNU63 | 0.749 | 3.23E−02 | 4 | 79 | WNU63 | 0.716 | 4.58E−02 | 4 | 70 |
| WNU63 | 0.857 | 6.51E−03 | 4 | 26 | WNU63 | 0.914 | 2.13E−04 | 4 | 91 |
| WNU63 | 0.863 | 5.76E−03 | 4 | 78 | WNU63 | 0.725 | 1.77E−02 | 2 | 82 |
| WNU63 | 0.768 | 4.40E−02 | 4 | 39 | WNU63 | 0.818 | 2.46E−02 | 2 | 36 |
| WNU63 | 0.753 | 1.91E−02 | 2 | 79 | WNU63 | 0.746 | 2.10E−02 | 2 | 91 |
| WNU63 | 0.787 | 3.57E−02 | 2 | 70 | WNU63 | 0.703 | 7.81E−02 | 2 | 39 |
| WNU63 | 0.701 | 3.53E−02 | 2 | 35 | WNU65 | 0.867 | 2.50E−03 | 3 | 25 |
| WNU65 | 0.710 | 7.38E−02 | 3 | 34 | WNU65 | 0.891 | 1.25E−03 | 3 | 79 |
| WNU65 | 0.722 | 1.85E−02 | 3 | 82 | WNU65 | 0.806 | 2.86E−02 | 3 | 70 |
| WNU65 | 0.784 | 3.69E−02 | 3 | 36 | WNU65 | 0.738 | 2.32E−02 | 3 | 71 |
| WNU65 | 0.765 | 1.63E−02 | 3 | 29 | WNU65 | 0.714 | 3.08E−02 | 8 | 16 |
| WNU65 | 0.910 | 4.38E−03 | 8 | 73 | WNU65 | 0.817 | 2.49E−02 | 8 | 28 |
| WNU65 | 0.943 | 1.45E−03 | 8 | 76 | WNU65 | 0.922 | 3.13E−03 | 8 | 89 |
| WNU65 | 0.798 | 9.98E−03 | 8 | 81 | WNU65 | 0.876 | 1.97E−03 | 8 | 85 |
| WNU65 | 0.788 | 6.25E−02 | 8 | 94 | WNU65 | 0.870 | 1.10E−02 | 8 | 30 |
| WNU65 | 0.797 | 1.01E−02 | 8 | 83 | WNU65 | 0.952 | 9.24E−04 | 8 | 95 |
| WNU65 | 0.711 | 3.18E−02 | 8 | 37 | WNU65 | 0.951 | 1.02E−03 | 8 | 23 |
| WNU65 | 0.831 | 2.05E−02 | 8 | 25 | WNU65 | 0.827 | 6.00E−03 | 8 | 82 |
| WNU65 | 0.867 | 1.14E−02 | 8 | 77 | WNU65 | 0.884 | 1.56E−03 | 8 | 86 |
| WNU65 | 0.746 | 5.44E−02 | 8 | 79 | WNU65 | 0.951 | 9.70E−04 | 8 | 26 |
| WNU65 | 0.919 | 3.46E−03 | 8 | 24 | WNU65 | 0.964 | 4.74E−04 | 8 | 27 |
| WNU65 | 0.715 | 3.04E−02 | 8 | 11 | WNU65 | 0.876 | 4.38E−03 | 8 | 93 |
| WNU65 | 0.974 | 2.03E−04 | 8 | 74 | WNU65 | 0.708 | 3.27E−02 | 9 | 93 |
| WNU65 | 0.762 | 4.66E−02 | 9 | 94 | WNU65 | 0.861 | 1.38E−03 | 1 | 81 |
| WNU65 | 0.741 | 1.42E−02 | 9 | 49 | WNU65 | 0.793 | 6.24E−03 | 1 | 83 |
| WNU65 | 0.863 | 1.30E−03 | 1 | 85 | WNU65 | 0.722 | 2.80E−02 | 1 | 6 |
| WNU65 | 0.877 | 8.52E−04 | 1 | 37 | WNU65 | 0.711 | 7.35E−02 | 1 | 70 |
| WNU65 | 0.731 | 1.63E−02 | 1 | 86 | WNU65 | 0.733 | 3.87E−02 | 4 | 94 |
| WNU65 | 0.806 | 8.76E−03 | 1 | 93 | WNU65 | 0.766 | 2.66E−02 | 4 | 36 |
| WNU65 | 0.761 | 2.84E−02 | 4 | 79 | WNU65 | 0.724 | 1.79E−02 | 4 | 91 |
| WNU65 | 0.771 | 2.52E−02 | 4 | 70 | WNU65 | 0.868 | 2.43E−03 | 2 | 76 |

TABLE 62-continued

Correlation between the expression level of selected genes of some embodiments of the invention in various tissues and the phenotypic performance under low nitrogen fertilization conditions across foxtail millet accessions

| Gene Name | R | P value | Exp. set | Cor. Set ID | Gene Name | R | P value | Exp. set | Cor. Set ID |
|---|---|---|---|---|---|---|---|---|---|
| WNU65 | 0.702 | 2.37E−02 | 4 | 93 | WNU65 | 0.753 | 1.19E−02 | 2 | 85 |
| WNU65 | 0.755 | 4.99E−02 | 2 | 94 | WNU65 | 0.730 | 1.65E−02 | 2 | 37 |
| WNU65 | 0.703 | 2.34E−02 | 2 | 10 | WNU65 | 0.839 | 4.68E−03 | 2 | 23 |
| WNU65 | 0.756 | 1.83E−02 | 2 | 95 | WNU65 | 0.702 | 3.52E−02 | 2 | 63 |
| WNU65 | 0.702 | 3.51E−02 | 2 | 80 | WNU65 | 0.756 | 1.83E−02 | 2 | 74 |
| WNU65 | 0.831 | 5.53E−03 | 2 | 27 | WNU65 | 0.823 | 2.29E−02 | 3 | 7 |
| WNU65 | 0.823 | 6.42E−03 | 2 | 93 | WNU66 | 0.813 | 2.62E−02 | 8 | 73 |
| WNU66 | 0.819 | 2.42E−02 | 3 | 92 | WNU66 | 0.788 | 3.53E−02 | 8 | 89 |
| WNU66 | 0.751 | 5.17E−02 | 8 | 76 | WNU66 | 0.705 | 3.38E−02 | 8 | 20 |
| WNU66 | 0.729 | 2.59E−02 | 8 | 50 | WNU66 | 0.735 | 2.40E−02 | 8 | 62 |
| WNU66 | 0.854 | 1.45E−02 | 8 | 90 | WNU66 | 0.845 | 1.67E−02 | 8 | 77 |
| WNU66 | 0.705 | 7.67E−02 | 8 | 23 | WNU66 | 0.749 | 5.28E−02 | 8 | 26 |
| WNU66 | 0.752 | 5.13E−02 | 8 | 24 | WNU66 | 0.904 | 1.33E−02 | 8 | 55 |
| WNU66 | 0.829 | 2.12E−02 | 8 | 96 | WNU66 | 0.820 | 1.28E−02 | 8 | 91 |
| WNU66 | 0.764 | 1.65E−02 | 8 | 51 | WNU66 | 0.786 | 3.60E−02 | 9 | 34 |
| WNU66 | 0.735 | 9.63E−02 | 8 | 39 | WNU66 | 0.781 | 3.83E−02 | 9 | 2 |
| WNU66 | 0.714 | 3.08E−02 | 9 | 90 | WNU66 | 0.932 | 2.19E−03 | 9 | 36 |
| WNU66 | 0.787 | 1.19E−02 | 9 | 79 | WNU66 | 0.713 | 2.07E−02 | 9 | 61 |
| WNU66 | 0.948 | 1.16E−03 | 9 | 70 | WNU66 | 0.725 | 4.20E−02 | 4 | 25 |
| WNU66 | 0.741 | 1.43E−02 | 1 | 46 | WNU66 | 0.776 | 1.40E−02 | 2 | 76 |
| WNU66 | 0.885 | 1.49E−03 | 2 | 73 | WNU66 | 0.947 | 1.09E−04 | 2 | 89 |
| WNU66 | 0.759 | 1.09E−02 | 2 | 81 | WNU66 | 0.780 | 7.74E−03 | 2 | 83 |
| WNU66 | 0.743 | 5.59E−02 | 2 | 7 | WNU66 | 0.791 | 1.10E−02 | 2 | 23 |
| WNU66 | 0.838 | 2.48E−03 | 2 | 37 | WNU66 | 0.854 | 1.66E−03 | 2 | 82 |
| WNU66 | 0.942 | 1.42E−04 | 2 | 77 | WNU66 | 0.856 | 1.59E−03 | 2 | 86 |
| WNU66 | 0.770 | 1.53E−02 | 2 | 80 | WNU66 | 0.900 | 9.36E−04 | 2 | 26 |
| WNU66 | 0.932 | 2.59E−04 | 2 | 24 | WNU66 | 0.728 | 1.69E−02 | 2 | 11 |
| WNU66 | 0.822 | 6.57E−03 | 2 | 78 | WNU66 | 0.869 | 2.38E−03 | 2 | 91 |
| WNU66 | 0.760 | 1.75E−02 | 2 | 27 | WNU67 | 0.725 | 2.70E−02 | 8 | 67 |
| WNU66 | 0.929 | 2.46E−03 | 2 | 39 | WNU67 | 0.791 | 3.40E−02 | 8 | 90 |
| WNU67 | 0.757 | 1.81E−02 | 8 | 50 | WNU67 | 0.914 | 5.63E−04 | 8 | 60 |
| WNU67 | 0.740 | 9.28E−02 | 8 | 2 | WNU67 | 0.886 | 1.46E−03 | 8 | 68 |
| WNU67 | 0.901 | 5.62E−03 | 8 | 96 | WNU67 | 0.754 | 1.88E−02 | 8 | 51 |
| WNU67 | 0.704 | 5.12E−02 | 8 | 63 | WNU67 | 0.805 | 8.93E−03 | 8 | 59 |
| WNU67 | 0.750 | 3.20E−02 | 8 | 87 | WNU67 | 0.814 | 2.60E−02 | 9 | 70 |
| WNU67 | 0.826 | 2.20E−02 | 9 | 36 | WNU67 | 0.795 | 5.98E−03 | 4 | 54 |
| WNU67 | 0.796 | 5.92E−03 | 4 | 56 | WNU67 | 0.724 | 1.79E−02 | 2 | 62 |
| WNU67 | 0.735 | 2.41E−02 | 2 | 90 | WNU67 | 0.804 | 2.92E−02 | 2 | 70 |
| WNU67 | 0.824 | 2.25E−02 | 2 | 36 | WNU67 | 0.765 | 4.52E−02 | 2 | 88 |
| WNU67 | 0.705 | 3.41E−02 | 2 | 96 | WNU68 | 0.916 | 5.12E−04 | 8 | 81 |
| WNU68 | 0.832 | 2.03E−02 | 3 | 7 | WNU68 | 0.926 | 3.36E−04 | 8 | 83 |
| WNU68 | 0.809 | 8.25E−03 | 8 | 85 | WNU68 | 0.940 | 1.63E−04 | 8 | 82 |
| WNU68 | 0.831 | 5.46E−03 | 8 | 37 | WNU68 | 0.821 | 1.25E−02 | 8 | 71 |
| WNU68 | 0.917 | 5.10E−04 | 8 | 86 | WNU68 | 0.850 | 7.46E−03 | 8 | 93 |
| WNU68 | 0.826 | 1.14E−02 | 8 | 91 | WNU68 | 0.897 | 1.06E−03 | 9 | 73 |
| WNU68 | 0.787 | 6.35E−02 | 8 | 39 | WNU68 | 0.739 | 2.29E−02 | 9 | 89 |
| WNU68 | 0.809 | 8.27E−03 | 9 | 76 | WNU68 | 0.853 | 3.49E−03 | 9 | 77 |
| WNU68 | 0.767 | 1.58E−02 | 9 | 95 | WNU68 | 0.810 | 8.07E−03 | 9 | 26 |
| WNU68 | 0.772 | 1.47E−02 | 9 | 24 | WNU68 | 0.748 | 1.29E−02 | 1 | 81 |
| WNU68 | 0.745 | 2.11E−02 | 9 | 74 | WNU68 | 0.818 | 3.85E−03 | 1 | 83 |
| WNU68 | 0.710 | 3.21E−02 | 1 | 89 | WNU68 | 0.807 | 8.59E−03 | 1 | 25 |
| WNU68 | 0.794 | 6.14E−03 | 1 | 37 | WNU68 | 0.886 | 1.47E−03 | 1 | 79 |
| WNU68 | 0.877 | 8.67E−04 | 1 | 82 | WNU68 | 0.769 | 1.54E−02 | 1 | 78 |
| WNU68 | 0.785 | 7.11E−03 | 1 | 86 | WNU68 | 0.954 | 6.41E−05 | 1 | 91 |
| WNU68 | 0.743 | 2.17E−02 | 1 | 71 | WNU68 | 0.759 | 1.77E−02 | 1 | 35 |
| WNU68 | 0.711 | 3.19E−02 | 1 | 69 | WNU68 | 0.832 | 2.84E−03 | 4 | 81 |
| WNU68 | 0.833 | 2.00E−02 | 1 | 39 | WNU68 | 0.727 | 4.10E−02 | 4 | 89 |
| WNU68 | 0.790 | 6.52E−03 | 4 | 12 | WNU68 | 0.733 | 3.85E−02 | 4 | 94 |
| WNU68 | 0.745 | 1.34E−02 | 4 | 14 | WNU68 | 0.833 | 2.80E−03 | 4 | 8 |
| WNU68 | 0.844 | 2.14E−03 | 4 | 85 | WNU68 | 0.872 | 1.00E−03 | 4 | 37 |
| WNU68 | 0.844 | 2.16E−03 | 4 | 83 | WNU68 | 0.759 | 2.90E−02 | 4 | 77 |
| WNU68 | 0.837 | 9.60E−03 | 4 | 25 | WNU68 | 0.762 | 2.79E−02 | 4 | 80 |
| WNU68 | 0.761 | 1.05E−02 | 4 | 82 | WNU68 | 0.707 | 4.98E−02 | 4 | 24 |
| WNU68 | 0.777 | 8.18E−03 | 4 | 86 | WNU68 | 0.792 | 6.32E−03 | 4 | 91 |
| WNU68 | 0.729 | 1.68E−02 | 4 | 71 | WNU68 | 0.927 | 2.62E−03 | 4 | 39 |
| WNU68 | 0.803 | 5.11E−03 | 4 | 93 | WNU68 | 0.702 | 2.37E−02 | 2 | 14 |
| WNU68 | 0.764 | 1.66E−02 | 2 | 89 | WNU68 | 0.750 | 1.26E−02 | 2 | 37 |
| WNU68 | 0.788 | 3.52E−02 | 2 | 7 | WNU68 | 0.793 | 1.07E−02 | 2 | 80 |
| WNU68 | 0.707 | 3.33E−02 | 2 | 77 | WNU68 | 0.775 | 1.41E−02 | 2 | 91 |
| WNU68 | 0.742 | 2.20E−02 | 2 | 78 | WNU69 | 0.708 | 7.49E−02 | 3 | 88 |
| WNU69 | 0.888 | 7.53E−03 | 3 | 34 | WNU69 | 0.781 | 7.62E−03 | 9 | 14 |
| WNU69 | 0.796 | 5.83E−03 | 9 | 9 | WNU69 | 0.772 | 8.90E−03 | 9 | 83 |
| WNU69 | 0.788 | 3.52E−02 | 9 | 7 | WNU69 | 0.788 | 1.17E−02 | 9 | 25 |

TABLE 62-continued

Correlation between the expression level of selected genes of some embodiments of the invention in various tissues and the phenotypic performance under low nitrogen fertilization conditions across foxtail millet accessions

| Gene Name | R | P value | Exp. set | Cor. Set ID | Gene Name | R | P value | Exp. set | Cor. Set ID |
|---|---|---|---|---|---|---|---|---|---|
| WNU69 | 0.713 | 2.07E−02 | 9 | 37 | WNU69 | 0.743 | 1.38E−02 | 9 | 82 |
| WNU69 | 0.863 | 2.73E−03 | 9 | 6 | WNU69 | 0.834 | 5.24E−03 | 9 | 71 |
| WNU69 | 0.793 | 6.19E−03 | 9 | 86 | WNU69 | 0.317 | 2.96E−02 | 9 | 35 |
| WNU69 | 0.839 | 4.74E−03 | 9 | 93 | WNU69 | 0.929 | 1.01E−04 | 1 | 81 |
| WNU69 | 0.774 | 4.11E−02 | 9 | 39 | WNU69 | 0.862 | 1.33E−03 | 1 | 83 |
| WNU69 | 0.885 | 6.73E−04 | 1 | 85 | WNU69 | 0.736 | 1.53E−02 | 1 | 4 |
| WNU69 | 0.858 | 1.51E−03 | 1 | 37 | WNU69 | 0.773 | 8.70E−03 | 1 | 86 |
| WNU69 | 0.809 | 4.57E−03 | 1 | 82 | WNU69 | 0.720 | 2.88E−02 | 1 | 71 |
| WNU69 | 0.720 | 1.88E−02 | 1 | 15 | WNU69 | 0.835 | 5.12E−03 | 1 | 91 |
| WNU69 | 0.736 | 1.53E−02 | 1 | 32 | WNU69 | 0.749 | 5.27E−03 | 1 | 39 |
| WNU69 | 0.747 | 2.08E−02 | 1 | 93 | WNU69 | 0.912 | 2.33E−04 | 2 | 81 |
| WNU69 | 0.734 | 1.56E−02 | 2 | 16 | WNU69 | 0.864 | 1.26E−03 | 2 | 83 |
| WNU69 | 0.837 | 2.53E−03 | 2 | 85 | WNU69 | 0.741 | 2.24E−02 | 2 | 77 |
| WNU69 | 0.885 | 6.64E−04 | 2 | 37 | WNU69 | 0.753 | 1.20E−02 | 2 | 86 |
| WNU69 | 0.740 | 1.45E−02 | 2 | 82 | WNU69 | 0.756 | 1.85E−02 | 2 | 91 |
| WNU69 | 0.817 | 7.13E−03 | 2 | 71 | WNU69 | 0.820 | 2.38E−02 | 2 | 39 |
| WNU69 | 0.795 | 1.05E−02 | 2 | 93 | WNU70 | 0.815 | 2.55E−02 | 3 | 34 |
| WNU70 | 0.866 | 1.20E−03 | 3 | 50 | WNU70 | 0.844 | 3.45E−02 | 8 | 64 |
| WNU70 | 0.888 | 6.09E−04 | 3 | 61 | WNU70 | 0.762 | 1.71E−02 | 8 | 13 |
| WNU70 | 0.704 | 1.18E−01 | 8 | 72 | WNU70 | 0.742 | 5.64E−02 | 9 | 7 |
| WNU70 | 0.780 | 7.78E−03 | 9 | 81 | WNU70 | 0.732 | 1.60E−02 | 9 | 37 |
| WNU70 | 0.841 | 2.32E−03 | 9 | 83 | WNU70 | 0.835 | 5.10E−03 | 9 | 25 |
| WNU70 | 0.749 | 5.25E−02 | 9 | 2 | WNU70 | 0.908 | 7.22E−04 | 9 | 79 |
| WNU70 | 0.849 | 1.87E−03 | 9 | 82 | WNU70 | 0.819 | 6.91E−03 | 9 | 71 |
| WNU70 | 0.745 | 1.33E−02 | 9 | 86 | WNU70 | 0.747 | 2.08E−02 | 9 | 69 |
| WNU70 | 0.779 | 1.33E−02 | 9 | 91 | WNU70 | 0.812 | 4.36E−03 | 1 | 12 |
| WNU70 | 0.812 | 2.65E−02 | 9 | 39 | WNU70 | 0.730 | 1.66E−02 | 1 | 42 |
| WNU70 | 0.783 | 7.42E−03 | 1 | 8 | WNU70 | 0.739 | 1.47E−02 | 1 | 47 |
| WNU70 | 0.859 | 1.46E−03 | 1 | 68 | WNU70 | 0.709 | 3.26E−02 | 1 | 75 |
| WNU70 | 0.782 | 7.46E−03 | 1 | 59 | WNU70 | 0.707 | 2.22E−02 | 1 | 5 |
| WNU70 | 0.720 | 1.88E−02 | 1 | 46 | WNU70 | 0.777 | 8.20E−03 | 4 | 4 |
| WNU70 | 0.725 | 1.76E−02 | 4 | 56 | WNU70 | 0.850 | 7.50E−03 | 4 | 79 |
| WNU70 | 0.791 | 1.94E−02 | 4 | 25 | WNU70 | 0.828 | 3.08E−03 | 4 | 15 |
| WNU70 | 0.747 | 3.33E−02 | 4 | 36 | WNU70 | 0.726 | 1.75E−02 | 4 | 54 |
| WNU70 | 0.745 | 3.38E−02 | 4 | 70 | WNU70 | 0.709 | 4.90E−02 | 4 | 75 |
| WNU70 | 0.777 | 8.20E−03 | 4 | 32 | WNU70 | 0.718 | 1.94E−02 | 2 | 37 |
| WNU70 | 0.774 | 8.54E−03 | 2 | 81 | WNU71 | 0.756 | 1.83E−02 | 3 | 75 |
| WNU71 | 0.746 | 5.39E−02 | 3 | 64 | WNU71 | 0.707 | 7.57E−02 | 8 | 26 |
| WNU71 | 0.785 | 3.63E−02 | 3 | 72 | WNU71 | 0.790 | 1.13E−02 | 9 | 90 |
| WNU71 | 0.715 | 1.10E−01 | 8 | 88 | WNU71 | 0.837 | 2.53E−03 | 4 | 48 |
| WNU71 | 0.747 | 5.35E−02 | 9 | 2 | WNU71 | 0.738 | 1.49E−02 | 4 | 91 |
| WNU71 | 0.768 | 9.47E−03 | 4 | 43 | WNU72 | 0.757 | 1.81E−02 | 3 | 25 |
| WNU71 | 0.728 | 2.62E−02 | 2 | 1 | WNU72 | 0.817 | 2.48E−02 | 3 | 70 |
| WNU72 | 0.805 | 2.90E−02 | 3 | 36 | WNU72 | 0.756 | 1.83E−02 | 3 | 69 |
| WNU72 | 0.703 | 3.45E−02 | 3 | 71 | WNU72 | 0.783 | 3.75E−02 | 3 | 72 |
| WNU72 | 0.786 | 1.21E−02 | 3 | 35 | WNU72 | 0.778 | 6.83E−02 | 8 | 64 |
| WNU72 | 0.712 | 3.16E−02 | 8 | 15 | WNU72 | 0.707 | 3.31E−02 | 8 | 13 |
| WNU72 | 0.769 | 4.32E−02 | 8 | 96 | WNU72 | 0.939 | 5.58E−05 | 9 | 10 |
| WNU72 | 0.916 | 1.94E−04 | 9 | 67 | WNU72 | 0.706 | 3.35E−02 | 9 | 79 |
| WNU72 | 0.962 | 8.93E−06 | 9 | 84 | WNU72 | 0.836 | 1.91E−02 | 9 | 70 |
| WNU72 | 0.838 | 1.85E−02 | 9 | 36 | WNU72 | 0.701 | 2.38E−02 | 9 | 11 |
| WNU72 | 0.734 | 1.57E−02 | 9 | 68 | WNU72 | 0.864 | 2.69E−03 | 9 | 35 |
| WNU72 | 0.843 | 4.33E−03 | 9 | 69 | WNU72 | 0.726 | 6.49E−02 | 9 | 39 |
| WNU72 | 0.898 | 4.25E−04 | 9 | 66 | WNU72 | 0.819 | 3.72E−03 | 1 | 10 |
| WNU72 | 0.722 | 1.84E−02 | 1 | 67 | WNU72 | 0.908 | 7.17E−04 | 1 | 79 |
| WNU72 | 0.822 | 6.54E−03 | 1 | 25 | WNU72 | 0.712 | 3.13E−02 | 1 | 1 |
| WNU72 | 0.937 | 1.88E−03 | 1 | 36 | WNU72 | 0.786 | 1.20E−02 | 1 | 69 |
| WNU72 | 0.928 | 2.53E−03 | 1 | 70 | WNU72 | 0.784 | 1.24E−02 | 1 | 35 |
| WNU72 | 0.734 | 2.43E−02 | 1 | 75 | WNU72 | 0.896 | 2.62E−03 | 4 | 7 |
| WNU72 | 0.726 | 1.76E−02 | 1 | 66 | WNU72 | 0.756 | 3.01E−02 | 4 | 36 |
| WNU72 | 0.759 | 2.90E−02 | 4 | 92 | WNU72 | 0.722 | 4.31E−02 | 4 | 72 |
| WNU72 | 0.727 | 4.09E−02 | 4 | 70 | WNU72 | 0.751 | 1.96E−02 | 2 | 89 |
| WNU72 | 0.741 | 2.23E−02 | 2 | 73 | WNU72 | 0.833 | 2.00E−02 | 2 | 36 |
| WNU72 | 0.737 | 2.35E−02 | 2 | 77 | WNU72 | 0.809 | 2.75E−02 | 2 | 70 |
| WNU72 | 0.754 | 1.89E−02 | 2 | 24 | WNU72 | 0.814 | 7.53E−03 | 2 | 69 |
| WNU72 | 0.747 | 5.37E−02 | 2 | 55 | WNU73 | 0.701 | 3.55E−02 | 8 | 67 |
| WNU72 | 0.751 | 1.98E−02 | 2 | 35 | WNU73 | 0.794 | 5.94E−02 | 8 | 2 |
| WNU73 | 0.720 | 2.87E−02 | 8 | 10 | WNU73 | 0.890 | 3.07E−03 | 8 | 63 |
| WNU73 | 0.824 | 6.27E−03 | 8 | 60 | WNU73 | 0.823 | 3.45E−03 | 9 | 67 |
| WNU73 | 0.760 | 1.74E−02 | 8 | 59 | WNU73 | 0.775 | 8.48E−03 | 9 | 66 |
| WNU73 | 0.793 | 6.25E−03 | 9 | 10 | WNU73 | 0.849 | 1.87E−03 | 1 | 10 |
| WNU73 | 0.732 | 1.61E−02 | 1 | 67 | WNU73 | 0.756 | 1.14E−02 | 4 | 63 |
| WNU73 | 0.814 | 7.54E−03 | 1 | 63 | WNU73 | 0.786 | 3.63E−02 | 2 | 36 |

TABLE 62-continued

Correlation between the expression level of selected genes of some embodiments of the invention in various tissues and the phenotypic performance under low nitrogen fertilization conditions across foxtail millet accessions

| Gene Name | R | P value | Exp. set | Cor. Set ID | Gene Name | R | P value | Exp. set | Cor. Set ID |
|---|---|---|---|---|---|---|---|---|---|
| WNU73 | 0.746 | 5.44E−02 | 2 | 2 | WNU74 | 0.742 | 5.61E−02 | 3 | 34 |
| WNU73 | 0.774 | 4.09E−02 | 2 | 70 | WNU74 | 0.764 | 4.58E−02 | 3 | 92 |
| WNU74 | 0.714 | 7.15E−02 | 3 | 2 | WNU74 | 0.823 | 2.30E−02 | 3 | 70 |
| WNU74 | 0.794 | 3.30E−02 | 3 | 36 | WNU74 | 0.788 | 3.51E−02 | 8 | 90 |
| WNU74 | 0.860 | 2.93E−03 | 8 | 50 | WNU74 | 0.848 | 3.27E−02 | 8 | 2 |
| WNU74 | 0.908 | 7.07E−04 | 8 | 62 | WNU74 | 0.898 | 1.00E−03 | 8 | 61 |
| WNU74 | 0.836 | 1.92E−02 | 8 | 96 | WNU74 | 0.784 | 3.69E−02 | 9 | 34 |
| WNU74 | 0.944 | 1.28E−04 | 8 | 51 | WNU74 | 0.717 | 2.98E−02 | 9 | 25 |
| WNU74 | 0.825 | 2.24E−02 | 9 | 2 | WNU74 | 0.923 | 2.99E−03 | 9 | 36 |
| WNU74 | 0.859 | 3.02E−03 | 9 | 79 | WNU74 | 0.736 | 1.53E−02 | 9 | 66 |
| WNU74 | 0.932 | 2.21E−03 | 9 | 70 | WNU74 | 0.794 | 3.32E−02 | 1 | 2 |
| WNU74 | 0.705 | 2.27E−02 | 1 | 50 | WNU74 | 0.710 | 2.15E−02 | 1 | 61 |
| WNU74 | 0.762 | 1.71E−02 | 1 | 1 | WNU74 | 0.804 | 1.63E−02 | 4 | 89 |
| WNU74 | 0.885 | 3.47E−03 | 4 | 73 | WNU74 | 0.754 | 3.07E−02 | 4 | 77 |
| WNU74 | 0.701 | 5.27E−02 | 4 | 25 | WNU74 | 0.773 | 2.44E−02 | 4 | 26 |
| WNU74 | 0.797 | 1.79E−02 | 4 | 24 | WNU74 | 0.742 | 5.64E−02 | 2 | 34 |
| WNU74 | 0.722 | 1.05E−01 | 4 | 55 | WNU74 | 0.830 | 2.08E−02 | 2 | 92 |
| WNU74 | 0.712 | 7.27E−02 | 2 | 7 | WNU74 | 0.776 | 8.33E−03 | 2 | 82 |
| WNU74 | 0.852 | 3.54E−03 | 2 | 6 | WNU74 | 0.754 | 5.05E−02 | 2 | 36 |
| WNU74 | 0.761 | 1.72E−02 | 2 | 79 | WNU74 | 0.907 | 4.85E−03 | 2 | 88 |
| WNU74 | 0.736 | 5.94E−02 | 2 | 70 | WNU74 | 0.703 | 3.47E−02 | 2 | 69 |
| WNU74 | 0.741 | 2.24E−02 | 2 | 91 | WNU74 | 0.714 | 3.06E−02 | 2 | 35 |

"Cor. ID"—correlation set ID according to the correlated parameters Table 59 above.
"Exp. Set"—Expression set.
"R" = Pearson correlation coefficient;
"P" = p value.

TABLE 63

Correlation between the expression level of selected genes of some embodiments of the invention in various tissues and the phenotypic performance under normal fertilization conditions across foxtail millet accessions

| Gene Name | R | P value | Exp. set | Cor. Set ID | Gene Name | R | P value | Exp. set | Cor. Set ID |
|---|---|---|---|---|---|---|---|---|---|
| WNU1 | 0.722 | 1.84E−02 | 3 | 35 | WNU1 | 0.722 | 1.84E−02 | 3 | 42 |
| WNU1 | 0.853 | 3.49E−03 | 2 | 29 | WNU1 | 0.853 | 3.43E−03 | 2 | 33 |
| WNU1 | 0.715 | 3.05E−02 | 2 | 30 | WNU1 | 0.844 | 4.24E−03 | 2 | 40 |
| WNU1 | 0.873 | 2.11E−03 | 2 | 32 | WNU1 | 0.775 | 2.38E−02 | 11 | 1 |
| WNU1 | 0.768 | 9.51E−03 | 11 | 56 | WNU1 | 0.735 | 5.96E−02 | 9 | 52 |
| WNU1 | 0.773 | 1.45E−02 | 12 | 62 | WNU1 | 0.726 | 4.14E−02 | 12 | 54 |
| WNU53 | 0.703 | 1.19E−01 | 8 | 41 | WNU53 | 0.714 | 3.06E−02 | 4 | 7 |
| WNU53 | 0.937 | 1.82E−03 | 4 | 54 | WNU53 | 0.914 | 1.51E−03 | 3 | 4 |
| WNU53 | 0.834 | 1.97E−02 | 2 | 4 | WNU53 | 0.900 | 9.31E−04 | 5 | 46 |
| WNU53 | 0.724 | 6.57E−02 | 5 | 20 | WNU53 | 0.861 | 2.86E−03 | 5 | 7 |
| WNU53 | 0.872 | 4.73E−03 | 5 | 4 | WNU53 | 0.803 | 9.21E−03 | 5 | 45 |
| WNU53 | 0.755 | 5.00E−02 | 5 | 53 | WNU53 | 0.708 | 2.21E−02 | 11 | 29 |
| WNU53 | 0.713 | 2.06E−02 | 11 | 33 | WNU53 | 0.942 | 4.78E−04 | 11 | 43 |
| WNU53 | 0.718 | 1.93E−02 | 11 | 7 | WNU53 | 0.730 | 3.99E−02 | 11 | 19 |
| WNU53 | 0.740 | 1.44E−02 | 1 | 26 | WNU53 | 0.780 | 1.32E−02 | 1 | 19 |
| WNU53 | 0.894 | 2.75E−03 | 1 | 62 | WNU53 | 0.714 | 2.03E−02 | 1 | 56 |
| WNU53 | 0.823 | 6.49E−03 | 9 | 46 | WNU53 | 0.827 | 5.95E−03 | 9 | 29 |
| WNU53 | 0.846 | 4.06E−03 | 9 | 33 | WNU53 | 0.838 | 9.46E−03 | 9 | 43 |
| WNU53 | 0.778 | 1.37E−02 | 9 | 7 | WNU53 | 0.778 | 3.93E−02 | 9 | 19 |
| WNU53 | 0.700 | 5.32E−02 | 9 | 4 | WNU53 | 0.716 | 3.02E−02 | 9 | 45 |
| WNU53 | 0.706 | 3.37E−02 | 9 | 59 | WNU53 | 0.716 | 3.02E−02 | 12 | 47 |
| WNU53 | 0.718 | 2.95E−02 | 12 | 25 | WNU54 | 0.864 | 1.22E−02 | 4 | 49 |
| WNU54 | 0.759 | 4.79E−02 | 4 | 20 | WNU54 | 0.777 | 4.00E−02 | 4 | 52 |
| WNU54 | 0.777 | 3.99E−02 | 4 | 61 | WNU54 | 0.762 | 1.71E−02 | 4 | 55 |
| WNU54 | 0.753 | 8.42E−02 | 4 | 37 | WNU54 | 0.725 | 2.70E−02 | 4 | 58 |
| WNU54 | 0.739 | 5.76E−02 | 4 | 21 | WNU54 | 0.734 | 2.43E−02 | 4 | 26 |
| WNU54 | 0.850 | 1.53E−02 | 4 | 63 | WNU54 | 0.718 | 6.91E−02 | 4 | 19 |
| WNU54 | 0.856 | 1.40E−02 | 4 | 50 | WNU54 | 0.725 | 6.51E−02 | 4 | 17 |
| WNU54 | 0.712 | 3.12E−02 | 4 | 62 | WNU54 | 0.838 | 1.86E−02 | 4 | 53 |
| WNU54 | 0.828 | 2.13E−02 | 4 | 18 | WNU54 | 0.865 | 5.51E−03 | 3 | 48 |
| WNU54 | 0.911 | 4.28E−03 | 2 | 20 | WNU54 | 0.749 | 5.28E−02 | 2 | 52 |
| WNU54 | 0.883 | 8.37E−03 | 2 | 61 | WNU54 | 0.782 | 3.79E−02 | 2 | 21 |
| WNU54 | 0.791 | 3.43E−02 | 2 | 17 | WNU54 | 0.828 | 2.15E−02 | 2 | 53 |

TABLE 63-continued

Correlation between the expression level of selected genes of some embodiments of the invention in various tissues and the phenotypic performance under normal fertilization conditions across foxtail millet accessions

| Gene Name | R | P value | Exp. set | Cor. Set ID | Gene Name | R | P value | Exp. set | Cor. Set ID |
|---|---|---|---|---|---|---|---|---|---|
| WNU54 | 0.923 | 2.99E−03 | 2 | 18 | WNU54 | 0.826 | 6.06E−03 | 5 | 46 |
| WNU54 | 0.719 | 4.44E−02 | 5 | 43 | WNU54 | 0.767 | 1.59E−02 | 5 | 7 |
| WNU54 | 0.701 | 3.54E−02 | 5 | 14 | WNU54 | 0.828 | 2.13E−02 | 11 | 37 |
| WNU54 | 0.756 | 3.00E−02 | 11 | 19 | WNU54 | 0.845 | 4.17E−03 | 1 | 49 |
| WNU54 | 0.791 | 1.12E−02 | 1 | 52 | WNU54 | 0.722 | 1.84E−02 | 1 | 8 |
| WNU54 | 0.715 | 2.00E−02 | 1 | 13 | WNU54 | 0.768 | 9.42E−03 | 1 | 5 |
| WNU54 | 0.923 | 3.93E−04 | 1 | 63 | WNU54 | 0.946 | 1.15E−04 | 1 | 50 |
| WNU54 | 0.784 | 1.24E−02 | 1 | 53 | WNU54 | 0.728 | 2.61E−02 | 9 | 46 |
| WNU54 | 0.730 | 2.55E−02 | 9 | 11 | WNU54 | 0.731 | 3.93E−02 | 9 | 43 |
| WNU55 | 0.726 | 4.13E−02 | 3 | 1 | WNU55 | 0.789 | 6.61E−03 | 3 | 40 |
| WNU55 | 0.829 | 2.11E−02 | 2 | 1 | WNU55 | 0.788 | 3.53E−02 | 2 | 54 |
| WNU55 | 0.742 | 5.60E−02 | 5 | 20 | WNU55 | 0.803 | 2.95E−02 | 5 | 52 |
| WNU55 | 0.762 | 4.63E−02 | 5 | 61 | WNU55 | 0.828 | 2.14E−02 | 5 | 21 |
| WNU55 | 0.716 | 7.05E−02 | 5 | 63 | WNU55 | 0.793 | 3.33E−02 | 5 | 17 |
| WNU55 | 0.754 | 5.05E−02 | 5 | 53 | WNU55 | 0.749 | 3.24E−02 | 11 | 1 |
| WNU55 | 0.790 | 6.58E−03 | 11 | 55 | WNU55 | 0.715 | 2.02E−02 | 11 | 58 |
| WNU55 | 0.725 | 1.77E−02 | 11 | 57 | WNU55 | 0.812 | 4.31E−03 | 11 | 26 |
| WNU55 | 0.820 | 1.27E−02 | 11 | 62 | WNU55 | 0.737 | 1.51E−02 | 11 | 56 |
| WNU55 | 0.705 | 3.41E−02 | 11 | 59 | WNU55 | 0.736 | 1.53E−02 | 1 | 55 |
| WNU55 | 0.717 | 1.97E−02 | 1 | 57 | WNU55 | 0.787 | 6.85E−03 | 1 | 26 |
| WNU55 | 0.848 | 3.84E−03 | 1 | 19 | WNU55 | 0.927 | 9.03E−04 | 1 | 62 |
| WNU55 | 0.809 | 4.59E−03 | 1 | 56 | WNU55 | 0.718 | 2.93E−02 | 1 | 59 |
| WNU55 | 0.719 | 6.89E−02 | 9 | 49 | WNU55 | 0.713 | 7.21E−02 | 9 | 20 |
| WNU55 | 0.742 | 5.64E−02 | 9 | 52 | WNU55 | 0.766 | 4.48E−02 | 9 | 61 |
| WNU55 | 0.774 | 4.09E−02 | 9 | 21 | WNU55 | 0.794 | 3.29E−02 | 9 | 63 |
| WNU55 | 0.767 | 2.63E−02 | 9 | 47 | WNU55 | 0.784 | 3.69E−02 | 9 | 50 |
| WNU55 | 0.812 | 2.65E−02 | 9 | 17 | WNU55 | 0.842 | 8.79E−03 | 9 | 25 |
| WNU55 | 0.848 | 3.89E−03 | 12 | 1 | WNU55 | 0.770 | 9.16E−03 | 12 | 55 |
| WNU55 | 0.716 | 1.99E−02 | 12 | 58 | WNU55 | 0.781 | 7.71E−03 | 12 | 57 |
| WNU55 | 0.800 | 5.46E−03 | 12 | 56 | WNU55 | 0.835 | 5.14E−03 | 12 | 59 |
| WNU56 | 0.854 | 3.03E−02 | 8 | 41 | WNU56 | 0.791 | 1.12E−02 | 4 | 29 |
| WNU56 | 0.778 | 1.36E−02 | 4 | 33 | WNU56 | 0.850 | 1.54E−02 | 4 | 22 |
| WNU56 | 0.765 | 1.62E−02 | 4 | 32 | WNU56 | 0.751 | 1.23E−02 | 3 | 30 |
| WNU56 | 0.855 | 1.62E−03 | 3 | 14 | WNU56 | 0.711 | 3.18E−02 | 3 | 51 |
| WNU56 | 0.722 | 1.83E−02 | 3 | 32 | WNU56 | 0.728 | 1.69E−02 | 3 | 9 |
| WNU56 | 0.727 | 6.41E−02 | 2 | 24 | WNU56 | 0.842 | 4.36E−03 | 2 | 29 |
| WNU56 | 0.841 | 4.48E−03 | 2 | 33 | WNU56 | 0.727 | 6.42E−02 | 2 | 22 |
| WNU56 | 0.742 | 2.22E−02 | 2 | 32 | WNU56 | 0.713 | 7.20E−02 | 5 | 54 |
| WNU56 | 0.724 | 6.56E−02 | 5 | 18 | WNU56 | 0.759 | 2.89E−02 | 1 | 24 |
| WNU56 | 0.825 | 3.31E−03 | 1 | 29 | WNU56 | 0.814 | 4.19E−03 | 1 | 33 |
| WNU56 | 0.814 | 7.64E−03 | 1 | 22 | WNU56 | 0.750 | 3.20E−02 | 1 | 60 |
| WNU56 | 0.776 | 2.36E−02 | 1 | 4 | WNU56 | 0.777 | 8.19E−03 | 1 | 32 |
| WNU56 | 0.704 | 7.76E−02 | 9 | 54 | WNU56 | 0.836 | 9.74E−03 | 12 | 52 |
| WNU56 | 0.777 | 8.23E−03 | 12 | 2 | WNU56 | 0.756 | 1.14E−02 | 12 | 29 |
| WNU56 | 0.817 | 3.95E−03 | 12 | 8 | WNU56 | 0.777 | 8.23E−03 | 12 | 23 |
| WNU56 | 0.750 | 1.24E−02 | 12 | 33 | WNU56 | 0.768 | 2.60E−02 | 12 | 21 |
| WNU56 | 0.835 | 5.12E−03 | 12 | 60 | WNU56 | 0.845 | 2.07E−03 | 12 | 30 |
| WNU56 | 0.812 | 1.43E−02 | 12 | 63 | WNU56 | 0.759 | 2.90E−02 | 12 | 50 |
| WNU56 | 0.736 | 3.73E−02 | 12 | 17 | WNU56 | 0.749 | 1.27E−02 | 12 | 32 |
| WNU56 | 0.753 | 1.20E−02 | 12 | 9 | WNU56 | 0.923 | 1.42E−04 | 12 | 3 |
| WNU57 | 0.829 | 4.15E−02 | 8 | 14 | WNU57 | 0.818 | 4.66E−02 | 8 | 34 |
| WNU57 | 0.702 | 3.48E−02 | 2 | 29 | WNU57 | 0.713 | 3.12E−02 | 5 | 29 |
| WNU57 | 0.824 | 1.20E−02 | 5 | 43 | WNU57 | 0.743 | 2.18E−02 | 5 | 14 |
| WNU57 | 0.711 | 3.18E−02 | 5 | 32 | WNU57 | 0.800 | 3.06E−02 | 9 | 22 |
| WNU57 | 0.702 | 3.51E−02 | 9 | 14 | WNU57 | 0.881 | 7.60E−04 | 12 | 29 |
| WNU57 | 0.880 | 7.86E−04 | 12 | 33 | WNU57 | 0.743 | 2.18E−04 | 12 | 43 |
| WNU57 | 0.859 | 1.44E−03 | 12 | 32 | WNU57 | 0.753 | 1.19E−02 | 12 | 34 |
| WNU58 | 0.715 | 1.10E−01 | 8 | 6 | WNU58 | 0.702 | 1.20E−01 | 8 | 8 |
| WNU58 | 0.837 | 4.89E−03 | 5 | 46 | WNU58 | 0.857 | 6.49E−03 | 5 | 43 |
| WNU58 | 0.809 | 8.32E−03 | 5 | 7 | WNU58 | 0.829 | 5.75E−03 | 5 | 14 |
| WNU58 | 0.721 | 2.85E−02 | 5 | 45 | WNU58 | 0.824 | 6.36E−03 | 1 | 49 |
| WNU58 | 0.798 | 1.00E−02 | 1 | 51 | WNU58 | 0.899 | 9.71E−04 | 9 | 46 |
| WNU58 | 0.796 | 1.80E−02 | 9 | 43 | WNU58 | 0.879 | 1.79E−03 | 9 | 7 |
| WNU58 | 0.807 | 1.54E−02 | 9 | 4 | WNU58 | 0.843 | 4.28E−03 | 9 | 45 |
| WNU58 | 0.702 | 5.22E−02 | 12 | 49 | WNU58 | 0.771 | 9.00E−03 | 12 | 29 |
| WNU58 | 0.769 | 9.26E−03 | 12 | 33 | WNU58 | 0.778 | 1.36E−02 | 12 | 43 |
| WNU58 | 0.833 | 1.03E−02 | 12 | 51 | WNU58 | 0.805 | 4.99E−03 | 12 | 32 |
| WNU59 | 0.727 | 4.10E−02 | 12 | 18 | WNU60 | 0.701 | 3.54E−02 | 4 | 29 |
| WNU60 | 0.772 | 1.48E−02 | 4 | 43 | WNU60 | 0.756 | 1.85E−02 | 4 | 14 |
| WNU60 | 0.858 | 1.34E−02 | 2 | 1 | WNU60 | 0.848 | 3.84E−03 | 2 | 55 |
| WNU60 | 0.907 | 7.40E−04 | 2 | 58 | WNU60 | 0.853 | 1.47E−02 | 2 | 48 |
| WNU60 | 0.793 | 1.08E−02 | 2 | 57 | WNU60 | 0.793 | 1.07E−02 | 2 | 26 |

TABLE 63-continued

Correlation between the expression level of selected genes of some embodiments of the invention in various tissues and the phenotypic performance under normal fertilization conditions across foxtail millet accessions

| Gene Name | R | P value | Exp. set | Cor. Set ID | Gene Name | R | P value | Exp. set | Cor. Set ID |
|---|---|---|---|---|---|---|---|---|---|
| WNU60 | 0.848 | 1.58E−02 | 2 | 62 | WNU60 | 0.826 | 6.11E−03 | 2 | 56 |
| WNU60 | 0.810 | 1.49E−02 | 2 | 59 | WNU60 | 0.952 | 2.68E−04 | 11 | 43 |
| WNU60 | 0.753 | 1.91E−02 | 1 | 49 | WNU60 | 0.729 | 2.57E−02 | 1 | 52 |
| WNU60 | 0.767 | 9.69E−03 | 1 | 8 | WNU60 | 0.737 | 1.51E−02 | 1 | 5 |
| WNU60 | 0.839 | 4.70E−03 | 1 | 63 | WNU60 | 0.807 | 8.50E−03 | 1 | 50 |
| WNU60 | 0.729 | 1.67E−02 | 1 | 3 | WNU60 | 0.735 | 1.55E−02 | 12 | 29 |
| WNU60 | 0.729 | 1.68E−02 | 12 | 33 | WNU60 | 0.815 | 1.36E−02 | 12 | 51 |
| WNU60 | 0.796 | 5.86E−03 | 12 | 34 | WNU61 | 0.810 | 2.74E−02 | 4 | 49 |
| WNU61 | 0.790 | 3.47E−02 | 4 | 20 | WNU61 | 0.748 | 2.05E−02 | 4 | 29 |
| WNU61 | 0.809 | 2.77E−02 | 4 | 61 | WNU61 | 0.749 | 2.01E−02 | 4 | 33 |
| WNU61 | 0.728 | 6.38E−02 | 4 | 63 | WNU61 | 0.748 | 5.33E−02 | 4 | 50 |
| WNU61 | 0.702 | 7.85E−02 | 4 | 17 | WNU61 | 0.862 | 1.27E−02 | 4 | 53 |
| WNU61 | 0.770 | 1.53E−02 | 4 | 3 | WNU61 | 0.887 | 7.81E−03 | 4 | 18 |
| WNU61 | 0.755 | 1.16E−02 | 3 | 34 | WNU61 | 0.893 | 6.73E−03 | 2 | 62 |
| WNU61 | 0.703 | 7.80E−02 | 5 | 20 | WNU61 | 0.774 | 4.11E−02 | 5 | 52 |
| WNU61 | 0.742 | 5.64E−02 | 5 | 53 | WNU61 | 0.768 | 9.53E−03 | 1 | 29 |
| WNU61 | 0.756 | 1.14E−02 | 1 | 33 | WNU61 | 0.729 | 2.59E−02 | 1 | 51 |
| WNU61 | 0.819 | 1.29E−02 | 1 | 4 | WNU61 | 0.806 | 4.86E−03 | 1 | 32 |
| WNU61 | 0.832 | 2.02E−02 | 9 | 49 | WNU61 | 0.864 | 1.22E−02 | 9 | 20 |
| WNU61 | 0.897 | 6.15E−03 | 9 | 52 | WNU61 | 0.792 | 3.36E−02 | 9 | 61 |
| WNU61 | 0.720 | 2.88E−02 | 9 | 55 | WNU61 | 0.737 | 2.36E−02 | 9 | 58 |
| WNU61 | 0.883 | 8.42E−03 | 9 | 21 | WNU61 | 0.770 | 1.52E−02 | 9 | 57 |
| WNU61 | 0.810 | 2.73E−02 | 9 | 63 | WNU61 | 0.842 | 1.75E−02 | 9 | 50 |
| WNU61 | 0.847 | 1.61E−02 | 9 | 17 | WNU61 | 0.772 | 4.20E−02 | 9 | 53 |
| WNU61 | 0.748 | 2.06E−02 | 9 | 56 | WNU61 | 0.865 | 2.61E−03 | 9 | 59 |
| WNU61 | 0.739 | 5.79E−02 | 9 | 18 | WNU61 | 0.721 | 1.85E−02 | 12 | 46 |
| WNU61 | 0.793 | 1.07E−02 | 12 | 1 | WNU61 | 0.731 | 1.64E−02 | 12 | 11 |
| WNU61 | 0.730 | 1.66E−02 | 12 | 57 | WNU63 | 0.705 | 3.40E−02 | 4 | 55 |
| WNU63 | 0.783 | 1.26E−02 | 4 | 58 | WNU63 | 0.706 | 3.34E−02 | 4 | 48 |
| WNU63 | 0.773 | 1.47E−02 | 4 | 57 | WNU63 | 0.721 | 2.85E−02 | 4 | 26 |
| WNU63 | 0.728 | 6.37E−02 | 4 | 63 | WNU63 | 0.739 | 5.75E−02 | 4 | 50 |
| WNU63 | 0.774 | 1.43E−02 | 4 | 56 | WNU63 | 0.821 | 6.66E−03 | 4 | 59 |
| WNU63 | 0.710 | 2.14E−02 | 3 | 6 | WNU63 | 0.716 | 4.58E−02 | 3 | 48 |
| WNU63 | 0.816 | 4.01E−03 | 3 | 57 | WNU63 | 0.856 | 1.58E−03 | 3 | 14 |
| WNU63 | 0.799 | 9.73E−03 | 3 | 19 | WNU63 | 0.710 | 4.83E−02 | 3 | 62 |
| WNU63 | 0.758 | 1.11E−02 | 3 | 56 | WNU63 | 0.812 | 7.85E−03 | 3 | 59 |
| WNU63 | 0.729 | 6.30E−02 | 2 | 20 | WNU63 | 0.709 | 3.24E−02 | 2 | 55 |
| WNU63 | 0.716 | 3.00E−02 | 2 | 58 | WNU63 | 0.718 | 6.91E−03 | 2 | 21 |
| WNU63 | 0.776 | 1.39E−02 | 2 | 57 | WNU63 | 0.726 | 2.67E−02 | 2 | 26 |
| WNU63 | 0.755 | 4.97E−02 | 2 | 17 | WNU63 | 0.815 | 7.50E−03 | 2 | 56 |
| WNU63 | 0.963 | 1.28E−04 | 2 | 59 | WNU63 | 0.848 | 1.60E−02 | 5 | 20 |
| WNU63 | 0.892 | 6.97E−03 | 5 | 61 | WNU63 | 0.762 | 1.69E−02 | 5 | 55 |
| WNU63 | 0.784 | 3.71E−02 | 5 | 21 | WNU63 | 0.779 | 1.33E−02 | 5 | 57 |
| WNU63 | 0.786 | 1.20E−02 | 5 | 26 | WNU63 | 0.825 | 2.23E−02 | 5 | 17 |
| WNU63 | 0.927 | 9.16E−04 | 5 | 62 | WNU63 | 0.795 | 3.25E−02 | 5 | 53 |
| WNU63 | 0.801 | 9.52E−03 | 5 | 56 | WNU63 | 0.770 | 1.52E−02 | 5 | 59 |
| WNU63 | 0.913 | 4.03E−03 | 5 | 18 | WNU63 | 0.738 | 3.67E−02 | 11 | 1 |
| WNU63 | 0.723 | 4.28E−02 | 11 | 49 | WNU63 | 0.894 | 6.63E−03 | 11 | 37 |
| WNU63 | 0.735 | 3.80E−02 | 11 | 50 | WNU63 | 0.794 | 1.07E−02 | 1 | 49 |
| WNU63 | 0.854 | 3.38E−03 | 1 | 20 | WNU63 | 0.790 | 1.13E−02 | 1 | 52 |
| WNU63 | 0.827 | 5.99E−03 | 1 | 61 | WNU63 | 0.729 | 1.69E−02 | 1 | 55 |
| WNU63 | 0.722 | 6.70E−02 | 1 | 37 | WNU63 | 0.818 | 7.04E−03 | 1 | 21 |
| WNU63 | 0.741 | 1.43E−02 | 1 | 5 | WNU63 | 0.729 | 1.68E−02 | 1 | 57 |
| WNU63 | 0.746 | 1.31E−02 | 1 | 26 | WNU63 | 0.858 | 3.09E−03 | 1 | 63 |
| WNU63 | 0.845 | 4.09E−03 | 1 | 50 | WNU63 | 0.793 | 1.08E−02 | 1 | 17 |
| WNU63 | 0.740 | 3.59E−02 | 1 | 62 | WNU63 | 0.751 | 1.97E−02 | 1 | 53 |
| WNU63 | 0.822 | 3.53E−03 | 1 | 56 | WNU63 | 0.822 | 6.57E−03 | 1 | 59 |
| WNU63 | 0.905 | 7.78E−04 | 1 | 18 | WNU63 | 0.725 | 6.53E−02 | 9 | 20 |
| WNU63 | 0.752 | 5.11E−02 | 9 | 61 | WNU63 | 0.719 | 2.89E−02 | 9 | 41 |
| WNU63 | 0.791 | 3.42E−02 | 9 | 18 | WNU63 | 0.798 | 9.97E−03 | 12 | 1 |
| WNU63 | 0.718 | 6.93E−02 | 12 | 37 | WNU63 | 0.724 | 1.79E−02 | 12 | 58 |
| WNU63 | 0.748 | 3.28E−02 | 12 | 19 | WNU63 | 0.712 | 3.16E−02 | 12 | 62 |
| WNU65 | 0.748 | 8.71E−02 | 8 | 26 | WNU65 | 0.770 | 7.31E−02 | 8 | 55 |
| WNU65 | 0.873 | 2.32E−02 | 8 | 13 | WNU65 | 0.741 | 5.67E−02 | 4 | 52 |
| WNU65 | 0.757 | 4.89E−02 | 4 | 21 | WNU65 | 0.711 | 7.31E−02 | 4 | 17 |
| WNU65 | 0.797 | 5.77E−03 | 3 | 55 | WNU65 | 0.787 | 6.92E−03 | 3 | 58 |
| WNU65 | 0.723 | 1.80E−02 | 3 | 26 | WNU65 | 0.705 | 5.10E−02 | 3 | 62 |
| WNU65 | 0.745 | 5.47E−02 | 2 | 24 | WNU65 | 0.934 | 2.22E−04 | 2 | 29 |
| WNU65 | 0.933 | 2.44E−04 | 2 | 55 | WNU65 | 0.874 | 2.06E−03 | 2 | 58 |
| WNU65 | 0.928 | 3.04E−04 | 2 | 33 | WNU65 | 0.873 | 1.03E−02 | 2 | 43 |
| WNU65 | 0.755 | 4.97E−02 | 2 | 60 | WNU65 | 0.909 | 4.55E−03 | 2 | 48 |
| WNU65 | 0.925 | 3.55E−04 | 2 | 57 | WNU65 | 0.935 | 2.18E−04 | 2 | 26 |

TABLE 63-continued

Correlation between the expression level of selected genes of some embodiments of the invention in various tissues and the phenotypic performance under normal fertilization conditions across foxtail millet accessions

| Gene Name | R | P value | Exp. set | Cor. Set ID | Gene Name | R | P value | Exp. set | Cor. Set ID |
|---|---|---|---|---|---|---|---|---|---|
| WNU65 | 0.962 | 5.33E−04 | 2 | 19 | WNU65 | 0.897 | 6.18E−03 | 2 | 51 |
| WNU65 | 0.929 | 2.52E−03 | 2 | 62 | WNU65 | 0.878 | 1.85E−03 | 2 | 32 |
| WNU65 | 0.926 | 3.36E−04 | 2 | 56 | WNU65 | 0.868 | 5.23E−03 | 2 | 59 |
| WNU65 | 0.811 | 8.06E−03 | 5 | 6 | WNU65 | 0.768 | 1.57E−02 | 5 | 8 |
| WNU65 | 0.799 | 9.76E−03 | 5 | 14 | WNU65 | 0.763 | 1.68E−02 | 5 | 9 |
| WNU65 | 0.804 | 1.61E−02 | 11 | 1 | WNU65 | 0.859 | 6.24E−03 | 11 | 54 |
| WNU65 | 0.779 | 2.27E−02 | 1 | 1 | WNU65 | 0.739 | 1.46E−02 | 1 | 55 |
| WNU65 | 0.787 | 6.85E−03 | 1 | 58 | WNU65 | 0.765 | 1.00E−02 | 1 | 26 |
| WNU65 | 0.715 | 4.64E−02 | 1 | 62 | WNU65 | 0.820 | 6.85E−03 | 1 | 54 |
| WNU65 | 0.854 | 3.39E−03 | 9 | 6 | WNU65 | 0.818 | 7.02E−03 | 9 | 8 |
| WNU65 | 0.732 | 2.49E−02 | 9 | 10 | WNU65 | 0.730 | 2.57E−02 | 9 | 5 |
| WNU65 | 0.852 | 7.25E−03 | 9 | 48 | WNU65 | 0.709 | 3.24E−02 | 9 | 14 |
| WNU65 | 0.728 | 2.61E−02 | 9 | 32 | WNU65 | 0.826 | 6.02E−03 | 9 | 9 |
| WNU65 | 0.877 | 1.91E−03 | 12 | 1 | WNU65 | 0.839 | 9.19E−03 | 12 | 20 |
| WNU65 | 0.777 | 2.32E−02 | 12 | 52 | WNU65 | 0.795 | 1.83E−02 | 12 | 61 |
| WNU65 | 0.853 | 1.70E−03 | 12 | 55 | WNU65 | 0.890 | 5.54E−04 | 12 | 58 |
| WNU65 | 0.717 | 1.96E−02 | 12 | 7 | WNU65 | 0.934 | 6.83E−04 | 12 | 21 |
| WNU65 | 0.856 | 1.57E−03 | 12 | 57 | WNU65 | 0.787 | 6.86E−03 | 12 | 26 |
| WNU65 | 0.925 | 1.01E−03 | 12 | 17 | WNU65 | 0.775 | 8.47E−03 | 12 | 56 |
| WNU65 | 0.864 | 2.66E−03 | 12 | 59 | WNU65 | 0.765 | 2.70E−02 | 12 | 18 |
| WNU66 | 0.704 | 1.18E−01 | 8 | 46 | WNU66 | 0.834 | 3.89E−02 | 8 | 11 |
| WNU66 | 0.862 | 2.73E−02 | 8 | 45 | WNU66 | 0.767 | 1.59E−02 | 4 | 48 |
| WNU66 | 0.763 | 4.62E−02 | 4 | 19 | WNU66 | 0.776 | 1.40E−02 | 3 | 22 |
| WNU66 | 0.759 | 4.80E−02 | 2 | 19 | WNU66 | 0.792 | 3.39E−02 | 2 | 62 |
| WNU66 | 0.718 | 6.90E−02 | 2 | 54 | WNU66 | 0.714 | 3.09E−02 | 5 | 46 |
| WNU66 | 0.713 | 3.10E−02 | 5 | 29 | WNU66 | 0.731 | 2.53E−02 | 5 | 33 |
| WNU66 | 0.755 | 3.03E−02 | 5 | 43 | WNU66 | 0.785 | 1.23E−02 | 5 | 7 |
| WNU66 | 0.817 | 1.33E−02 | 11 | 1 | WNU66 | 0.747 | 3.30E−02 | 11 | 49 |
| WNU66 | 0.783 | 2.16E−02 | 11 | 20 | WNU66 | 0.802 | 1.66E−02 | 11 | 52 |
| WNU66 | 0.743 | 3.48E−02 | 11 | 61 | WNU66 | 0.938 | 5.86E−05 | 11 | 55 |
| WNU66 | 0.839 | 1.83E−02 | 11 | 37 | WNU66 | 0.965 | 6.62E−06 | 11 | 58 |
| WNU66 | 0.707 | 4.97E−02 | 11 | 21 | WNU66 | 0.886 | 6.35E−04 | 11 | 57 |
| WNU66 | 0.865 | 1.21E−03 | 11 | 26 | WNU66 | 0.838 | 9.41E−03 | 11 | 63 |
| WNU66 | 0.881 | 3.86E−03 | 11 | 50 | WNU66 | 0.905 | 2.02E−03 | 11 | 62 |
| WNU66 | 0.820 | 1.27E−02 | 11 | 53 | WNU66 | 0.842 | 2.25E−03 | 11 | 56 |
| WNU66 | 0.843 | 4.28E−03 | 11 | 59 | WNU66 | 0.873 | 4.66E−03 | 11 | 18 |
| WNU66 | 0.842 | 1.74E−02 | 1 | 37 | WNU66 | 0.705 | 3.40E−02 | 1 | 19 |
| WNU66 | 0.798 | 3.17E−02 | 9 | 19 | WNU66 | 0.792 | 1.10E−02 | 12 | 43 |
| WNU67 | 0.756 | 8.20E−02 | 8 | 11 | WNU67 | 0.860 | 2.80E−02 | 8 | 45 |
| WNU67 | 0.865 | 2.61E−02 | 8 | 35 | WNU67 | 0.802 | 5.47E−02 | 8 | 7 |
| WNU67 | 0.785 | 6.43E−02 | 8 | 42 | WNU67 | 0.797 | 1.00E−02 | 4 | 13 |
| WNU67 | 0.837 | 3.76E−02 | 4 | 37 | WNU67 | 0.737 | 5.87E−02 | 4 | 63 |
| WNU67 | 0.712 | 3.15E−02 | 4 | 14 | WNU67 | 0.750 | 5.24E−02 | 4 | 50 |
| WNU67 | 0.853 | 1.69E−03 | 3 | 29 | WNU67 | 0.860 | 1.43E−03 | 3 | 33 |
| WNU67 | 0.707 | 2.23E−02 | 3 | 32 | WNU67 | 0.705 | 3.39E−02 | 2 | 46 |
| WNU67 | 0.712 | 7.24E−02 | 2 | 48 | WNU67 | 0.861 | 1.28E−02 | 2 | 62 |
| WNU67 | 0.807 | 8.59E−03 | 2 | 45 | WNU67 | 0.948 | 1.17E−03 | 2 | 54 |
| WNU67 | 0.840 | 1.80E−02 | 5 | 51 | WNU67 | 0.716 | 1.99E−02 | 1 | 40 |
| WNU67 | 0.757 | 1.81E−02 | 1 | 54 | WNU67 | 0.720 | 2.86E−02 | 9 | 11 |
| WNU67 | 0.749 | 2.02E−02 | 9 | 40 | WNU67 | 0.704 | 3.41E−02 | 9 | 34 |
| WNU68 | 0.784 | 6.48E−02 | 8 | 13 | WNU68 | 0.716 | 1.10E−01 | 8 | 58 |
| WNU68 | 0.815 | 4.84E−02 | 8 | 5 | WNU68 | 0.902 | 8.73E−04 | 4 | 55 |
| WNU68 | 0.839 | 4.74E−03 | 4 | 58 | WNU68 | 0.795 | 1.04E−02 | 4 | 48 |
| WNU68 | 0.911 | 6.40E−04 | 4 | 57 | WNU68 | 0.869 | 2.36E−03 | 4 | 26 |
| WNU68 | 0.898 | 6.02E−03 | 4 | 19 | WNU68 | 0.898 | 1.01E−03 | 4 | 62 |
| WNU68 | 0.856 | 3.21E−03 | 4 | 56 | WNU68 | 0.858 | 3.05E−03 | 4 | 59 |
| WNU68 | 0.756 | 1.85E−02 | 2 | 55 | WNU68 | 0.758 | 4.85E−02 | 2 | 48 |
| WNU68 | 0.803 | 9.16E−03 | 2 | 57 | WNU68 | 0.823 | 6.48E−03 | 2 | 26 |
| WNU68 | 0.929 | 2.52E−03 | 2 | 19 | WNU68 | 0.864 | 1.22E−02 | 2 | 62 |
| WNU68 | 0.804 | 9.06E−03 | 2 | 56 | WNU68 | 0.737 | 3.71E−02 | 2 | 59 |
| WNU68 | 0.767 | 4.40E−02 | 5 | 19 | WNU68 | 0.742 | 5.63E−02 | 5 | 18 |
| WNU68 | 0.835 | 9.92E−03 | 11 | 1 | WNU68 | 0.807 | 4.77E−03 | 11 | 55 |
| WNU68 | 0.751 | 1.23E−02 | 11 | 58 | WNU68 | 0.819 | 3.77E−03 | 11 | 57 |
| WNU68 | 0.728 | 1.69E−02 | 11 | 26 | WNU68 | 0.851 | 1.81E−03 | 11 | 56 |
| WNU68 | 0.917 | 5.04E−04 | 11 | 59 | WNU68 | 0.920 | 1.65E−04 | 1 | 55 |
| WNU68 | 0.838 | 2.45E−03 | 1 | 58 | WNU68 | 0.893 | 5.06E−04 | 1 | 57 |
| WNU68 | 0.863 | 1.32E−03 | 1 | 26 | WNU68 | 0.824 | 6.36E−03 | 1 | 19 |
| WNU68 | 0.961 | 1.47E−04 | 1 | 62 | WNU68 | 0.941 | 4.80E−05 | 1 | 56 |
| WNU68 | 0.890 | 1.31E−03 | 1 | 59 | WNU68 | 0.795 | 3.27E−02 | 9 | 49 |
| WNU68 | 0.809 | 2.75E−02 | 9 | 20 | WNU68 | 0.862 | 1.26E−02 | 9 | 61 |
| WNU68 | 0.716 | 7.01E−02 | 9 | 21 | WNU68 | 0.728 | 2.63E−02 | 9 | 26 |
| WNU68 | 0.853 | 1.46E−02 | 9 | 19 | WNU68 | 0.796 | 3.24E−02 | 9 | 17 |

TABLE 63-continued

Correlation between the expression level of selected genes of some embodiments of the invention in various tissues and the phenotypic performance under normal fertilization conditions across foxtail millet accessions

| Gene Name | R | P value | Exp. set | Cor. Set ID | Gene Name | R | P value | Exp. set | Cor. Set ID |
|---|---|---|---|---|---|---|---|---|---|
| WNU68 | 0.790 | 1.96E−02 | 9 | 62 | WNU68 | 0.873 | 1.02E−02 | 9 | 53 |
| WNU68 | 0.867 | 1.16E−02 | 9 | 18 | WNU68 | 0.727 | 4.09E−02 | 12 | 22 |
| WNU69 | 0.774 | 7.07E−02 | 8 | 41 | WNU69 | 0.893 | 1.18E−03 | 3 | 54 |
| WNU69 | 0.737 | 1.50E−02 | 3 | 56 | WNU69 | 0.783 | 1.26E−02 | 2 | 55 |
| WNU69 | 0.737 | 2.34E−02 | 2 | 58 | WNU69 | 0.804 | 2.94E−02 | 2 | 48 |
| WNU69 | 0.734 | 2.43E−02 | 2 | 57 | WNU69 | 0.814 | 7.63E−03 | 2 | 26 |
| WNU69 | 0.839 | 1.83E−02 | 2 | 19 | WNU69 | 0.919 | 3.40E−03 | 2 | 62 |
| WNU69 | 0.747 | 2.07E−02 | 2 | 56 | WNU69 | 0.751 | 3.18E−02 | 11 | 1 |
| WNU69 | 0.811 | 4.38E−03 | 11 | 55 | WNU69 | 0.745 | 1.35E−02 | 11 | 58 |
| WNU69 | 0.757 | 1.12E−02 | 11 | 57 | WNU69 | 0.809 | 4.55E−03 | 11 | 26 |
| WNU69 | 0.756 | 1.15E−02 | 11 | 56 | WNU69 | 0.760 | 1.75E−02 | 11 | 59 |
| WNU69 | 0.772 | 2.48E−02 | 1 | 1 | WNU69 | 0.795 | 5.94E−03 | 1 | 55 |
| WNU69 | 0.887 | 6.24E−04 | 1 | 58 | WNU69 | 0.719 | 1.91E−02 | 1 | 57 |
| WNU69 | 0.736 | 1.52E−02 | 1 | 26 | WNU69 | 0.702 | 7.89E−02 | 9 | 17 |
| WNU70 | 0.830 | 4.08E−02 | 8 | 41 | WNU70 | 0.797 | 1.01E−02 | 4 | 32 |
| WNU70 | 0.757 | 1.83E−02 | 4 | 9 | WNU70 | 0.760 | 2.85E−02 | 3 | 1 |
| WNU70 | 0.752 | 1.95E−02 | 3 | 19 | WNU70 | 0.780 | 2.24E−02 | 3 | 62 |
| WNU70 | 0.739 | 2.29E−02 | 3 | 59 | WNU70 | 0.724 | 2.73E−02 | 2 | 30 |
| WNU70 | 0.742 | 5.64E−02 | 2 | 19 | WNU70 | 0.880 | 8.89E−03 | 2 | 62 |
| WNU70 | 0.766 | 4.45E−02 | 2 | 54 | WNU70 | 0.806 | 8.65E−03 | 2 | 34 |
| WNU70 | 0.761 | 4.71E−02 | 5 | 19 | WNU70 | 0.784 | 7.27E−03 | 5 | 30 |
| WNU70 | 0.705 | 2.29E−02 | 11 | 32 | WNU70 | 0.728 | 1.70E−02 | 11 | 41 |
| WNU70 | 0.771 | 1.50E−02 | 1 | 22 | WNU70 | 0.938 | 5.69E−04 | 1 | 4 |
| WNU70 | 0.788 | 2.01E−02 | 9 | 25 | WNU70 | 0.744 | 2.17E−02 | 12 | 60 |
| WNU71 | 0.701 | 2.38E−02 | 3 | 42 | WNU71 | 0.877 | 9.56E−03 | 2 | 62 |
| WNU71 | 0.895 | 6.54E−03 | 2 | 54 | WNU71 | 0.752 | 1.95E−02 | 5 | 6 |
| WNU71 | 0.899 | 5.91E−03 | 5 | 49 | WNU71 | 0.924 | 2.97E−03 | 5 | 20 |
| WNU71 | 0.875 | 9.93E−03 | 5 | 52 | WNU71 | 0.744 | 2.14E−02 | 5 | 2 |
| WNU71 | 0.940 | 1.62E−03 | 5 | 61 | WNU71 | 0.712 | 3.15E−02 | 5 | 8 |
| WNU71 | 0.841 | 4.52E−03 | 5 | 10 | WNU71 | 0.744 | 2.14E−02 | 5 | 23 |
| WNU71 | 0.948 | 1.14E−03 | 5 | 21 | WNU71 | 0.703 | 3.45E−02 | 5 | 5 |
| WNU71 | 0.951 | 9.94E−04 | 5 | 63 | WNU71 | 0.899 | 2.36E−03 | 5 | 47 |
| WNU71 | 0.939 | 1.70E−03 | 5 | 50 | WNU71 | 0.958 | 6.84E−04 | 5 | 17 |
| WNU71 | 0.907 | 1.88E−03 | 5 | 25 | WNU71 | 0.786 | 3.59E−02 | 5 | 53 |
| WNU71 | 0.745 | 2.14E−02 | 5 | 59 | WNU71 | 0.887 | 7.78E−03 | 5 | 18 |
| WNU71 | 0.705 | 2.27E−02 | 1 | 58 | WNU71 | 0.735 | 1.55E−02 | 1 | 26 |
| WNU72 | 0.711 | 3.16E−02 | 4 | 55 | WNU72 | 0.748 | 2.04E−02 | 4 | 57 |
| WNU72 | 0.715 | 3.02E−02 | 4 | 26 | WNU72 | 0.803 | 9.13E−03 | 4 | 40 |
| WNU72 | 0.793 | 1.08E−02 | 4 | 62 | WNU72 | 0.738 | 5.84E−02 | 4 | 54 |
| WNU72 | 0.872 | 2.19E−03 | 4 | 56 | WNU72 | 0.761 | 1.73E−02 | 4 | 59 |
| WNU72 | 0.792 | 6.27E−03 | 3 | 46 | WNU72 | 0.749 | 1.27E−02 | 3 | 29 |
| WNU72 | 0.850 | 1.82E−03 | 3 | 55 | WNU72 | 0.720 | 1.89E−02 | 3 | 58 |
| WNU72 | 0.761 | 1.06E−02 | 3 | 33 | WNU72 | 0.826 | 3.24E−03 | 3 | 7 |
| WNU72 | 0.712 | 3.14E−02 | 3 | 22 | WNU72 | 0.758 | 1.12E−02 | 3 | 57 |
| WNU72 | 0.724 | 1.79E−02 | 3 | 26 | WNU72 | 0.799 | 9.74E−03 | 3 | 19 |
| WNU72 | 0.802 | 1.66E−02 | 3 | 62 | WNU72 | 0.732 | 1.61E−02 | 3 | 45 |
| WNU72 | 0.731 | 1.63E−02 | 3 | 56 | WNU72 | 0.843 | 4.31E−03 | 2 | 55 |
| WNU72 | 0.847 | 3.98E−03 | 2 | 58 | WNU72 | 0.853 | 1.46E−02 | 2 | 48 |
| WNU72 | 0.777 | 1.38E−02 | 2 | 57 | WNU72 | 0.823 | 6.37E−03 | 2 | 26 |
| WNU72 | 0.732 | 6.16E−02 | 2 | 19 | WNU72 | 0.834 | 1.96E−02 | 2 | 62 |
| WNU72 | 0.727 | 2.64E−02 | 2 | 56 | WNU72 | 0.730 | 3.98E−02 | 2 | 59 |
| WNU72 | 0.881 | 8.76E−03 | 5 | 22 | WNU72 | 0.707 | 4.97E−02 | 5 | 48 |
| WNU72 | 0.810 | 4.52E−03 | 11 | 30 | WNU72 | 0.731 | 3.95E−02 | 11 | 19 |
| WNU72 | 0.745 | 3.39E−02 | 1 | 24 | WNU72 | 0.845 | 4.09E−03 | 1 | 22 |
| WNU72 | 0.729 | 4.03E−02 | 1 | 60 | WNU72 | 0.741 | 2.22E−02 | 1 | 54 |
| WNU72 | 0.701 | 5.27E−02 | 9 | 48 | WNU72 | 0.749 | 1.27E−02 | 12 | 46 |
| WNU72 | 0.778 | 8.00E−03 | 12 | 11 | WNU72 | 0.715 | 2.00E−02 | 12 | 7 |
| WNU72 | 0.786 | 6.97E−03 | 12 | 45 | WNU73 | 0.703 | 3.47E−02 | 5 | 46 |
| WNU73 | 0.725 | 4.19E−02 | 5 | 43 | WNU73 | 0.749 | 2.01E−02 | 5 | 14 |
| WNU73 | 0.729 | 1.68E−02 | 11 | 29 | WNU73 | 0.713 | 2.05E−02 | 11 | 33 |
| WNU73 | 0.743 | 1.38E−02 | 11 | 32 | WNU73 | 0.708 | 2.20E−02 | 1 | 29 |
| WNU73 | 0.709 | 2.17E−02 | 1 | 40 | WNU73 | 0.829 | 5.70E−03 | 9 | 46 |
| WNU73 | 0.896 | 2.57E−03 | 9 | 43 | WNU73 | 0.753 | 1.92E−02 | 9 | 7 |
| WNU73 | 0.715 | 3.03E−02 | 9 | 14 | WNU73 | 0.759 | 1.77E−02 | 9 | 45 |
| WNU73 | 0.746 | 2.10E−02 | 12 | 43 | WNU74 | 0.744 | 5.51E−02 | 4 | 22 |
| WNU74 | 0.776 | 1.40E−02 | 4 | 40 | WNU74 | 0.727 | 1.72E−02 | 3 | 34 |
| WNU74 | 0.713 | 3.09E−02 | 2 | 11 | WNU74 | 0.776 | 1.39E−02 | 2 | 55 |
| WNU74 | 0.837 | 1.89E−02 | 2 | 48 | WNU74 | 0.716 | 2.99E−02 | 2 | 26 |
| WNU74 | 0.810 | 2.73E−02 | 2 | 19 | WNU74 | 0.730 | 6.25E−02 | 2 | 62 |
| WNU74 | 0.723 | 2.78E−02 | 2 | 45 | WNU74 | 0.782 | 3.77E−02 | 2 | 54 |
| WNU74 | 0.711 | 7.33E−02 | 5 | 54 | WNU74 | 0.807 | 8.63E−03 | 9 | 40 |

TABLE 63-continued

Correlation between the expression level of selected genes of some embodiments of the invention in various tissues and the phenotypic performance under normal fertilization conditions across foxtail millet accessions

| Gene Name | R | P value | Exp. set | Cor. Set ID | Gene Name | R | P value | Exp. set | Cor. Set ID |
|---|---|---|---|---|---|---|---|---|---|
| WNU74 | 0.763 | 1.03E−02 | 12 | 29 | WNU74 | 0.766 | 9.79E−03 | 12 | 33 |
| WNU74 | 0.825 | 6.23E−03 | 12 | 43 | WNU74 | 0.744 | 1.35E−02 | 12 | 40 |

Table 63. "Corr. ID"—correlation set ID according to the correlated parameters Table 58 above.
"Exp. Set"—Expression set.
"R" = Pearson correlation coefficient;
"P" = p value.

Example 13

Production of Wheat Transcriptome and High Throughput Correlation Analysis Using 60K Wheat Oligonucleotide Micro-Array In order to produce a high throughput correlation analysis comparing between plant phenotype and gene expression level, the present inventors utilized a Wheat oligonucleotide micro-array, produced by Agilent Technologies [chem. (dot) agilent (dot) com/Scripts/PDS (dot) asp?1Page=50879]. The array oligonucleotide represents about 60K Wheat genes and transcripts. In order to define correlations between the levels of RNA expression and yield or vigor related parameters, various plant characteristics of 14 different Wheat accessions were analyzed. Among them, 10 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

14 Wheat accessions in 5 repetitive blocks, each containing 8 plants per pot were grown at net house. Three different treatments were applied: plants were regularly fertilized and watered during plant growth until harvesting (as recommended for commercial growth, plants were irrigated 2-3 times a week, and fertilization was given in the first 1.5 months of the growth period) or under low Nitrogen (70% percent less Nitrogen) or under drought stress (cycles of drought and re-irrigating were conducted throughout the whole experiment, overall 40% less water were given in the drought treatment).

Analyzed Wheat tissues—Five tissues at different developmental stages [leaf, stem, root tip and adventitious root, flower], representing different plant characteristics, were sampled and RNA was extracted as described above. Each micro-array expression information tissue type has received a Set ID as summarized in Table 64 below.

TABLE 64

Wheat transcriptome expression sets under normal conditions

| Expression Set | Set ID |
|---|---|
| adv root : Normal: first tillering: | 1 |
| basal lemma: Normal: grain filling: | 2 |
| basal spike: Normal: flowering: | 3 |
| basal spike: Normal: grain filling: | 4 |
| leaf: Normal: flowering: | 5 |
| leaf: Normal: grain filling: | 6 |
| root tip: Normal: first tillering: | 7 |

TABLE 64-continued

Wheat transcriptome expression sets under normal conditions

| Expression Set | Set ID |
|---|---|
| stem: Normal: flowering: | 8 |
| stem: Normal: grain filling: | 9 |

Table 64. Provided are the wheat transcriptome expression sets under normal conditions.

TABLE 65

Wheat transcriptome expression sets under low N conditions

| Expression Set | Set ID |
|---|---|
| adv root: Low N: first tillering | 1 |
| basal spike: Low N: flowering | 2 |
| basal spike: Low N: grain filling | 3 |
| leaf: Low N: flowering | 4 |
| leaf: Low N:grain filling | 5 |
| root tip: Low N: first tillering | 6 |
| wheat/evogene exp848 Low N/stem: Low N: flowering | 7 |
| wheat/evogene exp848 Low N/stem: Low N: grain filling | 8 |

Table 65. Provided are the wheat transcriptome expression sets under low N conditions.

TABLE 66

Wheat transcriptome expression sets low N vs. normal conditions

| Expression Set | Set ID |
|---|---|
| Low N vs. normal/adv root: Low N: first tillering | 1 |
| Low N vs. normal/basal spike: Low N: flowering | 2 |
| Low N vs. normal/basal spike :Low N: grain filling | 3 |
| Low N vs. normal/leaf: Low N: flowering | 4 |
| Low N vs. normal/leaf: Low N: grain filling | 5 |
| Low N vs. normal/root tip: Low N: first tillering | 6 |
| Low N vs. normal/stem: Low N: flowering | 7 |
| Low N vs. normal/stem: Low N: grain filling | 8 |

Table 66. Provided are the wheat transcriptome expression sets at low N versus (vs.) normal conditions.

Wheat yield components and vigor related parameters assessment—Plants were phenotyped on a daily basis following the parameters listed in Tables 67-68 below. Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

Grain yield (gr.)—At the end of the experiment all spikes of the pots were collected. The total grains from all spikes that were manually threshed were weighted. The grain yield was calculated by per plot or per plant.

Spike length and width analysis—At the end of the experiment the length and width of five chosen spikes per plant were measured using measuring tape excluding the awns.

Spike number analysis—The spikes per plant were counted.

Plant height—Each of the plants was measured for its height using measuring tape. Height was measured from ground level to top of the longest spike excluding awns at two time points at the Vegetative growth (30 days after sowing) and at harvest.

Spike weight—The biomass and spikes weight of each plot was separated, measured and divided by the number of plants.

Dry weight—total weight of the vegetative portion above ground (excluding roots) after drying at 70° C. in oven for 48 hours at two time points at the Vegetative growth (30 days after sowing) and at harvest.

Spikelet per spike—number of spikelets per spike was counted.

Root/Shoot Ratio—The Root/Shoot Ratio is calculated using Formula XXII described above.

Total No. of tillers—all tillers were counted per plot at two time points at the Vegetative growth (30 days after sowing) and at harvest.

Node number—number of nodes in the main stem.

Percent of reproductive tillers—the number of reproductive tillers barring a spike at harvest was divided by the total numbers of tillers.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—3 plants per plot were selected for measurement of root weight, root length and for counting the number of lateral roots formed.

Shoot FW (fresh weight)—weight of 3 plants per plot were recorded at different time-points.

Average Grain Area (cm$^2$)—At the end of the growing period the grains were separated from the spike. A sample of ~200 grains was weighted, photographed and images were processed using the below described image processing system. The grain area was measured from those images and was divided by the number of grains.

Average Grain Length and width (cm)—At the end of the growing period the grains were separated from the spike. A sample of ~200 grains was weighted, photographed and images were processed using the below described image processing system. The sum of grain lengths or width (longest axis) was measured from those images and was divided by the number of grains.

Average Grain perimeter (cm)—At the end of the growing period the grains were separated from the spike. A sample of ~200 grains was weighted, photographed and images were processed using the below described image processing system. The sum of grain perimeter was measured from those images and was divided by the number of grains.

Heading date—the day in which booting stage was observed was recorded and number of days from sowing to heading was calculated.

Relative water content—Fresh weight (FW) of three leaves from three plants each from different seed ID was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) is calculated according to Formula I above.

Tiller abortion rate (hd to F)—difference between tiller number at heading and tillet number at flowering divided by tiller number at heading.

Tiller abortion rate—difference between tiller number at harvest and tillet number at flowering divided by tiller number at flowering.

Grain N (H)—% N content of dry matter in the grain at harvest.

Head N (GF)—% N content of dry matter in the head at grainfilling.

Total shoot N—calculated as the % N content multiplied by the weight of plant shoot.

Total grain N—calculated as the % N content multiplied by the weight of plant grain yield.

NUE [kg/kg] (N use efficiency)—is the ratio between total grain yield per total N applied in soil.

NUpE [kg/kg] (N uptake efficiency)—is the ratio between total plant biomass per total N applied in soil.

Grain NUtE (N utilization efficiency)—is the ratio between grain yield per total shoot N Total NUtE—is the ratio between grain and shoot biomass per total shoot N.

Stem Volume—(lower stem is the lowest internode and upper stem is the internode just below the head)—calculated volume of internode part.

Stem density—is the ratio between internode dry weight and internode volume.

NHI (N harvest index)—is the ratio between total grain N and total plant N(=total shoot N+total grain N).

BPE (Biomass production efficiency)—is the ratio between plant biomass and total shoot N.

Grain Fill duration—the difference between number of days to maturity and number of days to flowering.

Harvest Index (for Wheat)—The harvest index was calculated using Formula XVIII described above.

Growth rate: the growth rate (GR) of Plant Height (Formula III described above), SPAD (Formula IV described above) and number of tillers (Formula V described above) were calculated with the indicated Formulas.

Specific N absorption—N absorbed per root biomass.

Specific root length—root biomass per root length.

Ratio low N/Normal: Represents ratio for the specified parameter of Drought condition results divided by Normal conditions results (maintenance of phenotype under drought in comparison to normal conditions).

TABLE 67

Wheat correlated parameters under normal and low N conditions (vectors)

| Correlation set | Correlation ID |
|---|---|
| 1000 grain weight [gr] | 1 |
| Avr spike DW (SS) [gr] | 2 |
| Avr spike DW (flowering) [gr] | 3 |
| Avr spike weight (harvest) [gr] | 4 |
| BPE | 5 |

TABLE 67-continued

Wheat correlated parameters under normal and low N conditions (vectors)

| Correlation set | Correlation ID |
|---|---|
| Fertile spikelets ratio | 6 |
| Grain area [mm²] | 7 |
| Grain fill duration [days] | 8 |
| Grains per plant | 9 |
| Grains per spike | 10 |
| Grains per spikelet | 11 |
| Grains weight per plant | 12 |
| Grains weight per spike | 13 |
| Harvest index | 14 |
| Leaf Area [cm²] | 15 |
| Leaf Average Width [cm] | 16 |
| Leaf Length [cm] | 17 |
| Leaf Perimeter [cm] | 18 |
| Leaves num at tittering | 19 |
| Leaves num flowering | 20 |
| N use efficiency | 21 |
| NHI | 22 |
| Node Num | 23 |
| Num days Heading (single) | 24 |
| Num days to anthesis | 25 |
| NupE | 26 |
| Peduncle length [cm] | 27 |
| Peduncle thickness [mm] | 28 |
| Plant height [cm] | 29 |
| RWC | 30 |
| Root length [cm] | 31 |
| Roots DW [gr] | 32 |
| SPAD early-mid grainfilling | 33 |
| SPAD flowering | 34 |
| SPAD mid-late grainfilling | 35 |
| Seminal roots | 36 |
| Shoot DW [gr] | 37 |
| Shoot/Root | 38 |
| Spike Area [cm²] | 39 |
| Spike Perimeter [cm] | 40 |
| Spike length [cm] | 41 |
| Spike width [cm] | 42 |
| Spikelets per spike | 43 |
| Tiller abortion rate | 44 |
| Tittering (Flowering) | 45 |
| Tittering (Heading) | 46 |
| Tittering (Tittering) | 47 |
| Total dry matter [gr] | 48 |
| Total Leaf Area [cm²] | 49 |
| Vegetative DW (Harvest) [gr] | 50 |
| field awns length [cm] | 51 |
| grain NUtE | 52 |
| grain protein [%] | 53 |
| peduncle volume [cm³] | 54 |
| specific N absorption [mg/gr] | 55 |
| specific root length [gr/cm] | 56 |
| tiller abortion rate (hd to F) | 57 |
| total NUtE | 58 |
| total grain N | 59 |
| total shoot N | 60 |

Table 67. Provided are the wheat correlated parameters. "TP" = time point; "DW" = dry weight; "FW" = fresh weight; "Low N" = Low Nitrogen; "Relative water content [percent]; "num" = number.

TABLE 68

Wheat correlated parameters under low N conditions vs. normal (vectors)

| Correlation set | Correlation ID |
|---|---|
| 1000 grain weight [gr] | 1 |
| BPE | 2 |
| Fertile spikelets ratio | 3 |
| Grain area [mm²] | 4 |
| Grain fill duration [days] | 5 |
| Grains per spike | 6 |
| Grains per spikelet | 7 |
| Grains weight per spike | 8 |
| N use efficiency | 9 |
| NHI | 10 |
| NupE | 11 |
| Peduncle thickness [mm] | 12 |
| Root length [cm] | 13 |
| SPAD early-mid grainfilling | 14 |
| SPAD flowering | 15 |
| Seminal roots | 16 |
| Spikelets per spike | 17 |
| Tiller abortion rate | 18 |
| grain NUtE | 19 |
| grain protein [%] | 20 |
| peduncle volume [cm³] | 21 |
| specific N absorption [mg/gr] | 22 |
| specific root length [gr/cm] | 23 |
| tiller abortion rate (hd to F) | 24 |
| total NUtE | 25 |
| total grain N [mg] | 26 |
| total shoot N [mg] | 27 |

Table 68. Provided are the wheat correlated parameters. "TP" = time point; "DW" = dry weight; "FW" = fresh weight; "Low N" = Low Nitrogen; "RWC" = Relative water content [percent].

Experimental Results

Fourteen different Wheat accessions were grown and characterized for different parameters as described above. Tables 67-68 describe the wheat correlated parameters. The average for each of the measured parameter was calculated using the JMP software and values are summarized in Tables 69-71 below. Subsequent correlation analysis between the various transcriptome sets and the average parameters was conducted (Tables 72-74). Follow, results were integrated to the database.

TABLE 69

Measured parameters of correlation IDs in wheat accessions under normal conditions

| Cor. ID/ Line | L-1 | L-2 | L-3 | L-4 | L-5 | L-6 | L-7 | L-8 | L-9 | L-10 | L-11 | L-12 | L-13 | L-14 |
|---|---|---|---|---|---|---|---|---|---|---|---|---|---|---|
| 1 | 24.81 | 19.31 | 11.63 | 29.68 | 9.24 | 21.05 | 22.14 | 15.08 | 13.61 | 20.71 | 33.52 | 16.66 | 12.74 | 13.43 |
| 2 | 1.52 | 0.84 | 1.49 | 2.64 | 1.23 | 1.45 | 0.66 | 1.59 | 1.67 | 1.96 | 2.89 | 1.64 | 0.62 | 0.42 |
| 3 | 5.67 | 0.28 | 0.31 | 4.28 | 0.36 | 0.24 | NA | 0.27 | 0.28 | 0.47 | 9.11 | 5.11 | NA | NA |
| 4 | 1.36 | 0.89 | 1.41 | 2.51 | 1.01 | 1.57 | 0.51 | 1.42 | 1.48 | 2.06 | 2.46 | 1.16 | 0.44 | 0.36 |
| 5 | 0.58 | 0.36 | 0.34 | 0.47 | 0.37 | 0.61 | NA | 0.58 | 0.27 | 0.56 | 0.83 | 0.76 | NA | NA |
| 6 | 74.09 | 73.31 | 81.68 | 88.72 | NA | 75.72 | NA | 83.70 | 87.05 | 78.99 | 86.83 | 75.82 | NA | NA |
| 7 | 0.20 | 0.17 | 0.15 | 0.18 | 0.17 | 0.19 | 0.14 | 0.20 | 0.17 | 0.18 | 0.20 | 0.17 | 0.11 | 0.11 |
| 8 | 27.89 | 31.43 | NA | 30.02 | NA | 27.75 | NA | 32.84 | NA | 29.20 | 27.10 | 26.48 | NA | NA |
| 9 | 94.23 | 68.65 | 122.44 | 123.90 | 151.23 | 105.13 | 16.30 | 106.83 | 103.09 | 141.63 | 139.23 | 85.38 | 13.10 | 18.57 |
| 10 | 19.69 | 13.29 | 22.77 | 37.16 | 21.52 | 19.41 | 5.98 | 20.00 | 23.41 | 30.03 | 34.00 | 18.49 | 5.07 | 6.60 |

TABLE 69-continued

Measured parameters of correlation IDs in wheat accessions under normal conditions

| Cor. ID/Line | L-1 | L-2 | L-3 | L-4 | L-5 | L-6 | L-7 | L-8 | L-9 | L-10 | L-11 | L-12 | L-13 | L-14 |
|---|---|---|---|---|---|---|---|---|---|---|---|---|---|---|
| 11 | 2.17 | 1.26 | 2.19 | 2.93 | NA | 1.64 | NA | 1.83 | 1.93 | 2.30 | 2.80 | 2.28 | NA | NA |
| 12 | 4.54 | 2.75 | 3.76 | 5.93 | 4.32 | 4.86 | 0.48 | 5.29 | 4.11 | 6.01 | 6.91 | 3.59 | 0.40 | 2.53 |
| 13 | 0.95 | 0.53 | 0.70 | 1.74 | 0.59 | 0.90 | 0.13 | 0.96 | 0.93 | 1.26 | 1.69 | 0.78 | 0.09 | 0.77 |
| 14 | 0.48 | 0.32 | 0.28 | 0.49 | 0.26 | 0.35 | 0.05 | 0.41 | 0.33 | 0.42 | 0.48 | 0.45 | 0.03 | 0.18 |
| 15 | 13.80 | 19.54 | NA | 22.46 | NA | 21.61 | NA | 25.44 | 23.31 | 20.79 | 16.25 | 13.46 | NA | NA |
| 16 | 0.86 | 0.92 | NA | 1.26 | NA | 1.05 | NA | 1.17 | 1.12 | 1.19 | 1.01 | 0.83 | NA | NA |
| 17 | 19.65 | 26.79 | NA | 22.03 | NA | 25.53 | NA | 27.80 | 25.91 | 21.67 | 19.98 | 19.81 | NA | NA |
| 18 | 41.46 | 53.77 | NA | 48.92 | NA | 53.08 | NA | 58.95 | 54.29 | 46.10 | 42.25 | 40.93 | NA | NA |
| 19 | 6.60 | 5.60 | 6.20 | 6.60 | 5.80 | 5.60 | 6.40 | 5.40 | 5.40 | 5.20 | 6.00 | 6.20 | 5.00 | 5.00 |
| 20 | 18.00 | 13.00 | 22.50 | 11.50 | 20.75 | 18.50 | NA | 11.00 | 23.75 | 19.00 | 12.50 | 18.75 | NA | NA |
| 21 | 0.05 | 0.03 | 0.04 | 0.06 | 0.04 | 0.05 | 0.00 | 0.05 | 0.04 | 0.06 | 0.07 | 0.04 | NA | NA |
| 22 | 0.48 | 0.31 | 0.24 | 0.43 | 0.26 | 0.45 | NA | 0.47 | 0.23 | 0.40 | 0.54 | 0.54 | NA | NA |
| 23 | 4.00 | 4.43 | 4.50 | 4.94 | 4.27 | 4.56 | NA | 4.21 | 4.57 | 4.94 | 4.69 | 3.94 | NA | NA |
| 24 | 60.22 | 69.88 | 85.25 | 61.78 | 83.00 | 65.78 | 105.00 | 68.75 | 74.29 | 68.75 | 58.89 | 57.11 | 106.25 | 77.00 |
| 25 | 69.11 | 73.00 | 85.25 | 69.56 | 86.38 | 71.25 | 105.00 | 71.88 | 78.00 | 72.38 | 67.33 | 68.67 | 105.00 | NA |
| 26 | 2.50 | 2.49 | 4.26 | 3.59 | 4.70 | 3.33 | NA | 3.28 | 4.78 | 3.51 | 3.04 | 1.81 | NA | NA |
| 27 | 27.28 | 30.39 | 21.21 | 31.71 | 26.15 | 34.07 | NA | 29.78 | 25.44 | 27.41 | 28.13 | 21.53 | NA | NA |
| 28 | 2.61 | 2.72 | 3.53 | 3.31 | 3.22 | 3.07 | NA | 3.06 | 3.25 | 3.51 | 3.02 | 1.92 | NA | NA |
| 29 | 45.59 | 63.41 | 69.33 | 62.91 | 68.03 | 79.43 | NA | 61.86 | 62.33 | 59.18 | 55.23 | 44.72 | NA | NA |
| 30 | 76.29 | NA | 82.03 | 76.11 | NA | 67.30 | NA | 73.33 | NA | 70.94 | 80.72 | 74.88 | NA | NA |
| 31 | 31.10 | 16.20 | 28.10 | 34.06 | 37.84 | 26.88 | 31.98 | 23.42 | 36.02 | 38.88 | 37.20 | 33.00 | 22.38 | 34.60 |
| 32 | 0.89 | 0.07 | 0.20 | 1.01 | 0.36 | 0.50 | 0.63 | 0.11 | 0.16 | 0.52 | 1.04 | 0.54 | 0.27 | 0.25 |
| 33 | 37.33 | 28.34 | NA | 38.71 | NA | 46.47 | NA | 38.62 | 35.80 | 45.58 | 46.95 | 35.32 | NA | NA |
| 34 | 38.75 | 31.09 | 43.30 | 40.29 | 45.54 | 44.93 | NA | 38.98 | 36.10 | 46.43 | 42.89 | 34.15 | NA | NA |
| 35 | 35.97 | NA | NA | 37.21 | NA | NA | NA | NA | NA | NA | 46.27 | 35.81 | NA | NA |
| 36 | 11.20 | 6.00 | 8.00 | 11.00 | 7.80 | 7.80 | 10.20 | 6.00 | 6.20 | 8.20 | 10.80 | 7.60 | 6.60 | 7.80 |
| 37 | 0.64 | 0.25 | 0.46 | 0.56 | 0.43 | 0.37 | 0.58 | 0.34 | 0.45 | 0.46 | 0.52 | 0.43 | 0.33 | 0.39 |
| 38 | 0.72 | 3.47 | 2.30 | 0.55 | 1.18 | 0.74 | 0.92 | 3.12 | 2.76 | 0.89 | 0.50 | 0.78 | 1.24 | 1.53 |
| 39 | 9.52 | 6.27 | 8.42 | 11.73 | 7.03 | 6.51 | 8.96 | 9.88 | 9.43 | 10.33 | 12.38 | 9.53 | 7.33 | 8.14 |
| 40 | 22.34 | 15.81 | 22.47 | 20.86 | 26.69 | 20.43 | 30.39 | 20.81 | 20.89 | 21.34 | 22.76 | 18.72 | 22.74 | 27.02 |
| 41 | 8.48 | 6.51 | 9.54 | 8.14 | 10.29 | 8.51 | 13.41 | 8.11 | 8.25 | 8.57 | 9.13 | 7.46 | 9.69 | 11.24 |
| 42 | 1.39 | 1.18 | 1.12 | 1.68 | 0.83 | 1.02 | 0.89 | 1.50 | 1.43 | 1.55 | 1.64 | 1.52 | 1.03 | 0.92 |
| 43 | 16.24 | 17.22 | 19.40 | 16.93 | NA | 17.42 | NA | 16.22 | 17.25 | 18.84 | 19.56 | 16.93 | NA | NA |
| 44 | 19.58 | −10.00 | 32.58 | −2.31 | 46.10 | 41.28 | NA | −25.88 | 34.26 | 27.41 | 1.18 | 25.60 | NA | NA |
| 45 | 6.00 | 4.75 | 7.75 | 3.25 | 13.13 | 9.75 | NA | 4.25 | 6.75 | 6.75 | 4.25 | 6.25 | NA | NA |
| 46 | 4.00 | 5.89 | 7.00 | 4.24 | 11.25 | 6.86 | 28.0 | 5.32 | 5.81 | 4.57 | 3.19 | 3.43 | 1.80 | 2.80 |
| 47 | 2.60 | 1.80 | 3.40 | 2.00 | 3.40 | 2.40 | 28.0 | 2.20 | 1.60 | 1.80 | 1.60 | 2.00 | 1.80 | 2.80 |
| 48 | 75.26 | 62.94 | 109.09 | 94.88 | 128.46 | 112.16 | 72.40 | 100.76 | 100.02 | 116.56 | 115.89 | 63.75 | 71.40 | 109.78 |
| 49 | 227.54 | 111.47 | NA | 176.24 | NA | 549.02 | NA | 431.85 | 231.67 | 188.34 | 186.23 | 269.35 | NA | NA |
| 50 | 23.35 | 28.68 | 57.53 | 30.57 | 70.98 | 52.25 | 61.70 | 39.99 | 47.89 | 44.82 | 37.47 | 20.86 | 63.48 | 102.17 |
| 51 | 6.46 | 8.45 | 6.33 | 6.56 | NA | 1.20 | NA | 8.57 | 7.47 | 7.41 | 6.17 | 5.30 | NA | NA |
| 52 | 0.04 | 0.02 | 0.01 | 0.03 | 0.01 | 0.03 | NA | 0.03 | 0.01 | 0.03 | 0.05 | 0.04 | NA | NA |
| 53 | 15.12 | 15.79 | 15.61 | 14.94 | 16.13 | 17.49 | NA | 16.67 | 15.14 | 13.42 | 13.60 | 15.44 | NA | NA |
| 54 | 1.46 | 1.76 | 2.08 | 2.64 | 2.13 | 2.51 | NA | 2.19 | 2.11 | 2.65 | 2.02 | 0.62 | NA | NA |
| 55 | 146.26 | 2391.37 | 1626.16 | 201.95 | 956.25 | 367.62 | NA | 1596.15 | 2272.98 | 404.96 | 133.54 | 154.31 | NA | NA |
| 56 | 0.03 | 0.00 | 0.01 | 0.03 | 0.01 | 0.02 | 0.02 | 0.00 | 0.00 | 0.01 | 0.03 | 0.02 | NA | NA |
| 57 | −50.00 | 19.42 | −10.71 | 23.31 | −16.67 | −42.19 | NA | 20.05 | −16.08 | −47.66 | −33.21 | −82.29 | NA | NA |
| 58 | 0.30 | 0.25 | 0.26 | 0.26 | 0.27 | 0.34 | NA | 0.31 | 0.21 | 0.33 | 0.38 | 0.35 | NA | NA |
| 59 | 120.32 | 76.17 | 102.85 | 155.55 | 122.14 | 149.13 | 0.00 | 154.79 | 109.19 | 141.44 | 164.82 | 97.18 | NA | NA |
| 60 | 129.59 | 172.80 | 322.79 | 203.44 | 347.42 | 183.50 | 0.00 | 173.47 | 368.56 | 209.50 | 139.48 | 83.97 | NA | NA |

Table 69. Provided are the values of each of the parameters (as described in Table 67 above) measured in wheat accessions (line; "L") under normal growth conditions. Growth conditions are specified in the experimental procedure section.
"NA" = not available.
"Cor."—correlation.

TABLE 70

Measured parameters of correlation IDs in wheat accessions under low N conditions

| Cor. ID/Line | L-1 | L-2 | L-3 | L-4 | L-5 | L-6 | L-7 | L-8 | L-9 | L-10 | L-11 | L-12 | L-13 | L-14 |
|---|---|---|---|---|---|---|---|---|---|---|---|---|---|---|
| 1 | 14.16 | 25.17 | 14.38 | 31.87 | 16.45 | 17.73 | 18.58 | 15.41 | 9.52 | 24.18 | 25.37 | 13.45 | 21.45 | 15.71 |
| 2 | 3.13 | 2.01 | 3.00 | 5.55 | 1.32 | 3.31 | 0.83 | 2.96 | 3.21 | 5.22 | 5.01 | 2.98 | 1.14 | 0.84 |
| 3 | 0.29 | 0.33 | 0.30 | 0.50 | 0.23 | 0.32 | NA | 0.37 | 0.34 | 0.70 | 0.58 | 0.27 | NA | NA |
| 4 | 1.36 | 0.99 | 1.76 | 2.66 | 1.12 | 1.45 | 0.79 | 1.46 | 1.52 | 2.60 | 2.50 | 1.26 | 1.09 | 0.71 |
| 5 | 0.92 | 0.93 | 0.74 | 1.01 | 0.68 | 0.89 | NA | 0.81 | 0.81 | 0.54 | 0.89 | 0.76 | NA | NA |
| 6 | 71.78 | 67.63 | 90.51 | 86.83 | 85.63 | 86.29 | 90.18 | 78.66 | 79.08 | 80.66 | 80.58 | 75.68 | 83.34 | 81.51 |
| 7 | 0.18 | 0.16 | 0.14 | 0.17 | 0.15 | 0.18 | 0.12 | 0.19 | 0.16 | 0.17 | 0.17 | 0.16 | 0.13 | 0.12 |
| 8 | 27.54 | 31.57 | 27.11 | 33.14 | 22.43 | 33.75 | NA | 31.43 | 31.93 | 31.14 | 30.37 | 27.98 | NA | NA |
| 9 | 78.65 | 67.44 | 95.73 | 71.48 | 81.53 | 70.10 | 23.67 | 57.70 | 74.75 | 83.60 | 81.60 | 73.13 | 67.66 | 24.52 |

TABLE 70-continued

Measured parameters of correlation IDs in wheat accessions under low N conditions

| Cor. ID/ Line | L-1 | L-2 | L-3 | L-4 | L-5 | L-6 | L-7 | L-8 | L-9 | L-10 | L-11 | L-12 | L-13 | L-14 |
|---|---|---|---|---|---|---|---|---|---|---|---|---|---|---|
| 10 | 25.30 | 20.12 | 39.44 | 43.83 | 21.07 | 24.53 | 8.38 | 19.91 | 24.84 | 46.51 | 40.93 | 22.11 | 22.96 | 7.78 |
| 11 | 2.69 | 1.73 | 2.94 | 3.57 | 1.93 | 2.45 | 0.69 | 1.85 | 2.29 | 3.58 | 3.62 | 2.26 | 2.02 | 0.63 |
| 12 | 3.43 | 2.50 | 2.98 | 3.29 | 2.54 | 2.93 | 1.26 | 2.77 | 2.63 | 3.27 | 3.41 | 2.75 | 1.50 | 0.92 |
| 13 | 1.06 | 0.75 | 1.22 | 2.02 | 0.64 | 0.97 | 0.40 | 0.93 | 0.88 | 1.82 | 1.67 | 0.83 | 0.51 | 0.20 |
| 14 | 0.51 | 0.41 | 0.38 | 0.50 | 0.27 | 0.38 | 0.09 | 0.39 | 0.33 | 0.42 | 0.46 | 0.45 | 0.17 | 0.14 |
| 15 | 15.28 | 20.23 | NA | 11.13 | NA | 15.37 | NA | 13.37 | 18.07 | 14.65 | 16.78 | 12.92 | NA | NA |
| 16 | 0.94 | 1.01 | NA | 0.80 | NA | 0.90 | NA | 0.81 | 0.98 | 0.94 | 0.93 | 0.92 | NA | NA |
| 17 | 20.01 | 24.79 | NA | 16.84 | NA | 21.17 | NA | 19.79 | 22.14 | 19.60 | 22.26 | 18.02 | NA | NA |
| 18 | 43.99 | 53.54 | NA | 35.89 | NA | 43.81 | NA | 41.85 | 46.51 | 45.20 | 46.58 | 38.43 | NA | NA |
| 19 | 6.40 | 6.40 | 6.80 | 6.00 | 6.00 | 6.20 | 5.00 | 5.60 | 5.40 | 6.00 | 6.00 | 6.00 | 5.80 | 5.40 |
| 20 | NA | NA | NA | NA | 6.25 | NA | NA | NA | NA | NA | NA | NA | NA | NA |
| 21 | 0.14 | 0.10 | 0.12 | 0.13 | 0.10 | 0.12 | 0.05 | 0.11 | 0.11 | 0.13 | 0.14 | 0.11 | NA | NA |
| 22 | 0.54 | 0.49 | 0.42 | 0.66 | 0.28 | 0.56 | NA | 0.56 | 0.47 | 0.45 | 0.66 | 0.51 | NA | NA |
| 23 | 4.13 | 4.08 | 4.44 | 4.75 | 3.94 | 3.81 | NA | 3.31 | 4.25 | 3.53 | 4.56 | 4.56 | NA | NA |
| 24 | 57.56 | 67.11 | 76.22 | 61.33 | 80.63 | 65.11 | 109.00 | 65.56 | 70.00 | 66.44 | 58.44 | 53.11 | 103.56 | 109.00 |
| 25 | 68.89 | 73.00 | 77.89 | 68.00 | 82.57 | 71.25 | 105.00 | 71.00 | 72.57 | 73.00 | 67.78 | 68.44 | 101.13 | 105.00 |
| 26 | 5.03 | 3.92 | 6.22 | 6.07 | 7.61 | 5.99 | 0.00 | 6.24 | 6.00 | 8.40 | 7.49 | 5.44 | NA | NA |
| 27 | 25.91 | 39.58 | 44.70 | 32.31 | 20.79 | 43.84 | NA | 42.72 | 37.81 | 32.50 | 27.66 | 24.56 | NA | NA |
| 28 | 2.45 | 2.85 | 3.54 | 3.59 | 2.88 | 3.42 | NA | 3.16 | 3.23 | 3.69 | 3.51 | 2.44 | NA | NA |
| 29 | 47.48 | 81.12 | 85.36 | 61.31 | 62.29 | 94.38 | NA | 74.44 | 80.19 | 64.56 | 61.81 | 54.06 | NA | NA |
| 30 | 78.08 | 75.04 | 84.41 | 84.12 | NA | 82.70 | NA | 72.54 | 53.64 | 84.04 | 79.53 | 86.25 | NA | NA |
| 31 | 34.60 | 33.36 | 33.10 | 32.00 | 38.60 | 41.90 | 36.90 | 32.16 | 32.90 | 37.30 | 36.44 | 27.40 | 32.20 | 33.00 |
| 32 | 0.78 | 0.63 | 0.28 | 1.10 | 0.48 | 0.68 | 0.61 | 0.65 | 0.75 | 1.51 | 1.05 | 0.72 | 0.40 | 0.60 |
| 33 | 41.11 | 26.03 | NA | 38.94 | NA | 38.05 | NA | 32.06 | 31.48 | 41.45 | 45.34 | 35.17 | NA | NA |
| 34 | 40.38 | 32.17 | 38.19 | 42.45 | 37.49 | 42.30 | NA | 38.79 | 36.31 | NA | 45.14 | 34.60 | NA | NA |
| 35 | 33.10 | NA | NA | 32.57 | NA | NA | NA | NA | NA | NA | 37.87 | 29.01 | NA | NA |
| 36 | 11.20 | 8.00 | 10.00 | 96.0 | 7.00 | 8.80 | 8.20 | 9.20 | 8.80 | 11.40 | 10.40 | 10.80 | 7.00 | 7.40 |
| 37 | 0.45 | 0.48 | 0.64 | 0.51 | 0.39 | 0.55 | 0.48 | 0.66 | 0.59 | 0.61 | 0.60 | 0.63 | 0.43 | 0.43 |
| 38 | 0.58 | 0.77 | 2.24 | 0.47 | 0.81 | 0.81 | 0.79 | 1.01 | 0.80 | 0.40 | 0.57 | 0.87 | 1.06 | 0.72 |
| 39 | 8.05 | 5.90 | 7.31 | 11.08 | 8.29 | 7.38 | 9.73 | 8.21 | 7.77 | 10.74 | 10.17 | 7.26 | 7.27 | 9.72 |
| 40 | 18.48 | 15.54 | 19.57 | 19.84 | 23.88 | 20.11 | 32.44 | 18.68 | 18.65 | 20.31 | 18.97 | 16.29 | 21.77 | 30.30 |
| 41 | 7.32 | 6.31 | 8.17 | 7.87 | 10.05 | 8.70 | 14.36 | 7.00 | 6.99 | 8.08 | 7.44 | 6.43 | 9.01 | 13.43 |
| 42 | 1.29 | 1.10 | 1.13 | 1.51 | 1.03 | 1.07 | 0.92 | 1.40 | 1.40 | 1.51 | 1.57 | 1.33 | 1.12 | 1.05 |
| 43 | 16.20 | 16.29 | 17.49 | 16.44 | 17.97 | 16.49 | 20.62 | 15.16 | 17.20 | 18.53 | 18.00 | 17.13 | 18.38 | 18.97 |
| 44 | 17.33 | 36.36 | 46.11 | 33.00 | 51.94 | 53.20 | NA | 35.00 | 52.00 | 44.62 | 31.67 | 16.88 | NA | NA |
| 45 | 3.75 | 5.50 | 4.50 | 2.50 | 7.75 | 6.25 | NA | 4.50 | 6.25 | 3.25 | 3.00 | 4.00 | NA | NA |
| 46 | 41.4 | 42.2 | 4.29 | 3.00 | 6.05 | 5.29 | 2.40 | 4.76 | 3.90 | 3.65 | 3.19 | 4.10 | 3.20 | 2.40 |
| 47 | 18.0 | 2.60 | 4.20 | 1.60 | 3.20 | 2.80 | 2.40 | 3.20 | 2.40 | 2.80 | 2.00 | 2.00 | 3.20 | 2.40 |
| 48 | 52.66 | 46.55 | 67.18 | 52.36 | 92.33 | 58.79 | 89.95 | 55.21 | 64.50 | 62.16 | 56.55 | 51.08 | 84.82 | 91.80 |
| 49 | 201.42 | 190.89 | NA | 182.97 | NA | 148.36 | NA | 100.45 | 237.33 | 109.86 | 273.83 | 230.90 | NA | NA |
| 50 | 19.12 | 19.55 | 40.05 | 17.70 | 59.04 | 28.30 | 74.95 | 22.35 | 28.23 | 24.71 | 19.81 | 19.47 | 63.20 | 75.93 |
| 51 | 5.77 | 7.70 | 6.64 | 6.17 | NA | NA | NA | 9.31 | 7.49 | 5.63 | 5.46 | 4.75 | NA | NA |
| 52 | 0.06 | 0.05 | 0.03 | 0.06 | 0.02 | 0.04 | NA | 0.04 | 0.03 | 0.03 | 0.05 | 0.04 | NA | NA |
| 53 | 8.60 | 9.96 | 9.81 | 9.58 | 7.09 | 9.80 | NA | 9.46 | 9.69 | 9.02 | 10.20 | 10.94 | NA | NA |
| 54 | 1.22 | 2.52 | 4.39 | 3.26 | 1.36 | 4.02 | 0.00 | 3.34 | 3.09 | 3.46 | 2.68 | 1.14 | NA | NA |
| 55 | 161.96 | 155.87 | 547.22 | 138.06 | 399.44 | 219.78 | NA | 238.94 | 201.24 | 139.26 | 178.14 | 188.90 | NA | NA |
| 56 | 0.02 | 0.02 | 0.01 | 0.03 | 0.01 | 0.02 | NA | 0.02 | 0.02 | 0.04 | 0.03 | 0.03 | NA | NA |
| 57 | 9.48 | −30.26 | −5.00 | 16.67 | −28.15 | −18.24 | NA | 5.50 | −60.06 | 10.96 | 5.97 | 2.33 | NA | NA |
| 58 | 0.42 | 0.47 | 0.43 | 0.34 | 0.48 | 0.39 | NA | 0.35 | 0.43 | 0.30 | 0.30 | 0.38 | NA | NA |
| 59 | 68.42 | 48.01 | 64.65 | 99.72 | 53.69 | 83.57 | NA | 87.82 | 69.89 | 95.05 | 123.62 | 68.89 | NA | NA |
| 60 | 57.37 | 50.04 | 90.78 | 52.09 | 136.69 | 66.27 | NA | 68.21 | 80.06 | 114.89 | 63.65 | 67.08 | NA | NA |

Table 70. Provided are the values of each of the parameters (as described in Table 67 above) measured in Barley accessions (lines; "L") under low N growth conditions. Growth conditions are specified in the experimental procedure section.
"NA" = not available.
"Cor."—correlation.

TABLE 71

Additional measured parameters of correlation IDs in wheat accessions under low N vs. normal conditions

| Cor. ID/ Line | L-1 | L-2 | L-3 | L-4 | L-5 | L-6 | L-7 | L-8 | L-9 | L-10 | L-11 | L-12 | L-13 | L-14 |
|---|---|---|---|---|---|---|---|---|---|---|---|---|---|---|
| 1 | 0.57 | 1.30 | 1.24 | 1.07 | 1.78 | 0.84 | 0.84 | 1.02 | 0.70 | 1.17 | 0.76 | 0.81 | 1.68 | 1.17 |
| 2 | 1.58 | 2.55 | 2.19 | 2.16 | 1.83 | 1.45 | NA | 1.39 | 2.97 | 0.97 | 1.07 | 1.00 | NA | NA |
| 3 | 0.97 | 0.92 | 1.11 | 0.98 | NA | 1.14 | NA | 0.94 | 0.91 | 1.02 | 0.93 | 1.00 | NA | NA |
| 4 | 0.89 | 0.99 | 0.90 | 0.95 | 0.91 | 0.95 | 0.88 | 0.94 | 0.92 | 0.90 | 0.87 | 0.92 | 1.17 | 1.08 |
| 5 | 0.99 | 1.00 | NA | 1.10 | NA | 1.22 | NA | 0.96 | NA | 1.07 | 1.12 | 1.06 | NA | NA |
| 6 | 1.28 | 1.51 | 1.73 | 1.18 | 0.98 | 1.26 | 1.40 | 1.00 | 1.06 | 1.55 | 1.20 | 1.20 | 4.52 | 1.18 |
| 7 | 1.24 | 1.37 | 1.34 | 1.22 | NA | 1.49 | NA | 1.01 | 1.19 | 1.55 | 1.29 | 0.99 | NA | NA |

TABLE 71-continued

Additional measured parameters of correlation IDs in wheat accessions under low N vs. normal conditions

| Cor. ID/Line | L-1 | L-2 | L-3 | L-4 | L-5 | L-6 | L-7 | L-8 | L-9 | L-10 | L-11 | L-12 | L-13 | L-14 |
|---|---|---|---|---|---|---|---|---|---|---|---|---|---|---|
| 8 | 1.12 | 1.41 | 1.75 | 1.16 | 1.09 | 1.08 | 3.03 | 0.97 | 0.95 | 1.44 | 0.99 | 1.07 | 5.54 | 0.26 |
| 9 | 3.03 | 3.63 | 3.17 | 2.22 | 2.35 | 2.41 | 10.62 | 2.10 | 2.56 | 2.18 | 1.98 | 3.07 | NA | NA |
| 10 | 1.13 | 1.60 | 1.72 | 1.52 | 1.08 | 1.24 | NA | 1.19 | 2.04 | 1.12 | 1.22 | 0.94 | NA | NA |
| 11 | 2.01 | 1.58 | 1.46 | 1.69 | 1.62 | 1.80 | NA | 1.90 | 1.26 | 2.39 | 2.46 | 3.00 | NA | NA |
| 12 | 0.94 | 1.05 | 1.00 | 1.08 | 0.89 | 1.11 | NA | 1.03 | 0.99 | 1.05 | 1.16 | 1.27 | NA | NA |
| 13 | 1.11 | 2.06 | 1.18 | 0.94 | 1.02 | 1.56 | 1.15 | 1.37 | 0.91 | 0.96 | 0.98 | 0.83 | 1.44 | 0.95 |
| 14 | 1.10 | 0.92 | NA | 1.01 | NA | 0.82 | NA | 0.83 | 0.88 | 0.91 | 0.97 | 1.00 | NA | NA |
| 15 | 1.04 | 1.03 | 0.88 | 1.05 | 0.82 | 0.94 | NA | 1.00 | 1.01 | NA | 1.05 | 1.01 | NA | NA |
| 16 | 1.00 | 1.33 | 1.25 | 0.87 | 0.90 | 1.13 | 0.80 | 1.53 | 1.42 | 1.39 | 0.96 | 1.42 | 1.06 | 0.95 |
| 17 | 1.00 | 0.95 | 0.90 | 0.97 | NA | 0.95 | NA | 0.93 | 1.00 | 0.98 | 0.92 | 1.01 | NA | NA |
| 18 | 0.89 | −3.64 | 1.42 | −14.30 | 1.13 | 1.29 | NA | −1.35 | 1.52 | 1.63 | 26.92 | 0.66 | NA | NA |
| 19 | 1.71 | 3.14 | 2.82 | 2.16 | 1.50 | 1.67 | NA | 1.33 | 2.94 | 0.99 | 1.08 | 0.96 | NA | NA |
| 20 | 0.57 | 0.63 | 0.63 | 0.64 | 0.44 | 0.56 | NA | 0.57 | 0.64 | 0.67 | 0.75 | 0.71 | NA | NA |
| 21 | 0.84 | 1.43 | 2.11 | 1.24 | 0.64 | 1.60 | NA | 1.53 | 1.46 | 1.31 | 1.33 | 1.84 | NA | NA |
| 22 | 1.11 | 0.07 | 0.34 | 0.68 | 0.42 | 0.60 | NA | 0.15 | 0.09 | 0.34 | 1.33 | 1.22 | NA | NA |
| 23 | 0.79 | 4.23 | 1.21 | 1.16 | 1.29 | 0.88 | NA | 4.38 | 5.03 | 3.04 | 1.03 | 1.59 | NA | NA |
| 24 | −0.19 | −1.56 | 0.47 | 0.71 | 1.69 | 0.43 | NA | 0.27 | 3.73 | −0.23 | −0.18 | −0.03 | NA | NA |
| 25 | 1.39 | 1.88 | 1.69 | 1.31 | 1.77 | 1.16 | NA | 1.15 | 2.05 | 0.89 | 0.79 | 1.07 | NA | NA |
| 26 | 0.57 | 0.63 | 0.63 | 0.64 | 0.44 | 0.56 | NA | 0.57 | 0.64 | 0.67 | 0.75 | 0.71 | NA | NA |
| 27 | 0.44 | 0.29 | 0.28 | 0.26 | 0.39 | 0.36 | NA | 0.39 | 0.22 | 0.55 | 0.46 | 0.80 | NA | NA |

Table 71.
Provided are the values of each of the parameters (as described in Table 68 above) measured in wheat accessions (lines; "L") under low N vs. normal growth conditions. Growth conditions are specified in the experimental procedure section.
"NA" = not available.
"Cor."—correlation.

TABLE 72

Correlation between the expression level of selected genes of some embodiments of the invention in various tissues and the phenotypic performance under low nitrogen fertilization conditions across wheat accessions

| Gene Name | R | P value | Exp. set | Cor. Set ID | Gene Name | R | P value | Exp. set | Cor. Set ID |
|---|---|---|---|---|---|---|---|---|---|
| WNU102 | 0.783 | 4.41E−03 | 8 | 10 | WNU103 | 0.723 | 1.05E−01 | 4 | 30 |
| WNU102 | 0.946 | 4.36E−03 | 4 | 29 | WNU103 | 0.735 | 1.00E−02 | 1 | 57 |
| WNU102 | 0.715 | 1.10E−01 | 4 | 18 | WNU103 | 0.718 | 1.28E−02 | 1 | 4 |
| WNU102 | 0.782 | 6.60E−02 | 4 | 44 | | | | | |
| WNU102 | 0.738 | 2.31E−02 | 6 | 33 | | | | | |
| WNU103 | 0.776 | 4.02E−02 | 3 | 24 | | | | | |
| WNU103 | 0.773 | 4.17E−02 | 3 | 44 | | | | | |
| WNU103 | 0.787 | 3.59E−02 | 3 | 41 | | | | | |
| WNU103 | 0.730 | 1.65E−02 | 7 | 24 | | | | | |

(P value column first entries: 1.50E−02, 5.20E−02, 2.05E−02, 2.88E−02, 3.19E−02, 7.24E−02, 2.88E−03, 1.99E−02, 6.51E−02; Exp set: 5, 4, 4, 4, 4, 3, 3, 3, 3; Cor Set ID: 3, 24, 47, 25, 27, 60, 31, 40, 48)

Table 72.
"Cor. ID"—correlation set ID according to the correlated parameters in Table 67 above.
"Exp. Set"—Expression set.
"R" = Pearson correlation coefficient;
"P" = p value.

Second block P values: 9.67E−03, 4.67E−03, 4.41E−03; Exp set: 7, 1, 1; Cor Set ID: 44, 2, 13.

TABLE 73

Correlation between the expression level of selected genes of some embodiments of the invention in various tissues and the phenotypic performance under normal fertilization conditions across wheat accessions

| Gene Name | R | P value | Exp. set | Cor. Set ID | Gene Name | R | P value | Exp. set | Cor. Set ID |
|---|---|---|---|---|---|---|---|---|---|
| WNU102 | 0.801 | 3.04E−03 | 3 | 24 | WNU102 | 0.715 | 4.64E−02 | 3 | 8 |
| WNU102 | 0.704 | 3.43E−02 | 3 | 18 | WNU102 | 0.742 | 8.87E−03 | 3 | 25 |
| WNU102 | 0.782 | 1.29E−02 | 3 | 17 | WNU102 | 0.845 | 2.09E−03 | 9 | 43 |
| WNU102 | 0.913 | 1.11E−02 | 5 | 24 | WNU102 | 0.731 | 9.87E−02 | 5 | 46 |
| WNU102 | 0.899 | 1.48E−02 | 5 | 25 | WNU102 | 0.802 | 5.52E−02 | 5 | 51 |
| WNU102 | 0.717 | 2.96E−02 | 6 | 43 | WNU103 | 0.728 | 1.70E−02 | 2 | 47 |
| WNU103 | 0.796 | 3.23E−02 | 7 | 30 | WNU103 | 0.705 | 2.27E−02 | 7 | 47 |
| WNU103 | 0.768 | 9.52E−03 | 7 | 40 | WNU103 | 0.735 | 1.55E−02 | 7 | 41 |
| WNU103 | 0.739 | 9.33E−03 | 3 | 1 | WNU103 | 0.718 | 1.28E−02 | 3 | 32 |
| WNU103 | 0.782 | 4.46E−03 | 3 | 14 | WNU103 | 0.871 | 4.76E−04 | 3 | 3 |
| WNU103 | 0.866 | 5.70E−04 | 3 | 52 | WNU103 | 0.747 | 8.31E−03 | 3 | 22 |
| WNU103 | 0.784 | 4.26E−03 | 3 | 5 | WNU103 | 0.710 | 1.44E−02 | 3 | 58 |
| WNU103 | 0.733 | 1.58E−02 | 1 | 14 | WNU103 | 0.735 | 1.54E−02 | 1 | 39 |
| WNU103 | 0.752 | 1.20E−02 | 1 | 2 | WNU103 | 0.778 | 1.35E−02 | 1 | 11 |

TABLE 73-continued

Correlation between the expression level of selected genes of some embodiments of the invention in various tissues and the phenotypic performance under normal fertilization conditions across wheat accessions

| Gene Name | R | P value | Exp. set | Cor. Set ID | Gene Name | R | P value | Exp. set | Cor. Set ID |
|---|---|---|---|---|---|---|---|---|---|
| WNU103 | 0.784 | 7.24E−03 | 1 | 13 | WNU103 | 0.707 | 2.22E−02 | 1 | 4 |
| WNU103 | 0.783 | 7.41E−03 | 4 | 24 | WNU103 | 0.797 | 5.77E−03 | 4 | 25 |
| WNU103 | 0.753 | 1.20E−02 | 9 | 19 | WNU103 | 0.784 | 6.50E−02 | 5 | 1 |
| WNU103 | 0.796 | 5.81E−02 | 5 | 32 | WNU103 | 0.796 | 5.80E−02 | 5 | 6 |
| WNU103 | 0.820 | 4.57E−02 | 5 | 56 | WNU103 | 0.705 | 1.17E−01 | 5 | 2 |
| WNU103 | 0.789 | 6.18E−02 | 5 | 36 | WNU103 | 0.737 | 9.45E−02 | 5 | 11 |
| WNU103 | 0.765 | 7.63E−02 | 5 | 13 | WNU103 | 0.723 | 1.04E−01 | 5 | 19 |
| WNU103 | 0.703 | 1.19E−01 | 5 | 10 | WNU103 | 0.744 | 8.64E−03 | 8 | 1 |
| WNU103 | 0.730 | 1.07E−02 | 8 | 32 | WNU103 | 0.768 | 5.73E−03 | 8 | 14 |
| WNU103 | 0.798 | 3.21E−03 | 8 | 56 | WNU103 | 0.702 | 1.60E−02 | 8 | 3 |
| WNU103 | 0.781 | 4.53E−03 | 8 | 52 | WNU103 | 0.850 | 9.09E−04 | 8 | 22 |
| WNU103 | 0.717 | 1.30E−02 | 8 | 5 | | | | | |

Table 73.
"Cor. ID"—correlation set ID according to the correlated parameters in Table 67 above.
"Exp. Set"—Expression set.
"R" = Pearson correlation coefficient;
"P" = p value.

TABLE 74

Correlation between the expression level of selected genes of some embodiments of the invention in various tissues and the phenotypic performance under low N vs. normal fertilization conditions across wheat accessions

| Gene Name | R | P value | Exp. set | Cor. Set ID | Gene Name | R | P value | Exp. set | Cor. Set ID |
|---|---|---|---|---|---|---|---|---|---|
| WNU102 | 0.702 | 2.35E−02 | 2 | 7 | WNU102 | 0.821 | 2.36E−02 | 3 | 11 |
| WNU102 | 0.894 | 6.64E−03 | 3 | 27 | WNU102 | 0.798 | 3.15E−02 | 3 | 12 |
| WNU102 | 0.724 | 1.17E−02 | 8 | 8 | WNU102 | 0.733 | 1.02E−02 | 8 | 6 |
| WNU102 | 0.892 | 1.68E−02 | 4 | 1 | WNU102 | 0.964 | 1.93E−03 | 4 | 23 |
| WNU102 | 0.778 | 6.86E−02 | 4 | 8 | WNU102 | 0.811 | 5.01E−02 | 4 | 6 |
| WNU102 | 0.701 | 1.62E−02 | 6 | 11 | WNU102 | 0.920 | 5.92E−05 | 6 | 22 |
| WNU102 | 0.704 | 3.43E−02 | 6 | 14 | WNU103 | 0.782 | 6.61E−02 | 3 | 7 |
| WNU103 | 0.745 | 1.34E−02 | 7 | 10 | WNU103 | 0.726 | 1.74E−02 | 7 | 2 |
| WNU103 | 0.709 | 2.16E−02 | 7 | 25 | WNU103 | 0.759 | 7.99E−02 | 4 | 11 |
| WNU103 | 0.834 | 3.88E−02 | 4 | 27 | WNU103 | 0.790 | 6.15E−02 | 4 | 12 |
| WNU103 | 0.802 | 5.49E−02 | 4 | 21 | | | | | |

Table 74.
"Cor. ID"—correlation set ID according to the correlated parameters in Table 67 above.
"Exp. Set"—Expression set.
"R" = Pearson correlation coefficient;
"P" = p value.

Example 14

Gene Cloning and Generation of Binary Vectors for Plant Expression

To validate their role in improving yield, selected genes were over-expressed in plants, as follows.

Cloning Strategy

Selected genes from those presented in Examples 1-13 hereinabove were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from leaves, roots or other plant tissues, growing under normal/limiting or stress conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York.) which are well known to those skilled in the art. PCR products were purified using PCR purification kit (Qiagen).

Usually, 2 sets of primers were prepared for the amplification of each gene, via nested PCR (if required). Both sets of primers were used for amplification on a cDNA. In case no product was obtained, a nested PCR reaction was performed. Nested PCR was performed by amplification of the gene using external primers and then using the produced PCR product as a template for a second PCR reaction, where the internal set of primers were used. Alternatively, one or two of the internal primers were used for gene amplification, both in the first and the second PCR reactions (meaning only 2-3 primers are designed for a gene). To facilitate further cloning of the cDNAs, an 8-12 base pairs (bp) extension was added to the 5' of each internal primer. The primer extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc) according to the sites designed in the primers. Each digested/undigested PCR product was inserted into a high copy vector pUC19 (New England BioLabs Inc], or into plasmids originating from this vector. In some cases the undigested PCR product was inserted into pCR-Blunt II-TOPO (Invitrogen) or into pJET1.2 (CloneJET PCR Cloning Kit, Thermo Scientific) or directly into the binary vector. The digested/undigested products and the linearized plasmid vector were ligated using T4 DNA ligase enzyme (Roche, Switzerland or other manufacturers). In cases where pCR-Blunt II-TOPO is used no T4 ligase is needed.

Sequencing of the inserted genes was performed, using the ABI 377 sequencer (Applied Biosystems). In some cases, after confirming the sequences of the cloned genes, the cloned cDNA was introduced into a modified pGI binary vector containing the At6669 promoter (e.g., pQFNc) and the NOS terminator (SEQ ID NO: 6929) via digestion with appropriate restriction endonucleases.

Figure 9A:
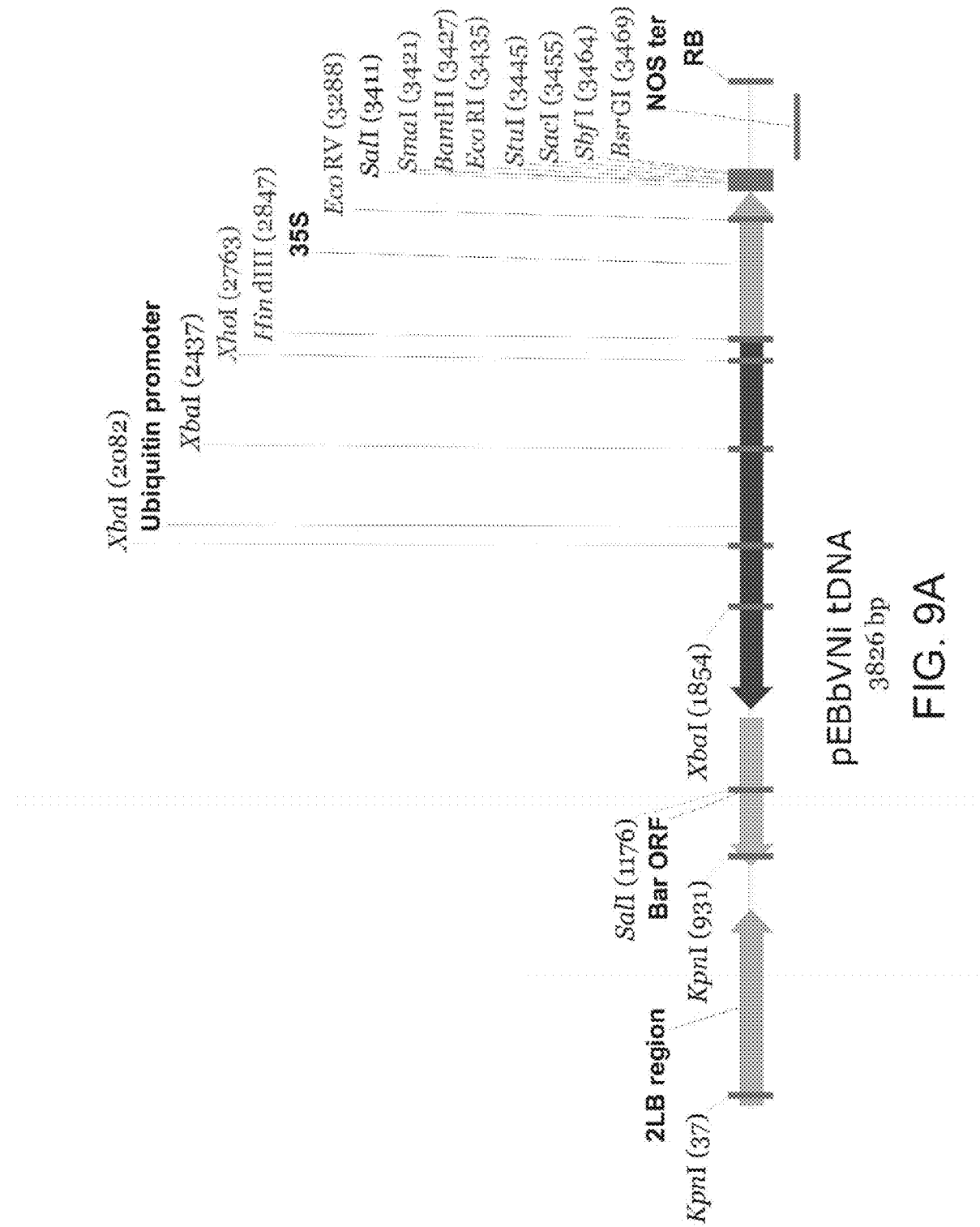
FIGS. 9A-B are schematic illustrations of the pEBbVNi tDNA (FIG. 9A) and the pEBbNi tDNA (FIG. 9B) plasmids used in the *Brachypodium* experiments. pEBbVNi tDNA (FIG. 9A) was used for expression of the isolated polynucleotide sequences of some embodiments of the invention in *Brachypodium*. pEBbNi tDNA (FIG. 9B) was used for transformation into *Brachypodium* as a negative control. "RB"=right border; "2LBregion"=2 repeats of left border; "35S"=35S promoter (SEQ ID NO:6930); "NOS ter"=nopaline synthase terminator; "Bar ORF"—BAR open reading frame (GenBank Accession No. JQ293091.1; SEQ ID NO:7121); The isolated polynucleotide sequences of some embodiments of the invention were cloned into the Multiple cloning site of the vector using one or more of the indicated restriction enzyme sites.

In case of Brachypodium transformation, after confirming the sequences of the cloned genes, the cloned cDNAs were introduced into pEBbVNi (FIG. 9A) containing 35S promoter (SEQ ID NO: 6930) and the NOS terminator (SEQ ID NO:6929) via digestion with appropriate restriction endonucleases. The genes were cloned downstream to the 35S promoter and upstream to the NOS terminator.

Several DNA sequences of the selected genes were synthesized by GeneArt (Life Technologies, Grand Island, N.Y., USA). Synthetic DNA was designed in silico. Suitable restriction enzymes sites were added to the cloned sequences at the 5' end and at the 3' end to enable later cloning into the desired binary vector.

Binary vectors—The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI is similar to pPI, but the original gene in the backbone is GUS-Intron and not GUS.

The modified pGI vector (e.g., pQFN, pQFNc, pQYN_6669, pQNa_RP, pQFYN or pQXNc) is a modified version of the pGI vector in which the cassette is inverted between the left and right borders so the gene and its corresponding promoter are close to the right border and the NPTII gene is close to the left border.

At6669, the new Arabidopsis thaliana promoter sequence (SEQ ID NO:6918) was inserted in the modified pGI binary vector, upstream to the cloned genes, followed by DNA ligation and binary plasmid extraction from positive E. coli colonies, as described above. Colonies were analyzed by PCR using the primers covering the insert which were designed to span the introduced promoter and gene. Positive plasmids were identified, isolated and sequenced.

pEBbVNi (FIG. 9A) is a modified version of pJJ2LB in which the Hygromycin resistance gene was replaced with the BAR gene which confers resistance to the BASTA herbicide [BAR gene coding sequence is provided in GenBank Accession No. JQ293091.1 (SEQ ID NO:7121); further description is provided in Akama K, et al. "*Efficient Agrobacterium-mediated transformation of Arabidopsis thaliana using the bar gene as selectable marker*", Plant Cell Rep. 1995, 14(7):450-4; Christiansen P, et al. "*A rapid and efficient transformation protocol for the grass Brachypodium distachyon*", Plant Cell Rep. 2005 March; 23(10-11): 751-8. Epub 2004 Oct. 19; and Păcurar D I, et al. "*A high-throughput Agrobacterium-mediated transformation system for the grass model species Brachypodium distachyon L*", Transgenic Res. 2008 17(5):965-75; each of which is fully incorporated herein by reference in its entirety]. The pEBbVNi construct contains the 35S promoter (SEQ ID NO:6930). pJJ2LB is a modified version of pCambia0305.2 (Cambia).

In case genomic DNA was cloned, the genes were amplified by direct PCR on genomic DNA extracted from leaf tissue using the DNAeasy kit (Qiagen Cat. No. 69104). Selected genes cloned by the present inventors are provided in Table 75 below.

TABLE 75

Genes cloned in High copy number plasmids or in binary vectors and the primers used for cloning of the genes

| Gene Name | High copy plasmid | Organism | SEQ ID NOs of the primers employed | Polyn. SEQ ID NO: | Polyp. SEQ ID NO: |
|---|---|---|---|---|---|
| WNU1 | pMA-RQ_WNU1_GA | | | 112 | 202 |
| WNU2 | pUC19c_WNU2 | SORGHUM Sorghum bicolor | 7030, 6949, 7030, 6949 | 113 | 203 |
| WNU3 | pUC19c_WNU3 | SORGHUM Sorghum bicolor | 7062, 6989, 7062, 6989 | 114 | 204 |
| WNU5 | pQFNc_WNU5 | ARABIDOPSIS Arabidopsis thalia | | 115 | 205 |
| WNU6 | pQFNc_WNU6 | ARABIDOPSIS Arabidopsis thalia | 7089, 7011, 7085, 6953 | 116 | 206 |
| WNU7 | pMA-RQ_WNU7_GA | | | 117 | 207 |
| WNU8 | pUC19c_WNU8 | BARLEY Hordeum vulgare L. | 7058, 6961, 7058, 7002 | 118 | 208 |
| WNU9 | pMA-RQ_WNU9_GA | | | 119 | 209 |
| WNU11 | pQFNc_WNU11 | BARLEY Hordeum vulgare L. | 7069, 7103, 7087, 7101 | 120 | 211 |
| WNU12 | pUC19_WNU12 | BARLEY Hordeum vulgare L. | 7016, 7113, 7016, 7113 | 121 | 305 |
| WNU13 | pQFNc_WNU13 | BARLEY Hordeum vulgare L. | 7086, 7115, 7045, 7118 | 122 | 213 |
| WNU14 | pUC19c_WNU14 | BARLEY Hordeum vulgare L. | 7041, 6991, 7077, 6959 | 123 | 306 |
| WNU15 | pMA-RQ_WNU15_GA | | | 124 | 215 |
| WNU16 | pUC19c_WNU16 | BARLEY Hordeum vulgare L. | 7060, 6984, 7060, 6984 | 125 | 216 |
| WNU17 | pMA-T_WNU17_GA | | | 126 | 217 |
| WNU18 | pMA-T_WNU18_GA | | | 127 | 218 |
| WNU19 | pUC19c_WNU19 | BARLEY Hordeum vulgare L. | 7043, 6951, 7043, 6980 | 128 | 219 |
| WNU20 | pMA-T_WNU20_GA | | | 129 | 220 |
| WNU21 | pQFNc_WNU21 | BARLEY Hordeum vulgare L. | 7024, 7012, 7068, 6954 | 130 | 307 |

TABLE 75-continued

Genes cloned in High copy number plasmids or in binary vectors and the primers used for cloning of the genes

| Gene Name | High copy plasmid | Organism | SEQ ID NOs of the primers employed | Polyn. SEQ ID NO: | Polyp. SEQ ID NO: |
|---|---|---|---|---|---|
| WNU23 | pMA-RQ_WNU23_GA | | | 131 | 223 |
| WNU25 | pUC19c_WNU25 | BARLEY Hordeum vulgare L. | 7056, 7107, 7056, 7107 | 132 | 224 |
| WNU26 | pMA-RQ_WNU26_GA | | | 133 | 225 |
| WNU27 | pUC19c_WNU27 | BARLEY Hordeum vulgare L. | 6995, 6936, 6992, 6934 | 134 | 308 |
| WNU28 | pQFNc_WNU28 | BARLEY Hordeum vulgare L. | 7067, 6983, 7067, 6983 | 135 | 309 |
| WNU29 | pUC19g_WNU29 | BARLEY Hordeum vulgare L. | | 136 | 228 |
| WNU30 | pMA-RQ_WNU30_GA | | | 137 | 229 |
| WNU31 | pQFNc_WNU31 | BARLEY Hordeum vulgare L. | 7033, 6975, 7033, 6975 | 138 | 230 |
| WNU32 | pMA-RQ_WNU32_GA | | | 139 | 231 |
| WNU33 | pMA-T_WNU33_GA | | | 140 | 232 |
| WNU34 | pUC19c_WNU34 | BARLEY Hordeum vulgare L. | 7049, 6969, 7049, 6969 | 141 | 310 |
| WNU35 | pQFNc_WNU35 | BARLEY Hordeum vulgare L. | 7052, 6933, 7052, 6933 | 142 | 234 |
| WNU37 | pUC19c_WNU37 | BARLEY Hordeum vulgare L. | | 143 | 311 |
| WNU38 | pUC19c_WNU38 | BARLEY Hordeum vulgare L. | 7054, 6967, 7054, 6967 | 144 | 237 |
| WNU39 | pUC19c_WNU39 | BARLEY Hordeum vulgare L. | 7050, 7007, 7048, 6960 | 145 | 238 |
| WNU40 | pMA-RQ_WNU40_GA | | | 146 | 239 |
| WNU41 | pQFNc_WNU41 | BARLEY Hordeum vulgare L. | 7039, 7110, 7078, 7111 | 147 | 312 |
| WNU42 | pUC19c_WNU42 | BARLEY Hordeum vulgare L. | 6932, 6931, 6939, 7104 | 148 | 241 |
| WNU43 | pMA-RQ_WNU43_GA | | | 149 | 242 |
| WNU44 | pUC19c_WNU44 | BARLEY Hordeum vulgare L. | 7055, 6965, 7088, 6981 | 150 | 243 |
| WNU45 | TopoB_WNU45 | BRACHYPODIUM Brachypodiums dis | 7064, 7109, 7071, 7108 | 151 | 244 |
| WNU46 | pMA-RQ_WNU46_GA | | | 152 | 245 |
| WNU47 | pUC19c_WNU47 | BRACHYPODIUM Brachypodiums dis | 7091, 6947, 7091, 6947 | 153 | 246 |
| WNU49 | pQFNc_WNU49 | BRACHYPODIUM Brachypodiums dis | 7090, 6957, 7090, 6957 | 154 | 247 |
| WNU50 | pQFNc_WNU50 | BRACHYPODIUM Brachypodiums dis | 7036, 7116, 7057, 7099 | 155 | 313 |
| WNU51 | pQFNc_WNU51 | BRACHYPODIUM Brachypodiums dis | 7059, 7112, 7059, 7112 | 156 | 314 |
| WNU52 | pMA-T_WNU52_GA | | | 157 | 250 |
| WNU54 | pUC19c_WNU54 | FOXTAIL Setaria italica | 7081, 6978, 7081, 6978 | 158 | 252 |
| WNU55 | pQFNc_WNU55 | FOXTAIL Setaria italica | 7051, 6986, 7075, 6998 | 159 | 253 |
| WNU56 | pQFNc_WNU56 | FOXTAIL Setaria italica | | 160 | 254 |
| WNU57 | pUC19c_WNU57 | FOXTAIL Setaria italica | 7076, 7005, 7076, 7005 | 161 | 255 |
| WNU58 | pQFNc_WNU58 | FOXTAIL Setaria italica | 7047, 6966, 7047, 6966 | 162 | 256 |
| WNU60 | pQFNc_WNU60 | FOXTAIL Setaria italica | 6945, 7117, 6941, 7093 | 163 | 257 |
| WNU61 | pQFNc_WNU61 | FOXTAIL Setaria italica | 6944, 7120, 6946, 7119 | 164 | 315 |
| WNU63 | pQFNc_WNU63 | FOXTAIL Setaria italica | 7046, 6970, 7046, 6970 | 165 | 316 |
| WNU65 | pQFNc_WNU65 | FOXTAIL Setaria italica | 7032, 7004, 7031, 6962 | 166 | 260 |
| WNU66 | TopoB_WNU66 | FOXTAIL Setaria italica | 7040, 7013, 7040, 7013 | 167 | 261 |
| WNU67 | pQFNc_WNU67 | FOXTAIL Setaria italica | 6940, 6997, 6943, 6958 | 168 | 262 |
| WNU68 | pQFNc_WNU68 | FOXTAIL Setaria italica | 7025, 6974, 7025, 6955 | 169 | 263 |
| WNU69 | pMA_WNU69_GA | | | 170 | 264 |
| WNU70 | pUC19c_WNU70 | FOXTAIL Setaria italica | 7035, 6948, 7035, 6948 | 171 | 265 |
| WNU71 | pUC19c_WNU71 | FOXTAIL Setaria italica | 7063, 6950, 7063, 6950 | 172 | 266 |
| WNU72 | pUC19c_WNU72 | FOXTAIL Setaria italica | 7070, 7095, 7083, 7097 | 173 | 267 |
| WNU73 | pUC19c_WNU73 | FOXTAIL Setaria italica | 7082, 6935, 7082, 6935 | 174 | 268 |
| WNU74 | pUC19c_WNU74 | FOXTAIL Setaria italica | 7084, 7015, 7084, 7015 | 175 | 317 |
| WNU75 | pUC19c_WNU75 | MAIZE Zea mays L. | 7028, 6996, 7029, 6999 | 176 | 270 |
| WNU76 | pUC19g_WNU76 | MAIZE Zea mays L. | 7023, 7102, 7023, 7102 | 177 | 318 |
| WNU77 | pQFNc_WNU77 | MAIZE Zea mays L. | 7037, 7100, 7037, 7100 | 178 | 272 |
| WNU78 | pUC19g_WNU78 | MAIZE Zea mays L. | 7021, 6993, 7019, 7001 | 179 | 319 |
| WNU80 | pQFNc_WNU80 | MAIZE Zea mays L. | | 180 | 320 |
| WNU81 | pUC19c_WNU81 | MAIZE Zea mays L. | 7065, 7094, 7065, 7094 | 181 | 321 |
| WNU82 | pQFNc_WNU82 | MAIZE Zea mays L. | 7026, 6987, 7053, 6963 | 182 | 322 |
| WNU83 | pQFNc_WNU83 | MAIZE Zea mays L. | 7066, 7006, 7066, 7006 | 183 | 323 |
| WNU85 | pQFNc_WNU85 | RICE Oryza sativa L. | 6977, 6937, 6977, 6937 | 184 | 324 |
| WNU87 | pUC19c_WNU87 | RICE Oryza sativa L. | | 185 | 279 |
| WNU90 | pMA_WNU90_GA | | | 186 | 280 |
| WNU91 | pQFNc_WNU91 | SORGHUM Sorghum bicolor | 7020, 6985, 7022, 6979 | 187 | 281 |
| WNU92 | pUC19c_WNU92 | SORGHUM Sorghum bicolor | 7027, 6972, 7073, 6956 | 188 | 282 |
| WNU93 | pMA-RQ_WNU93_GA | | | 189 | 283 |
| WNU94 | pUC19_WNU94 | SORGHUM Sorghum bicolor | 7034, 6990, 7034, 6990 | 190 | 284 |
| WNU96 | pQFNc_WNU96 | SORGHUM Sorghum bicolor | 7038, 6952, 7038, 6952 | 191 | 285 |
| WNU97 | pUC19c_WNU97 | SORGHUM Sorghum bicolor | 6968, 6938, 6968, 6938 | 192 | 286 |
| WNU98 | pUC19c_WNU98 | SORGHUM Sorghum bicolor | 6942, 7009, 6942, 7009 | 193 | 325 |
| WNU99 | pUC19g_WNU99 | SORGHUM Sorghum bicolor | 7017, 7008, 7017, 7008 | 194 | 326 |
| WNU100 | pQFNc_WNU100 | SORGHUM Sorghum bicolor | 7061, 7014, 7061, 6971 | 195 | 289 |
| WNU101 | pQFNc_WNU101 | SORGHUM Sorghum bicolor | 7079, 6973, 7079, 6973 | 196 | 290 |
| WNU102 | pMA-RQ_WNU102_GA | | | 197 | 291 |
| WNU104 | pUC19c_WNU104 | MAIZE Zea mays L. | 7080, 7003, 7042, 6982 | 198 | 293 |
| WNU105 | pMA-RQ_WNU105_GA | | | 199 | 294 |

TABLE 75-continued

Genes cloned in High copy number plasmids or in binary vectors and the primers used for cloning of the genes

| Gene Name | High copy plasmid | Organism | SEQ ID NOs of the primers employed | Polyn. SEQ ID NO: | Polyp. SEQ ID NO: |
|---|---|---|---|---|---|
| WNU103_H11 | pMA-RQ_WNU103_H11_GA | | | 200 | 295 |
| WNU22_H1 | TopoB_WNU22_H1 | WHEAT Triticum aestivum L. | 6988, 7106, 6976, 7105 | 201 | 327 |

Table 75. "Polyn."—Polynucleotide; "Polyp"— polypeptide. For cloning of each gene at least 2 primers were used: Forward (Fwd) or Reverse (Rev). In some cases, 4 primers were used: External forward (EF), External reverse (ER), nested forward (NF) or nested reverse (NR). The sequences of the primers used for cloning the genes are provided in the sequence listing. Some genes were synthetically produced by GeneArt (marked as "GA").

Example 15

Transforming *Agrobacterium Tumefaciens* Cells with Binary Vectors Harboring Putative Genes The above described binary vectors were used to transform *Agrobacterium* cells. Two additional binary constructs, having only the At6669 or the 35S promoter, or no additional promoter were used as negative controls.

The binary vectors were introduced to *Agrobacterium tumefaciens* GV301 or LB4404 (for *Arabidopsis*) or AGL1 (for *Brachypodium*) competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (for *Arabidopsis*; 50 mg/L; for *Agrobacterium* strains GV301) or streptomycin (for *Arabidopsis*; 300 mg/L; for *Agrobacterium* strain LB4404); or with Carbenicillin (for *Brachypodium*; 50 mg/L) and kanamycin (for *Arabidopsis* and *Brachypodium*; 50 mg/L) at 28° C. for 48 hours. *Abrobacterium* colonies, which were developed on the selective media, were further analyzed by PCR using the primers designed to span the inserted sequence in the pPI plasmid. The resulting PCR products were isolated and sequenced to verify that the correct polynucleotide sequences of the invention are properly introduced to the *Agrobacterium* cells.

Example 16

Transformation of *Arabidopsis Thaliana* Plants with the Polynucleotides of the Invention

*Arabidopsis thaliana* Columbia plants ($T_0$ plants) were transformed using the Floral Dip procedure described by Clough and Bent, 1998 (Floral dip: a simplified method for *Agrobacterium*-mediated transformation of *Arabidopsis thaliana*. Plant J 16:735-43) and by Desfeux et al., 2000 (Female Reproductive Tissues Are the Primary Target of *Agrobacterium*-Mediated Transformation by the *Arabidopsis* Floral-Dip Method. Plant Physiol, July 2000, Vol. 123, pp. 895-904), with minor modifications. Briefly, $T_0$ Plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hour light/dark cycles. The $T_0$ plants were ready for transformation six days before anthesis.

Single colonies of *Agrobacterium* carrying the binary constructs, were generated as described in Examples 14-15 above. Colonies were cultured in LB medium supplemented with kanamycin (50 mg/L) and gentamycin (50 mg/L). The cultures were incubated at 28° C. for 48 hours under vigorous shaking and then centrifuged at 4000 rpm for 5 minutes. The pellets comprising the *Agrobacterium* cells were re-suspended in a transformation medium containing half-strength (2.15 g/L) Murashige-Skoog (Duchefa); 0.044 μM benzylamino purine (Sigma); 112 μg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension, such that the above ground plant tissue is submerged for 3-5 seconds. Each inoculated $T_0$ plant was immediately placed in a plastic tray, then covered with clear plastic dome to maintain humidity and was kept in the dark at room temperature for 18 hours, to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry. Seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochloride and 0.05% triton for 5 minutes. The surface-sterilized seeds were thoroughly washed in sterile distilled water then placed on culture plates containing half-strength Murashige-Skoog (Duchefa); 2% sucrose; 0.8% plant agar; 50 mM kanamycin; and 200 mM carbenicylin (Duchefa). The culture plates were incubated at 4° C. for 48 hours, then transferred to a growth room at 25° C. for an additional week of incubation. Vital $T_1$ *Arabidopsis* plants were transferred to fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 17

Transformation of *Brachypodium Distachyon* Plants with the Polynucleotides of the Invention Similar to the *Arabidopsis* model plant, *Brachypodium* distachyon has several features that recommend it as a model plant for functional genomic studies, especially in the grasses. Traits that make it an ideal model include its small genome (~160 Mbp for a diploid genome and 355 Mbp for a polyploidy genome), small physical stature, a short lifecycle, and few growth requirements. *Brachypodium* is related to the major cereal grain species but is understood to be more closely related to the Triticeae (wheat, barley) than to the other cereals. *Brachypodium*, with its polyploidy accessions, can serve as an ideal model for these grains (whose genomics size and complexity is a major barrier to biotechnological improvement).

*Brachypodium distachyon* embryogenic calli were transformed using the procedure described by Vogel and Hill (2008) [High-efficiency *Agrobacterium*-mediated transformation of *Brachypodium distachyon* inbred line Bd21-3. Plant Cell Rep 27:471-478], Vain et al (2008) [*Agrobacterium*-mediated transformation of the temperate grass *Brachypodium* distachyon (genotypeBd21) for T-DNA insertional mutagenesis. Plant Biotechnology J 6: 236-245], and Vogel J, et al. (2006) [*Agrobacterium* mediated transformation and inbred line development in the model grass *Brachypodium* distachyon. Plant Cell Tiss Org. Cult. 85:199-211], each of which is fully incorporated herein by reference, with some minor modifications, which are briefly summarized hereinbelow.

Callus initiation—Immature spikes (about 2 months after seeding) were harvested at the very beginning of seeds filling. Spikes were then husked and surface sterilized with 3% NaClO containing 0.1% Tween 20, shaked on a gyratory shaker at low speed for 20 minutes. Following three rinses with sterile distilled water, embryos were excised under a dissecting microscope in a laminar flow hood using fine forceps.

Excised embryos (size~0.3 mm, bell shaped) were placed on callus induction medium (CIM) [LS salts (Linsmaier, E. M. & Skoog, F. 1965. Physiol. Plantarum 18, 100) and vitamins plus 3% sucrose, 6 mg/L $CuSO_4$, 2.5 mg/l 2,4-Dichlorophenoxyacetic Acid, pH 5.8 and 0.25% phytagel (Sigma)] scutellar side down, 100 embryos on a plate, and incubated at 28° C. in the dark. One week later, the embryonic calli was cleaned from emerging roots, shoots and somatic calli, and was subcultured onto fresh CIM medium. During culture, yellowish embryogenic callus (EC) appeared and were further selected (e.g., picked and transferred) for further incubation in the same conditions for additional 2 weeks. Twenty-five pieces of sub-cultured calli were then separately placed on 90×15 mm petri plates, and incubated as before for three additional weeks.

Transformation—As described in Vogel and Hill (2008, Supra), *Agrobacterium* was scraped off 2-day-old MGL plates (plates with the MGL medium which contains: Tryptone 5 g/l, Yeast Extract 2.5 g/l, NaCl 5 g/l, D-Mannitol 5 g/l, $MgSO_4*7H_2O$ 0.204 g/l, $K_2HPO_4$ 0.25 g/l, Glutamic Acid 1.2 g/l, Plant Agar 7.5 g/l) and resuspended in liquid MS medium supplemented with 200 μM acetosyringone to an optic density (OD) at 600 nm ($OD_{600}$) of 0.6. Once the desired OD was attained, 1 ml of 10% Synperonic PE/F68 (Sigma) per 100 ml of inoculation medium was added.

To begin inoculation, 300 callus pieces were placed in approximately 12 plates (25 callus pieces in each plate) and covered with the *Agrobacterium* suspension (8-8.5 ml). The callus was incubated in the *Agrobacterium* suspension for 15 minutes with occasional gentle rocking. After incubation, the *Agrobacterium* suspension was aspirated off and the calli were then transferred into co-cultivation plates, prepared by placing a sterile 7-cm diameter filter paper in an empty 90×15 mm petri plate. The calli pieces were then gently distributed on the filter paper. One co-cultivation plate was used for two starting callus plates (50 initial calli pieces). The co-cultivation plates were then sealed with parafilm and incubated at 22° C. in the dark for 3 days. The callus pieces were then individually transferred onto CIM medium as described above, which was further supplemented with 200 mg/l Ticarcillin (to kill the *Agrobacterium*) and Bialaphos (5 mg/L) (for selection of the transformed resistant embryogenic calli sections), and incubated at 28° C. in the dark for 14 days.

The calli pieces were then transferred to shoot induction media (SIM; LS salts and vitamins plus 3% Maltose monohydrate) supplemented with 200 mg/l Ticarcillin, Bialaphos (5 mg/L), Indol-3-acetic acid (IAA) (0.25 mg/L), and 6-Benzylaminopurine (BAP) (1 mg/L), and were sub-cultured in light to the same media after 10 days (total of 20 days). At each sub-culture all the pieces from a single callus were kept together to maintain their independence and were incubated under the following conditions: lighting to a level of 60 IE m-2 s-1, a 16-h light, 8-h dark photoperiod and a constant 24° C. temperature. Plantlets emerged from the transformed calli.

When plantlets were large enough to handle without damage, they were transferred to plates containing the above mentioned shoot induction media (SIM) without Bialaphos. Each plantlet was considered as a different event. The plantlets grew axillary tillers and eventually became bushy. Each bush from the same plant (event ID) was then divided to tissue culture boxes ("Humus") containing "rooting medium" [MS basal salts, 3% sucrose, 3 g/L phytagel, 2 mg/l α-Naphthalene Acetic Acid (NAA) and 1 mg/L IAA and Ticarcillin 200 mg/L, PH 5.8). All plants in a "Humus box" were different plants of the same transformation event.

When plantlets established roots they were transplanted to soil and transferred to a greenhouse. To verify the transgenic status of plants containing the other constructs, T0 plants were subjected to PCR as previously described by Vogel et al. 2006 *[Agrobacterium* mediated transformation and inbred line development in the model grass *Brachypodium* distachyon. Plant Cell Tiss Org. Cult. 85:199-211].

Example 18

Evaluating Transgenic *Arabidopsis* Nue Under Low or Normal Nitrogen Conditions Using Seedling Assays Assay 1: Plant Growth Under Low and Favorable Nitrogen Concentration Levels Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½MS media (15 mM N) for the normal nitrogen concentration treatment and 0.30 mM nitrogen for the low nitrogen concentration treatments. For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, was used for capturing images of plantlets sawn in agar plates.

Figure 3A:
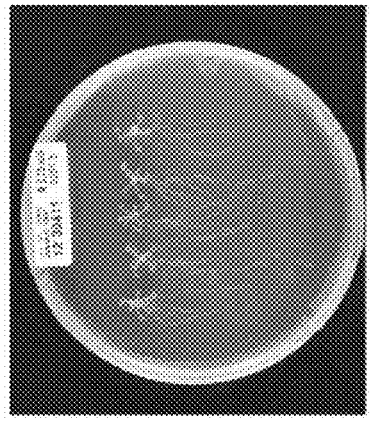
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3C:
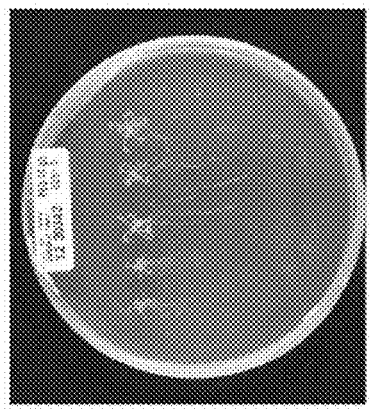
Figure 3E:
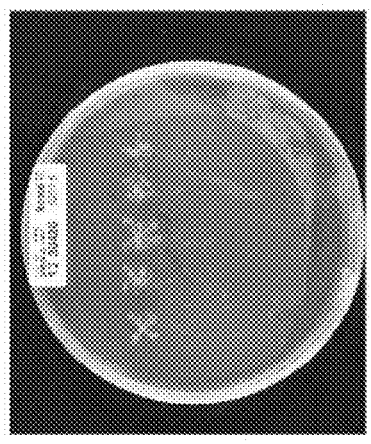
Figure 3B:
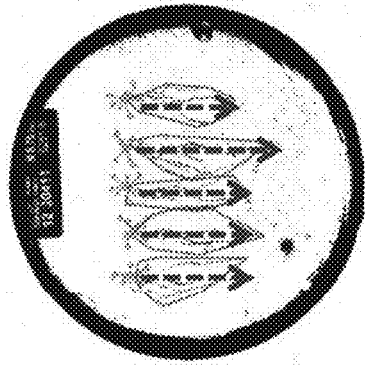
Figure 3D:
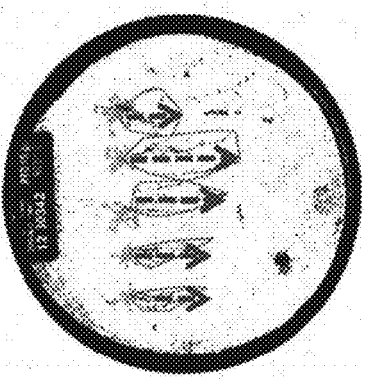
Figure 3F:
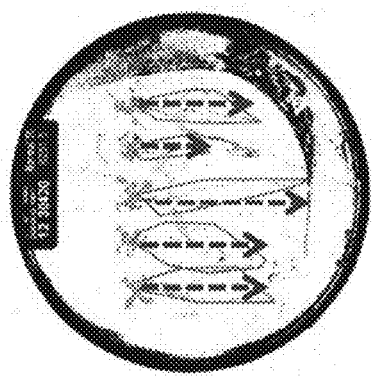
Figure 4:
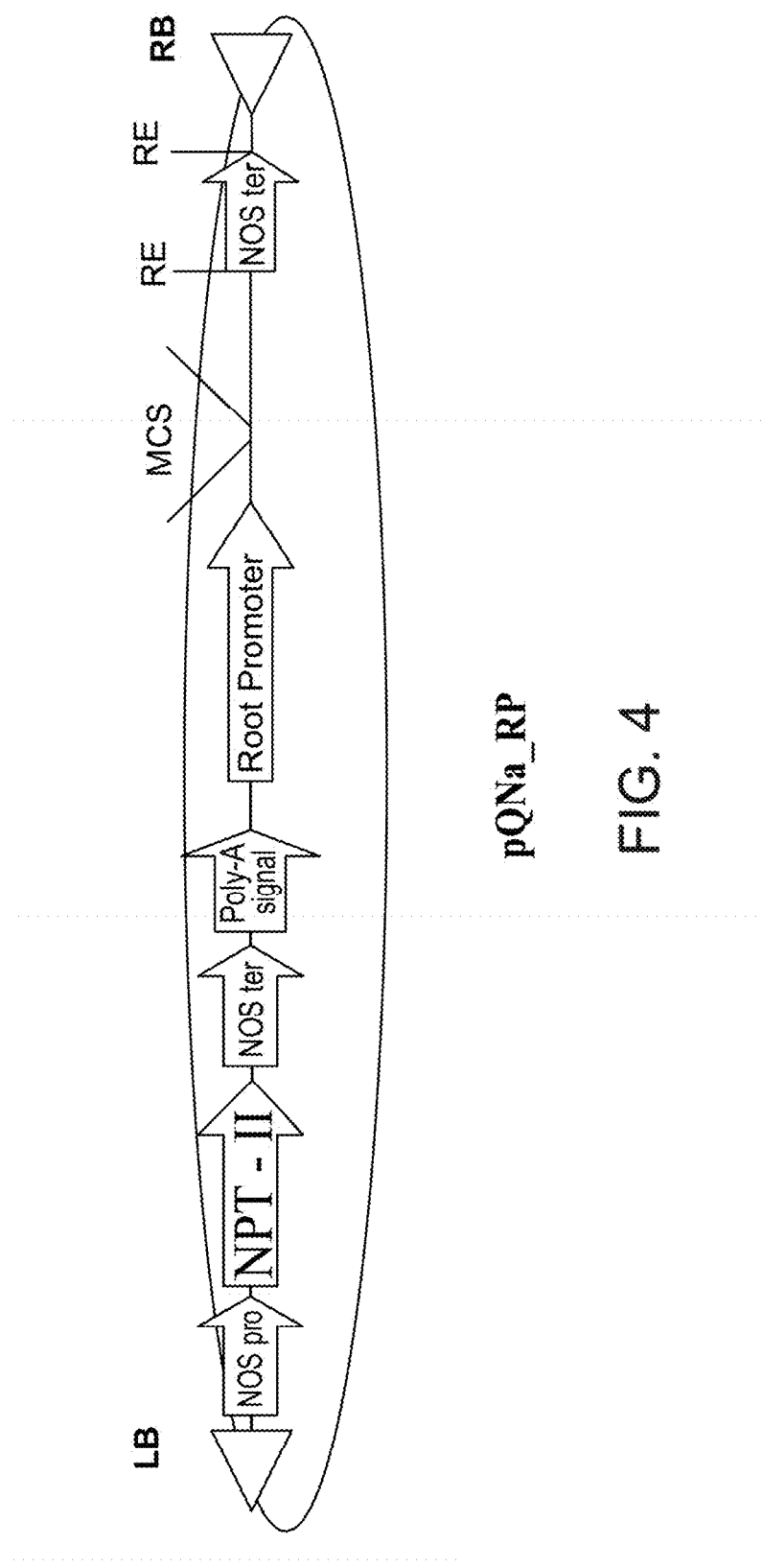
FIG. 4 is a schematic illustration of the modified pGI binary plasmid containing the Root Promoter (pQNa_RP; SEQ ID NO: 6927) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); The isolated polynucleotide sequences according to some embodiments of the invention were cloned into the MCS (Multiple cloning site) of the vector.
Figure 5:
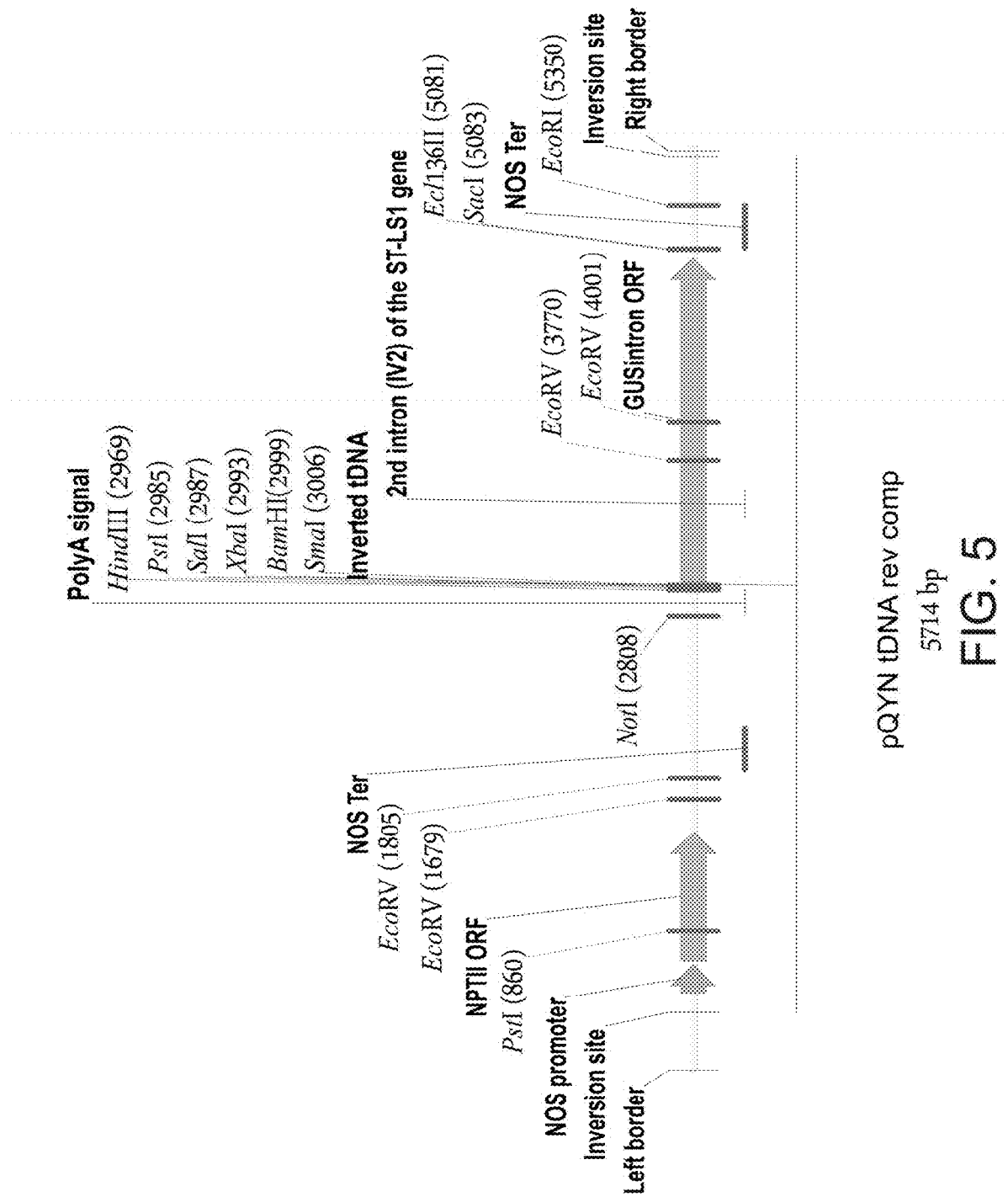
FIG. 5 is a schematic illustration of the pQYN plasmid.
Figure 6:
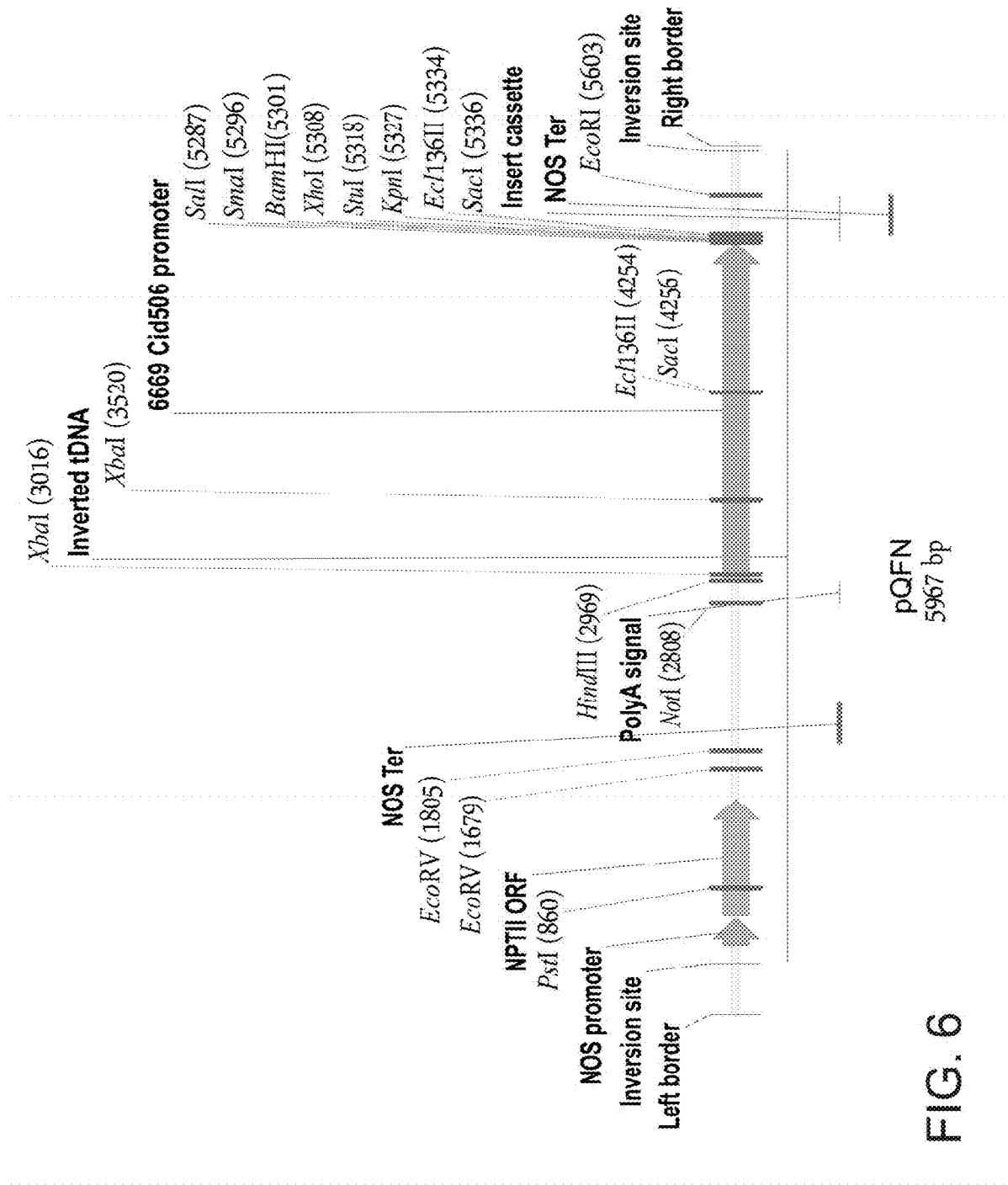
FIG. 6 is a schematic illustration of the pQFN plasmid.
Figure 7:
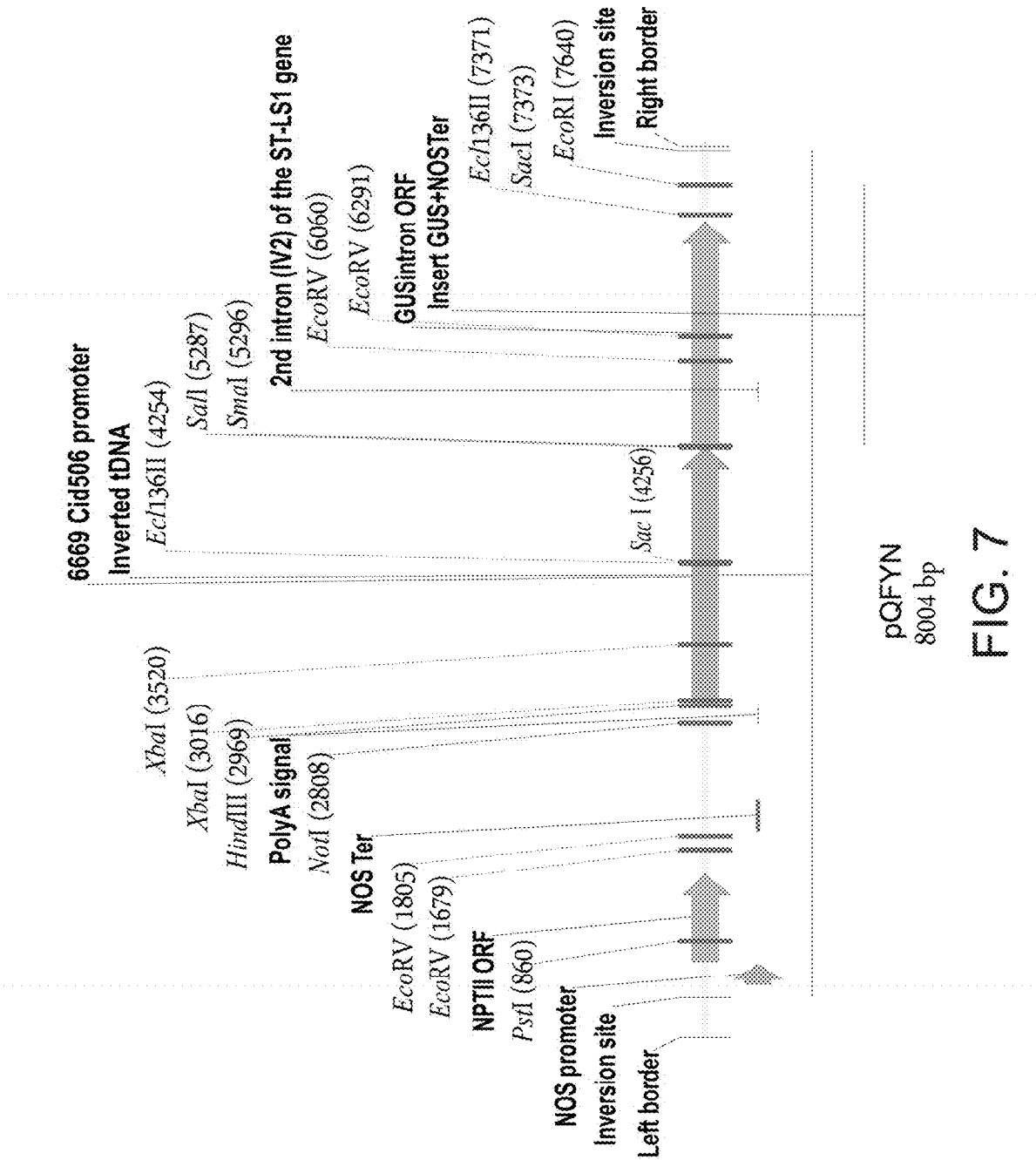
FIG. 7 is a schematic illustration of the pQFYN plasmid.
Figure 8:
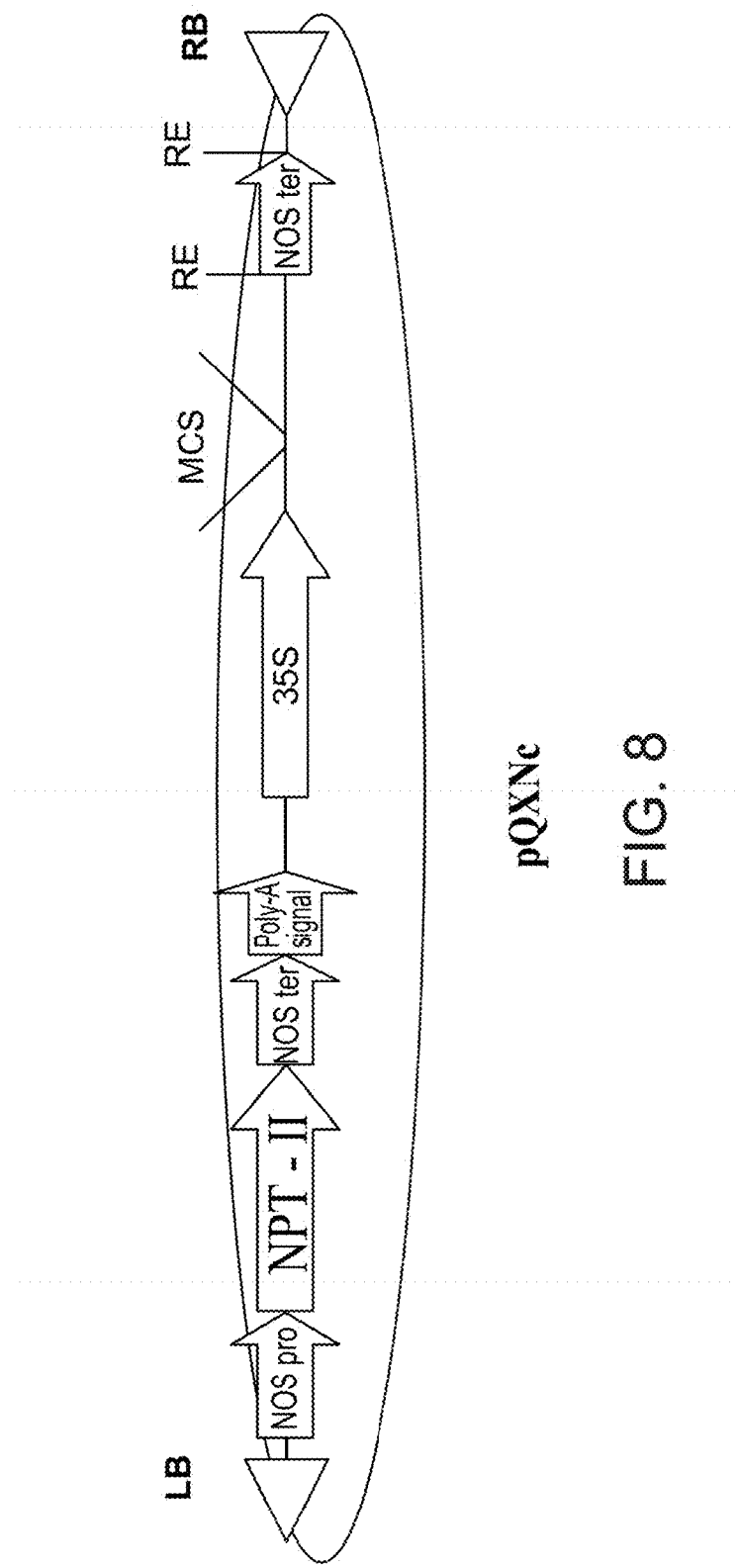
FIG. 8 is a schematic illustration of pQXNc plasmid, which is a modified pGI binary plasmid used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (pqfnc; SEQ ID NO: 6914). The isolated polynucleotide sequences of some embodiments of the invention were cloned into the MCS (Multiple cloning site) of the vector.

The image capturing process was repeated every 3-4 days starting at day 1 till day 10 (see for example the images in FIGS. 3A-B). An image analysis system was used, which consists of a personal desktop computer (Intel P4 3.0 GHz processor) and a public domain program—ImageJ 1.39 [Java based image processing program which is developed at the U.S. National Institutes of Health and freely available on the internet at rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate for the various seedling parameters was calculated according to Formulas XIII (Relative growth rate of leaf area), XII (Relative growth rate of leaf blade area) and VI (Relative growth rate of root length) as described above.

At the end of the experiment, plantlets were removed from the media and weighed for the determination of plant fresh weight. Plantlets were then dried for 24 hours at 60° C., and weighed again to measure plant dry weight for later statistical analysis. Growth rate was determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events were examined in replicates.

Statistical analyses—To identify genes conferring significantly improved plant vigor or enlarged root architecture, the results obtained from the transgenic plants were compared to those obtained from control plants that were grown under identical growth conditions. To identify outperforming genes and constructs, results from the independent transformation events tested were analyzed separately. To evaluate the effect of a gene event over a control the data was analyzed by Student's t-test and the p value was calculated. Results were considered significant if $p \leq 0.1$. The JMP statistics software package was used (Version 5.2.1, SAS Institute Inc., Cary, N.C., USA).

Experimental Results:

The genes presented in the following Tables were cloned under the regulation of a constitutive promoter (At6669). Evaluation of the effect of transformation in a plant of each gene was carried out by testing the performance of different number of transformation events. Some of the genes were evaluated in more than one seedling assay. The results obtained in these second experiments were significantly positive as well. Event with p-value<0.1 was considered statistically significant.

The genes presented in Tables 76-78 showed a significant improvement in plant NUE since they produced larger plant biomass (plant fresh and dry weight; leaf area, root length and root coverage) in T2 generation (Tables 76-77) or T1 generation (Table 78) when grown under limiting nitrogen growth conditions, compared to control plants that were grown under identical growth conditions. Plants producing larger root biomass have better possibilities to absorb larger amount of nitrogen from soil.

TABLE 76

Genes showing improved plant performance at nitrogen deficient conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| WNU9 | 76615.4 | 5.33 | 0.10 | 34 | 128.6 | 0.12 | 51 |
| WNU41 | 79012.2 | 5.12 | 0.05 | 29 | — | — | — |
| WNU41 | 79012.4 | 4.72 | 0.02 | 19 | — | — | — |
| WNU41 | 79013.1 | 5.05 | 0.05 | 27 | 98.0 | 0.25 | 15 |
| WNU31 | 75790.2 | — | — | — | 115.7 | 0.24 | 36 |
| WNU20 | 78340.5 | — | — | — | 131.1 | 0.07 | 54 |
| CONT. | — | 3.97 | — | — | 85.3 | — | — |
| WNU96 | 75816.4 | 6.25 | L | 80 | 95.7 | L | 40 |
| WNU96 | 75818.9 | 4.07 | 0.21 | 17 | 85.4 | 0.29 | 25 |
| WNU93 | 76607.13 | — | — | — | 83.4 | 0.20 | 22 |
| WNU93 | 76607.9 | 4.80 | 0.02 | 38 | 86.7 | 0.15 | 27 |
| WNU93 | 76609.3 | 5.03 | 0.04 | 45 | 106.9 | 0.06 | 57 |
| WNU93 | 76609.4 | 3.98 | 0.26 | 15 | 89.3 | 0.19 | 31 |
| WNU8 | 77116.2 | 4.05 | 0.05 | 17 | — | — | — |
| WNU8 | 77117.9 | 3.98 | 0.23 | 15 | — | — | — |
| WNU76 | 77092.1 | 4.73 | 0.13 | 36 | 86.0 | 0.07 | 26 |
| WNU76 | 77092.3 | 4.07 | 0.25 | 17 | — | — | — |
| WNU76 | 77095.2 | 4.72 | 0.03 | 36 | 94.8 | 0.08 | 39 |
| WNU49 | 75796.8 | 4.35 | 0.13 | 25 | 92.2 | 0.22 | 35 |
| WNU49 | 75797.3 | 3.98 | 0.22 | 15 | 81.4 | 0.25 | 19 |
| WNU49 | 75799.6 | — | — | — | 81.5 | 0.29 | 20 |
| WNU40 | 78091.1 | 4.55 | 0.02 | 31 | 88.2 | 0.22 | 29 |
| WNU40 | 78092.5 | 4.30 | 0.22 | 24 | 117.1 | 0.22 | 72 |
| WNU40 | 78095.5 | 4.63 | L | 34 | — | — | — |
| WNU37 | 77766.2 | 4.47 | 0.21 | 29 | 102.5 | 0.15 | 50 |
| WNU37 | 77767.1 | 4.10 | 0.06 | 18 | 109.2 | 0.07 | 60 |

TABLE 76-continued

Genes showing improved plant performance at nitrogen deficient conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| WNU37 | 77767.3 | 5.58 | 0.02 | 61 | 105.6 | 0.01 | 55 |
| WNU23 | 78341.3 | 4.25 | 0.16 | 22 | 83.0 | 0.17 | 22 |
| WNU23 | 78341.7 | 4.00 | 0.18 | 15 | — | — | — |
| WNU23 | 78343.1 | 4.43 | 0.06 | 28 | 102.6 | 0.05 | 50 |
| WNU23 | 78344.2 | 4.12 | 0.18 | 19 | 88.9 | 0.12 | 30 |
| WNU102 | 76549.12 | 4.72 | L | 36 | 95.5 | 0.21 | 40 |
| WNU102 | 76550.4 | 5.10 | L | 47 | 107.5 | 0.03 | 58 |
| WNU100 | 77989.3 | 4.58 | 0.09 | 32 | 94.5 | 0.02 | 39 |
| WNU100 | 78026.6 | 4.05 | 0.18 | 17 | — | — | — |
| WNU100 | 78029.3 | 4.17 | 0.03 | 20 | — | — | — |
| CONT. | — | 3.47 | — | — | 68.2 | — | — |
| WNU70 | 78102.7 | 4.00 | 0.07 | 33 | 68.0 | 0.04 | 39 |
| WNU70 | 78104.1 | 4.37 | 0.21 | 46 | 67.1 | 0.29 | 37 |
| WNU61 | 78014.1 | 3.70 | 0.15 | 23 | — | — | — |
| WNU61 | 78014.2 | 4.25 | 0.20 | 42 | 66.4 | 0.10 | 36 |
| WNU61 | 78015.10 | 3.47 | 0.20 | 16 | 56.2 | 0.21 | 15 |
| WNU6 | 76542.5 | 6.58 | 0.02 | 119 | 108.0 | 0.05 | 121 |
| WNU6 | 76544.1 | 4.25 | 0.02 | 42 | 66.1 | 0.05 | 35 |
| WNU6 | 76544.4 | 6.27 | 0.15 | 109 | — | — | — |
| WNU55 | 77632.3 | 5.93 | 0.04 | 98 | 63.2 | 0.05 | 29 |
| WNU55 | 77632.6 | 5.40 | 0.02 | 80 | 67.5 | 0.03 | 38 |
| WNU51 | 79018.6 | 3.60 | 0.14 | 20 | — | — | — |
| WNU51 | 79019.2 | — | — | — | 58.5 | 0.11 | 20 |
| WNU11 | 76397.2 | 4.00 | 0.25 | 33 | 61.8 | 0.19 | 27 |
| WNU105 | 77261.2 | 4.37 | 0.05 | 46 | — | — | — |
| WNU105 | 77261.4 | 3.52 | 0.21 | 18 | 56.1 | 0.24 | 15 |
| CONT. | — | 4.39 | — | — | 71.2 | — | — |
| WNU91 | 76213.2 | — | — | — | 93.1 | 0.19 | 14 |
| WNU91 | 76213.4 | 4.88 | 0.02 | 30 | 102.7 | 0.02 | 26 |
| WNU70 | 78104.1 | 4.92 | 0.04 | 31 | 96.2 | 0.08 | 18 |
| WNU70 | 78104.3 | 5.05 | 0.12 | 35 | 119.0 | 0.06 | 46 |
| WNU70 | 78104.4 | 4.47 | 0.16 | 19 | 99.9 | 0.16 | 23 |
| WNU14 | 77113.9 | — | — | — | 96.6 | 0.10 | 19 |
| WNU11 | 76397.2 | 5.25 | 0.02 | 40 | 126.4 | 0.07 | 55 |
| WNU105 | 77261.4 | 4.55 | 0.20 | 21 | 96.5 | 0.08 | 19 |
| CONT. | — | 3.75 | — | — | 81.4 | — | — |
| WNU99 | 77099.4 | — | — | — | 41.5 | 0.28 | 17 |
| WNU99 | 77100.3 | 3.43 | 0.01 | 39 | 47.8 | L | 34 |
| WNU98 | 77462.4 | 3.35 | 0.01 | 36 | 51.8 | L | 46 |
| WNU97 | 77181.4 | 3.30 | L | 34 | 49.8 | 0.06 | 40 |
| WNU97 | 77182.2 | 3.15 | 0.10 | 28 | 48.0 | L | 35 |
| WNU94 | 78108.3 | 3.08 | 0.05 | 25 | 44.9 | 0.01 | 26 |
| WNU94 | 78109.1 | 2.90 | 0.26 | 18 | — | — | — |
| WNU94 | 78110.3 | — | — | — | 47.3 | 0.17 | 33 |
| WNU9 | 76612.1 | — | — | — | 43.1 | 0.22 | 21 |
| WNU9 | 76615.6 | 3.73 | L | 52 | 54.1 | L | 52 |
| WNU83 | 75821.8 | 3.08 | 0.04 | 25 | 49.2 | L | 39 |
| WNU83 | 75823.10 | 3.28 | 0.05 | 33 | 48.7 | 0.05 | 37 |
| WNU83 | 75824.4 | — | — | — | 42.6 | 0.09 | 20 |
| WNU81 | 78097.2 | 3.40 | 0.03 | 38 | 55.5 | L | 56 |
| WNU81 | 78097.5 | 3.15 | 0.06 | 28 | 45.1 | 0.08 | 27 |
| WNU81 | 78098.2 | — | — | — | 42.1 | 0.08 | 19 |
| WNU5 | 76044.2 | 3.17 | 0.09 | 29 | 42.7 | 0.19 | 20 |
| WNU5 | 76045.7 | 3.05 | 0.09 | 24 | — | — | — |
| WNU46 | 77021.3 | 3.40 | L | 38 | 45.3 | 0.08 | 28 |
| WNU46 | 77022.1 | 3.02 | 0.14 | 23 | 41.6 | 0.10 | 17 |
| WNU46 | 77024.3 | — | — | — | 49.6 | 0.12 | 40 |
| WNU43 | 77270.2 | 3.32 | 0.02 | 35 | 46.4 | L | 31 |
| WNU41 | 79012.2 | 3.55 | 0.15 | 44 | — | — | — |
| WNU41 | 79012.4 | 4.13 | L | 68 | 54.3 | 0.02 | 53 |
| WNU41 | 79013.1 | 2.98 | 0.07 | 21 | 44.8 | 0.10 | 26 |
| WNU38 | 76594.5 | 3.25 | 0.05 | 32 | 51.2 | 0.17 | 44 |
| WNU38 | 76595.11 | — | — | — | 41.9 | 0.21 | 18 |
| WNU35 | 75793.1 | 3.32 | 0.02 | 35 | 48.3 | 0.05 | 36 |
| WNU31 | 75786.3 | 3.35 | 0.15 | 36 | 47.6 | 0.15 | 34 |
| WNU31 | 75790.2 | 3.45 | 0.10 | 40 | 46.0 | 0.06 | 30 |
| WNU31 | 75790.7 | 3.10 | 0.14 | 26 | 53.5 | 0.05 | 51 |
| WNU20 | 78336.5 | 2.95 | 0.07 | 20 | 41.2 | 0.23 | 16 |
| WNU20 | 78340.1 | 3.15 | 0.05 | 28 | 46.3 | 0.07 | 30 |
| WNU20 | 78340.5 | 3.00 | 0.16 | 22 | 54.9 | 0.09 | 55 |
| WNU17 | 76556.4 | — | — | — | 40.8 | 0.17 | 15 |
| WNU17 | 76557.4 | 2.85 | 0.15 | 16 | 40.7 | 0.22 | 15 |
| WNU17 | 76559.1 | 3.02 | 0.23 | 23 | — | — | — |

TABLE 76-continued

Genes showing improved plant performance at nitrogen deficient conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| CONT. | — | 2.46 | — | — | 35.5 | — | — |
| WNU103_H11 | 78347.1 | 4.4 | 0.18126 | 26 | — | — | — |
| WNU103_H11 | 78346.4 | — | — | — | 107.15 | 0.11509 | 57 |
| WNU22_H1 | 79403.1 | 3.925 | 0.119338 | 13 | 90.55 | 0.200901 | 32 |
| WNU22_H1 | 79405.2 | 4.775 | 0.085495 | 37 | 103.375 | 0.194248 | 51 |
| CONT. | — | 3.47 | — | — | 68.18 | — | — |

Table 76.
"CONT."—Control;
"Ave."—Average;
"% Incr." = % increment;
"p-val."—p-value;
L means that p-value is less than 0.01, p < 0.1 was considered as significant.

TABLE 77

Genes showing improved plant performance at nitrogen deficient conditions (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| WNU98 | 77462.2 | 0.457 | 0.15 | 13 | — | — | — | 7.03 | L | 11 |
| WNU98 | 77462.4 | — | — | — | — | — | — | 6.71 | 0.10 | 6 |
| WNU98 | 77463.13 | 0.437 | 0.27 | 8 | — | — | — | — | — | — |
| WNU98 | 77465.1 | 0.468 | 0.08 | 16 | 11.2 | 0.02 | 23 | 6.68 | 0.28 | 6 |
| WNU97 | 77182.2 | 0.448 | 0.01 | 11 | 10.8 | 0.29 | 18 | 6.83 | 0.02 | 8 |
| WNU94 | 78108.3 | — | — | — | 11.7 | 0.04 | 27 | 7.13 | 0.05 | 13 |
| WNU9 | 76612.1 | — | — | — | — | — | — | 6.79 | 0.19 | 8 |
| WNU9 | 76615.6 | — | — | — | — | — | — | 6.81 | 0.02 | 8 |
| WNU83 | 75821.7 | — | — | — | — | — | — | 6.77 | 0.05 | 7 |
| WNU83 | 75823.10 | — | — | — | — | — | — | 6.67 | 0.22 | 6 |
| WNU83 | 75824.4 | — | — | — | — | — | — | 6.64 | 0.05 | 5 |
| WNU81 | 78098.2 | — | — | — | — | — | — | 6.85 | 0.10 | 9 |
| WNU41 | 79012.1 | — | — | — | — | — | — | 6.99 | 0.12 | 11 |
| WNU41 | 79012.2 | 0.468 | L | 16 | 14.8 | L | 61 | 7.37 | L | 17 |
| WNU41 | 79012.4 | 0.472 | 0.15 | 17 | — | — | — | 6.74 | 0.07 | 7 |
| WNU41 | 79013.1 | 0.458 | 0.14 | 13 | 10.3 | 0.02 | 13 | 6.74 | 0.08 | 7 |
| WNU38 | 76595.11 | 0.442 | 0.16 | 9 | — | — | — | 6.89 | 0.09 | 9 |
| WNU31 | 75790.2 | 0.477 | 0.08 | 18 | 10.8 | 0.12 | 18 | 6.77 | 0.05 | 7 |
| WNU31 | 75790.7 | — | — | — | 11.9 | 0.28 | 30 | — | — | — |
| WNU31 | 75790.8 | — | — | — | — | — | — | 6.78 | 0.03 | 7 |
| WNU20 | 78339.2 | 0.459 | 0.10 | 14 | — | — | — | 7.07 | L | 12 |
| WNU20 | 78340.1 | — | — | — | 10.4 | 0.13 | 13 | 7.20 | 0.02 | 14 |
| WNU20 | 78340.5 | 0.468 | 0.09 | 16 | 11.8 | L | 29 | 7.44 | L | 18 |
| WNU17 | 76556.3 | 0.464 | 0.02 | 15 | 12.5 | 0.02 | 37 | 7.38 | L | 17 |
| WNU17 | 76557.4 | — | — | — | — | — | — | 6.82 | 0.15 | 8 |
| CONT. | — | 0.404 | — | — | 9.15 | — | — | 6.30 | — | — |
| WNU96 | 75816.4 | 0.444 | 0.02 | 39 | 11.4 | L | 58 | 7.01 | L | 18 |
| WNU96 | 75818.9 | 0.366 | 0.19 | 15 | 8.28 | 0.23 | 15 | 6.63 | 0.04 | 12 |
| WNU96 | 75820.6 | — | — | — | — | — | — | 6.86 | L | 16 |
| WNU96 | 75820.7 | 0.365 | 0.10 | 15 | — | — | — | — | — | — |
| WNU93 | 76607.13 | 0.403 | 0.02 | 26 | 10.6 | L | 48 | 7.09 | L | 20 |
| WNU93 | 76607.9 | 0.386 | 0.05 | 21 | 9.08 | 0.15 | 26 | — | — | — |
| WNU93 | 76609.3 | 0.407 | 0.11 | 28 | 9.62 | 0.21 | 34 | 7.04 | 0.03 | 19 |
| WNU8 | 77117.1 | 0.369 | 0.19 | 16 | 8.70 | 0.06 | 21 | 6.35 | 0.21 | 7 |
| WNU8 | 77117.9 | 0.359 | 0.19 | 12 | — | — | — | — | — | — |
| WNU76 | 77091.10 | — | — | — | 8.32 | 0.24 | 16 | — | — | — |
| WNU76 | 77092.1 | 0.452 | 0.07 | 42 | — | — | — | — | — | — |
| WNU76 | 77095.2 | 0.368 | 0.25 | 15 | 9.56 | 0.05 | 33 | 6.38 | 0.24 | 8 |
| WNU49 | 75796.8 | 0.399 | 0.03 | 25 | 8.38 | 0.09 | 17 | — | — | — |
| WNU49 | 75797.3 | 0.359 | 0.13 | 13 | — | — | — | 6.28 | 0.23 | 6 |
| WNU49 | 75799.6 | 0.369 | 0.26 | 16 | — | — | — | — | — | — |
| WNU49 | 75799.7 | — | — | — | — | — | — | 6.42 | 0.09 | 8 |
| WNU40 | 78091.1 | 0.392 | L | 23 | — | — | — | — | — | — |
| WNU40 | 78092.5 | 0.373 | 0.02 | 17 | 10.3 | L | 44 | 6.45 | 0.09 | 9 |
| WNU40 | 78095.5 | 0.374 | 0.28 | 17 | — | — | — | — | — | — |
| WNU37 | 77766.2 | 0.402 | 0.03 | 26 | 9.28 | 0.14 | 29 | — | — | — |
| WNU37 | 77767.1 | 0.391 | 0.12 | 23 | 9.33 | 0.06 | 30 | 6.77 | 0.11 | 14 |

TABLE 77-continued

Genes showing improved plant performance at nitrogen deficient conditions (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| WNU37 | 77767.3 | 0.397 | 0.07 | 24 | 11.0 | 0.02 | 53 | 6.85 | 0.06 | 15 |
| WNU23 | 78341.3 | 0.397 | 0.01 | 24 | — | — | — | 6.38 | 0.12 | 8 |
| WNU23 | 78341.7 | 0.355 | 0.10 | 11 | 8.16 | 0.21 | 14 | 6.60 | 0.16 | 11 |
| WNU23 | 78343.1 | 0.428 | 0.01 | 34 | 9.83 | 0.08 | 37 | 7.22 | L | 22 |
| WNU23 | 78344.2 | 0.408 | L | 28 | — | — | — | 6.73 | 0.02 | 13 |
| WNU102 | 76549.12 | 0.442 | L | 38 | 12.1 | L | 68 | 6.75 | 0.03 | 14 |
| WNU102 | 76550.4 | 0.444 | L | 39 | 12.5 | L | 74 | 7.26 | 0.01 | 22 |
| WNU100 | 77989.3 | 0.414 | 0.01 | 30 | 8.90 | 0.05 | 24 | 6.83 | L | 15 |
| WNU100 | 77990.2 | — | — | — | — | — | — | 6.54 | 0.15 | 10 |
| WNU100 | 78026.6 | 0.379 | 0.06 | 19 | — | — | — | — | — | — |
| WNU100 | 78029.3 | 0.350 | 0.16 | 10 | 10.1 | 0.01 | 40 | 6.67 | 0.03 | 12 |
| CONT. | — | 0.319 | — | — | 7.18 | — | — | 5.93 | — | — |
| WNU91 | 76213.2 | — | — | — | — | — | — | 5.87 | 0.23 | 7 |
| WNU91 | 76213.4 | 0.373 | 0.17 | 11 | — | — | — | 5.93 | 0.17 | 8 |
| WNU91 | 76215.5 | — | — | — | — | — | — | 5.93 | 0.05 | 8 |
| WNU70 | 78102.7 | 0.411 | 0.10 | 22 | 8.73 | 0.01 | 51 | 6.85 | L | 25 |
| WNU70 | 78104.1 | 0.416 | 0.09 | 24 | 7.75 | 0.02 | 34 | — | — | — |
| WNU70 | 78104.3 | — | — | — | — | — | — | 6.20 | 0.02 | 13 |
| WNU61 | 78014.1 | 0.370 | 0.07 | 10 | 6.50 | 0.20 | 13 | 5.88 | L | 7 |
| WNU61 | 78014.2 | 0.404 | 0.14 | 20 | 8.59 | 0.16 | 49 | 5.87 | 0.18 | 7 |
| WNU61 | 78015.10 | 0.380 | 0.05 | 13 | 6.35 | 0.20 | 10 | 5.97 | 0.08 | 9 |
| WNU6 | 76542.5 | 0.459 | 0.05 | 37 | 12.6 | 0.04 | 119 | 6.83 | 0.02 | 24 |
| WNU6 | 76544.1 | 0.435 | L | 29 | 7.58 | L | 31 | 6.30 | L | 15 |
| WNU55 | 77632.3 | 0.419 | L | 25 | 7.55 | 0.04 | 31 | — | — | — |
| WNU55 | 77632.6 | 0.389 | 0.04 | 16 | 8.23 | 0.05 | 43 | 5.95 | 0.24 | 8 |
| WNU55 | 77634.1 | 0.351 | 0.24 | 5 | — | — | — | — | — | — |
| WNU51 | 79018.6 | 0.388 | 0.11 | 16 | 7.32 | 0.15 | 27 | 5.93 | 0.02 | 8 |
| WNU51 | 79019.2 | 0.377 | 0.11 | 12 | 7.13 | 0.15 | 24 | — | — | — |
| WNU11 | 76397.2 | 0.401 | 0.15 | 19 | 7.72 | 0.10 | 34 | 6.28 | 0.23 | 14 |
| WNU11 | 76400.2 | 0.389 | 0.09 | 16 | — | — | — | — | — | — |
| WNU105 | 77261.2 | 0.461 | L | 37 | 10.6 | 0.02 | 83 | 6.91 | L | 26 |
| WNU105 | 77263.4 | 0.396 | 0.19 | 18 | 7.63 | 0.29 | 32 | — | — | — |
| CONT. | — | 0.336 | — | — | 5.77 | — | — | 5.50 | — | — |
| WNU91 | 76211.4 | 0.428 | 0.21 | 14 | — | — | — | 6.61 | 0.30 | 9 |
| WNU91 | 76213.2 | 0.464 | L | 23 | 9.57 | 0.10 | 27 | 7.10 | L | 18 |
| WNU91 | 76213.4 | 0.513 | L | 36 | 12.3 | L | 64 | 7.32 | L | 21 |
| WNU70 | 78104.1 | 0.446 | 0.04 | 19 | 9.87 | 0.04 | 31 | — | — | — |
| WNU70 | 78104.3 | 0.505 | 0.03 | 34 | 11.8 | 0.04 | 57 | 7.43 | L | 23 |
| WNU70 | 78104.4 | 0.518 | L | 38 | 9.26 | 0.14 | 23 | 6.70 | 0.04 | 11 |
| WNU7 | 77772.3 | — | — | — | 8.96 | 0.06 | 19 | — | — | — |
| WNU6 | 76544.1 | — | — | — | 8.82 | 0.20 | 18 | 7.23 | 0.02 | 20 |
| WNU6 | 76544.4 | — | — | — | — | — | — | 6.44 | 0.20 | 7 |
| WNU42 | 76597.1 | 0.423 | 0.03 | 12 | — | — | — | — | — | — |
| WNU42 | 76598.1 | 0.423 | 0.15 | 12 | 9.01 | 0.09 | 20 | 6.54 | 0.18 | 8 |
| WNU34 | 76588.5 | — | — | — | — | — | — | 6.44 | 0.19 | 7 |
| WNU14 | 77113.11 | 0.439 | 0.07 | 17 | 9.47 | 0.20 | 26 | — | — | — |
| WNU14 | 77113.4 | — | — | — | — | — | — | 6.38 | 0.28 | 6 |
| WNU14 | 77113.9 | 0.432 | 0.02 | 15 | — | — | — | — | — | — |
| WNU11 | 76397.2 | 0.546 | L | 45 | 10.9 | L | 45 | 7.49 | L | 24 |
| WNU11 | 76398.1 | 0.413 | 0.14 | 10 | — | — | — | — | — | — |
| WNU11 | 76399.1 | — | — | — | — | — | — | 6.48 | 0.19 | 7 |
| WNU11 | 76400.2 | 0.423 | 0.02 | 12 | 8.45 | 0.21 | 12 | — | — | — |
| WNU105 | 77261.4 | 0.472 | L | 26 | 9.22 | 0.10 | 23 | 6.67 | 0.15 | 10 |
| CONT. | — | 0.376 | — | — | 7.51 | — | — | 6.04 | — | — |
| WNU99 | 77100.3 | 0.395 | L | 30 | — | — | — | — | — | — |
| WNU98 | 77462.4 | 0.390 | 0.01 | 28 | 6.49 | 0.21 | 11 | 6.24 | 0.27 | 9 |
| WNU97 | 77181.4 | 0.389 | 0.02 | 28 | — | — | — | — | — | — |
| WNU97 | 77182.2 | 0.359 | 0.10 | 18 | 7.05 | 0.21 | 21 | — | — | — |
| WNU94 | 78108.3 | 0.378 | 0.01 | 24 | 6.74 | 0.18 | 15 | 6.24 | 0.11 | 9 |
| WNU94 | 78110.3 | 0.347 | 0.10 | 14 | — | — | — | — | — | — |
| WNU9 | 76612.1 | 0.377 | 0.04 | 24 | 6.50 | 0.12 | 11 | 6.45 | 0.03 | 12 |
| WNU9 | 76615.4 | — | — | — | — | — | — | 6.27 | 0.26 | 9 |
| WNU9 | 76615.6 | 0.378 | 0.10 | 24 | 7.05 | 0.26 | 20 | — | — | — |
| WNU83 | 75821.8 | 0.395 | L | 30 | — | — | — | — | — | — |
| WNU83 | 75823.10 | 0.376 | 0.05 | 23 | — | — | — | — | — | — |
| WNU81 | 78097.2 | 0.391 | 0.01 | 28 | 7.15 | 0.14 | 22 | 6.34 | 0.13 | 11 |
| WNU81 | 78097.5 | 0.374 | 0.07 | 23 | — | — | — | — | — | — |
| WNU5 | 76044.2 | 0.358 | 0.11 | 18 | 6.69 | 0.08 | 14 | 6.45 | 0.04 | 12 |
| WNU5 | 76045.7 | 0.383 | 0.12 | 26 | — | — | — | 6.49 | 0.12 | 13 |
| WNU46 | 77021.3 | 0.337 | 0.20 | 10 | — | — | — | — | — | — |
| WNU46 | 77024.3 | 0.339 | 0.30 | 11 | 7.03 | 0.20 | 20 | 6.55 | 0.04 | 14 |
| WNU41 | 79012.2 | 0.337 | 0.28 | 11 | — | — | — | — | — | — |

TABLE 77-continued

Genes showing improved plant performance at nitrogen deficient conditions (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| WNU41 | 79012.4 | 0.434 | L | 42 | 7.55 | 0.03 | 29 | 6.21 | 0.14 | 8 |
| WNU41 | 79013.1 | 0.354 | 0.07 | 16 | — | — | — | — | — | — |
| WNU38 | 76594.5 | 0.396 | 0.06 | 30 | 7.15 | 0.12 | 22 | — | — | — |
| WNU38 | 76595.11 | 0.362 | 0.13 | 19 | 6.88 | 0.26 | 17 | 6.35 | 0.09 | 11 |
| WNU35 | 75793.1 | 0.389 | L | 28 | — | — | — | — | — | — |
| WNU31 | 75786.3 | 0.397 | L | 30 | 6.74 | 0.08 | 15 | — | — | — |
| WNU31 | 75790.2 | 0.424 | L | 39 | 7.27 | 0.19 | 24 | 6.35 | 0.10 | 11 |
| WNU31 | 75790.7 | 0.397 | 0.02 | 30 | — | — | — | — | — | — |
| WNU20 | 78336.5 | 0.335 | 0.29 | 10 | — | — | — | — | — | — |
| WNU20 | 78340.1 | 0.399 | L | 31 | 7.45 | L | 27 | 6.62 | 0.02 | 15 |
| WNU20 | 78340.5 | 0.366 | 0.03 | 20 | 7.29 | 0.09 | 24 | 6.36 | 0.13 | 11 |
| CONT. | | 0.305 | — | — | 5.85 | — | — | 5.74 | — | — |
| WNU103_H11 | 78346.4 | 0.399 | 0.024 | 25 | 9.27 | 0.09 | 29 | 6.90 | 0.008 | 16 |
| WNU103_H11 | 78347.1 | — | — | — | 8.98 | 0.12 | 25 | — | — | — |
| WNU22_H1 | 79403.1 | 0.359 | 0.246 | 13 | — | — | — | 6.40 | 0.253 | 8 |
| WNU22_H1 | 79405.2 | 0.389 | 0.023 | 22 | 8.36 | 0.28 | 16 | — | — | — |
| WNU22_H1 | 79464.2 | 0.381 | 0.090 | 20 | 8.63 | 0.26 | 20 | 6.57 | 0.124 | 11 |
| CONT. | | — | 0.319 | — | — | 7.18 | — | — | 5.93 | — |

Table 77.
"CONT."—Control;
"Ave."—Average;
"% Incr." = % increment;
"p-val."—p-value;
L means that p-value is less than 0.01, p < 0.1 was considered as significant.

TABLE 78

Genes showing improved plant performance at nitrogen deficient conditions (T1 generation)

| | Dry Weight [mg] | | |
|---|---|---|---|
| Gene Name | Ave. | P-Val. | % Incr. |
| WNU90 | 6.35 | 0.09 | 25 |
| WNU1 | 6.00 | 0.10 | 18 |
| CONT. | 5.07 | — | — |

Table 78: "CONT."—Control; "Ave."—Average; "% Incr." = % increment. "p-val."—p-value; L means that p-value is less than 0.01, p < 0.1 was considered as significant.

The genes listed in Table 79 have improved plant relative growth rate (relative growth rate of the leaf area, root coverage and root length) when grown under limiting nitrogen growth conditions, compared to control plants (T2 generation) that were grown under identical growth conditions. Plants showing fast growth rate show a better plant establishment in soil under nitrogen deficient conditions. Faster growth was observed when growth rate of leaf area, root length and root coverage was measured.

TABLE 79

Genes showing improved plant growth rate at nitrogen deficient conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| WNU98 | 77462.2 | 0.0444 | 0.16 | 16 | — | — | — | — | — | — |
| WNU98 | 77465.1 | 0.0446 | 0.11 | 17 | 1.33 | 0.03 | 22 | — | — | — |
| WNU97 | 77182.2 | — | — | — | 1.28 | 0.12 | 17 | — | — | — |
| WNU94 | 78108.3 | — | — | — | 1.37 | 0.02 | 25 | 0.630 | 0.21 | 11 |
| WNU83 | 75821.7 | — | — | — | — | — | — | 0.0619 | 0.25 | 9 |
| WNU81 | 78098.2 | 0.0427 | 0.27 | 12 | — | — | — | — | — | — |
| WNU41 | 79012.2 | — | — | — | 1.75 | L | 61 | 0.620 | 0.25 | 9 |
| WNU41 | 79012.4 | 0.0443 | 0.15 | 16 | — | — | — | — | — | — |
| WNU41 | 79013.1 | — | — | — | 1.23 | 0.17 | 12 | — | — | — |
| WNU38 | 76595.11 | 0.0425 | 0.27 | 11 | — | — | — | — | — | — |
| WNU31 | 75790.2 | — | — | — | 1.25 | 0.13 | 15 | — | — | — |
| WNU31 | 75790.7 | — | — | — | 1.41 | 0.05 | 30 | — | — | — |
| WNU20 | 78339.2 | 0.0429 | 0.24 | 12 | — | — | — | — | — | — |
| WNU20 | 78340.5 | — | — | — | 1.37 | L | 26 | — | — | — |
| WNU17 | 76556.3 | — | — | — | 1.47 | L | 35 | — | — | — |
| WNU17 | 76559.1 | — | — | — | 1.25 | 0.20 | 15 | — | — | — |
| CONT. | | 0.0383 | — | — | 1.09 | — | — | 0.569 | — | — |
| WNU96 | 75816.4 | 0.0358 | 0.25 | 18 | 1.34 | L | 55 | 0.604 | 0.27 | 13 |

TABLE 79-continued

Genes showing improved plant growth rate at nitrogen deficient conditions (T2 generation)

| | | RGR Of Leaf Area | | | RGR Of Roots Coverage | | | RGR Of Root Length | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| WNU96 | 75820.6 | — | — | — | — | — | — | 0.612 | 0.19 | 14 |
| WNU93 | 76607.13 | 0.0382 | 0.11 | 26 | 1.27 | L | 46 | — | — | — |
| WNU93 | 76607.9 | — | — | — | 1.08 | 0.16 | 25 | — | — | — |
| WNU93 | 76609.3 | 0.0377 | 0.16 | 24 | 1.13 | 0.11 | 31 | 0.601 | 0.29 | 12 |
| WNU8 | 77117.1 | — | — | — | 1.03 | 0.30 | 19 | — | — | — |
| WNU76 | 77092.1 | 0.0413 | 0.05 | 36 | — | — | — | — | — | — |
| WNU76 | 77095.2 | — | — | — | 1.13 | 0.07 | 30 | — | — | — |
| WNU49 | 75796.8 | 0.0370 | 0.16 | 22 | — | — | — | — | — | — |
| WNU40 | 78091.1 | 0.0371 | 0.14 | 22 | — | — | — | — | — | — |
| WNU40 | 78092.5 | — | — | — | 1.25 | 0.01 | 44 | — | — | — |
| WNU37 | 77766.2 | 0.0370 | 0.16 | 22 | 1.12 | 0.09 | 30 | — | — | — |
| WNU37 | 77767.1 | 0.0369 | 0.19 | 22 | 1.09 | 0.12 | 27 | — | — | — |
| WNU37 | 77767.3 | 0.0368 | 0.17 | 21 | 1.32 | L | 52 | 0.612 | 0.22 | 14 |
| WNU23 | 78341.7 | 0.0354 | 0.27 | 17 | — | — | — | 0.603 | 0.28 | 13 |
| WNU23 | 78343.1 | 0.0408 | 0.05 | 34 | 1.17 | 0.07 | 35 | 0.648 | 0.10 | 21 |
| WNU23 | 78344.2 | 0.0365 | 0.18 | 20 | — | — | — | — | — | — |
| WNU102 | 76549.12 | 0.0418 | 0.02 | 38 | 1.44 | L | 67 | — | — | — |
| WNU102 | 76550.4 | 0.0423 | 0.01 | 39 | 1.48 | L | 71 | 0.605 | 0.26 | 13 |
| WNU100 | 77989.3 | 0.0385 | 0.08 | 27 | 1.03 | 0.21 | 19 | — | — | — |
| WNU100 | 78026.6 | 0.0362 | 0.22 | 19 | — | — | — | — | — | — |
| WNU100 | 78029.3 | — | — | — | 1.21 | 0.02 | 40 | 0.615 | 0.18 | 15 |
| CONT. | | 0.0304 | — | — | 0.865 | — | — | 0.535 | — | — |
| WNU91 | 76213.4 | 0.0355 | 0.27 | 13 | — | — | — | 0.553 | 0.04 | 17 |
| WNU70 | 78102.7 | 0.0373 | 0.17 | 19 | 1.02 | L | 51 | 0.577 | L | 22 |
| WNU70 | 78104.1 | 0.0388 | 0.06 | 24 | 0.934 | 0.04 | 39 | 0.568 | 0.09 | 20 |
| WNU70 | 78104.3 | — | — | — | — | — | — | 0.566 | 0.01 | 20 |
| WNU61 | 78014.1 | 0.0358 | 0.19 | 15 | 0.784 | 0.29 | 16 | 0.551 | 0.02 | 16 |
| WNU61 | 78014.2 | — | — | — | 1.02 | 0.03 | 51 | 0.525 | 0.18 | 11 |
| WNU61 | 78015.10 | 0.0366 | 0.12 | 17 | — | — | — | 0.536 | 0.10 | 13 |
| WNU6 | 76542.5 | 0.0402 | 0.04 | 29 | 1.49 | L | 121 | 0.553 | 0.08 | 17 |
| WNU6 | 76544.1 | 0.0369 | 0.11 | 18 | 0.893 | 0.04 | 32 | 0.531 | 0.09 | 12 |
| WNU55 | 77632.3 | — | — | — | 0.902 | 0.06 | 34 | — | — | — |
| WNU55 | 77632.6 | — | — | — | 0.958 | 0.02 | 42 | — | — | — |
| WNU51 | 79018.6 | 0.0370 | 0.14 | 18 | 0.892 | 0.07 | 32 | 0.580 | L | 22 |
| WNU51 | 79019.2 | 0.0353 | 0.29 | 13 | 0.861 | 0.12 | 28 | 0.544 | 0.08 | 15 |
| WNU11 | 76397.2 | 0.0360 | 0.29 | 15 | 0.912 | 0.06 | 35 | 0.534 | 0.28 | 13 |
| WNU11 | 76398.1 | — | — | — | — | — | — | 0.518 | 0.25 | 10 |
| WNU105 | 77261.2 | 0.0408 | 0.01 | 30 | 1.25 | L | 89 | 0.602 | L | 27 |
| WNU105 | 77263.4 | 0.0377 | 0.14 | 20 | 0.920 | 0.10 | 36 | 0.544 | 0.11 | 15 |
| CONT. | | 0.0313 | — | — | 0.674 | — | — | 0.473 | — | — |
| WNU91 | 76211.4 | — | — | — | 1.08 | 0.18 | 21 | 0.606 | 0.29 | 10 |
| WNU91 | 76213.2 | 0.0443 | 0.12 | 21 | 1.12 | 0.06 | 26 | — | — | — |
| WNU91 | 76123.4 | 0.0466 | 0.05 | 28 | 1.46 | L | 63 | 0.640 | 0.02 | 16 |
| WNU70 | 78104.1 | — | — | — | 1.18 | 0.02 | 32 | — | — | — |
| WNU70 | 78104.3 | 0.0461 | 0.07 | 26 | 1.39 | L | 56 | 0.634 | 0.05 | 15 |
| WNU70 | 78104.4 | 0.0457 | 0.06 | 25 | 1.11 | 0.08 | 24 | 0.622 | 0.07 | 13 |
| WNU7 | 77772.3 | — | — | — | 1.08 | 0.11 | 21 | — | — | — |
| WNU7 | 77775.1 | — | — | — | 1.06 | 0.26 | 19 | — | — | — |
| WNU6 | 76544.1 | 0.0425 | 0.25 | 17 | 1.05 | 0.20 | 17 | 0.643 | 0.03 | 17 |
| WNU42 | 76598.1 | 0.0426 | 0.24 | 17 | 1.07 | 0.13 | 20 | 0.599 | 0.25 | 9 |
| WNU14 | 77113.11 | — | — | — | 1.11 | 0.10 | 24 | — | — | — |
| WNU11 | 76397.2 | 0.0504 | L | 38 | 1.29 | L | 44 | 0.626 | 0.08 | 13 |
| WNU105 | 77261.4 | 0.0446 | 0.11 | 22 | 1.09 | 0.10 | 22 | — | — | — |
| CONT. | | 0.0365 | — | — | 0.893 | — | — | 0.552 | — | — |
| WNU99 | 77100.3 | 0.0366 | 0.10 | 27 | — | — | — | — | — | — |
| WNU97 | 77181.4 | 0.0386 | 0.06 | 34 | — | — | — | 0.559 | 0.12 | 17 |
| WNU97 | 77182.2 | 0.0348 | 0.21 | 21 | 0.837 | 0.17 | 21 | — | — | — |
| WNU94 | 78108.3 | 0.0367 | 0.09 | 27 | 0.798 | 0.24 | 15 | — | — | — |
| WNU94 | 78110.3 | 0.0339 | 0.26 | 18 | — | — | — | — | — | — |
| WNU9 | 76612.1 | 0.0358 | 0.16 | 24 | — | — | — | 0.573 | 0.06 | 20 |
| WNU9 | 76615.6 | 0.0345 | 0.27 | 20 | 0.838 | 0.16 | 21 | — | — | — |
| WNU83 | 75821.8 | 0.0370 | 0.08 | 29 | — | — | — | 0.546 | 0.18 | 14 |
| WNU81 | 78097.2 | 0.0370 | 0.09 | 28 | 0.850 | 0.11 | 23 | 0.543 | 0.24 | 13 |
| WNU81 | 78097.5 | 0.0360 | 0.15 | 25 | — | — | — | — | — | — |
| WNU5 | 76044.2 | 0.0356 | 0.17 | 24 | 0.789 | 0.26 | 14 | 0.532 | 0.27 | 11 |
| WNU5 | 76045.7 | 0.0381 | 0.09 | 32 | 0.824 | 0.20 | 19 | 0.560 | 0.15 | 17 |
| WNU46 | 77024.3 | 0.0339 | 0.28 | 18 | 0.825 | 0.17 | 19 | 0.535 | 0.28 | 12 |
| WNU41 | 79012.4 | 0.0420 | 0.01 | 46 | 0.894 | 0.05 | 29 | — | — | — |
| WNU41 | 79013.1 | 0.0347 | 0.20 | 20 | — | — | — | — | — | — |
| WNU38 | 76594.5 | 0.0388 | 0.06 | 35 | 0.851 | 0.11 | 23 | 0.536 | 0.30 | 12 |
| WNU38 | 76595.11 | 0.0359 | 0.17 | 25 | 0.811 | 0.23 | 17 | — | — | — |
| WNU35 | 75793.1 | 0.0363 | 0.11 | 26 | — | — | — | 0.576 | 0.06 | 20 |

TABLE 79-continued

Genes showing improved plant growth rate at nitrogen deficient conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| WNU31 | 75786.3 | 0.0361 | 0.11 | 25 | 0.803 | 0.18 | 16 | — | — | — |
| WNU31 | 75790.2 | 0.0371 | 0.10 | 29 | 0.863 | 0.11 | 25 | 0.580 | 0.06 | 21 |
| WNU31 | 75790.7 | 0.0374 | 0.10 | 30 | — | — | — | — | — | — |
| WNU20 | 78336.5 | — | — | — | — | — | — | 0.547 | 0.19 | 14 |
| WNU20 | 78340.1 | 0.0384 | 0.05 | 33 | 0.879 | 0.03 | 27 | 0.574 | 0.06 | 20 |
| WNU20 | 78340.5 | 0.0345 | 0.23 | 20 | 0.866 | 0.08 | 25 | — | — | — |
| CONT. | — | 0.0288 | — | — | 0.692 | — | — | 0.479 | — | — |
| WNU103_H11 | 78346.4 | 0.0378 | 0.117 | 24 | 1.117 | 0.088 | 29 | 0.604 | 0.252 | 13 |
| WNU103_H11 | 78347.1 | — | — | — | 1.053 | 0.203 | 22 | — | — | — |
| WNU22_H1 | 79464.2 | — | — | — | 1.035 | 0.250 | 20 | — | — | — |
| CONT. | — | 0.030 | — | — | 0.865 | — | — | 0.535 | — | — |

Table 79.
"CONT."—Control;
"Ave."—Average;
"% Incr." = % increment;
"p-val."—p-value;
L means that p-value is less than 0.01, p < 0.1 was considered as significant.

The genes listed in Tables 80-83 improved plant NUE when grown at standard nitrogen concentration levels. These genes produced larger plant biomass (plant fresh and dry weight; leaf area, root coverage and roots length) when grown under standard nitrogen growth conditions, compared to control plants that were grown under identical growth conditions in T2 (Tables 80-81) and T1 (Tables 82-83) generations. Larger plant biomass under these growth conditions indicates the high ability of the plant to better metabolize the nitrogen present in the medium. Plants producing larger root biomass have better possibilities to absorb larger amount of nitrogen from soil.

TABLE 80

Genes showing improved plant performance at standard nitrogen growth conditions (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| WNU91 | 76213.2 | 3.50 | 0.24 | 19 | — | — | — |
| WNU70 | 78102.7 | 4.67 | 0.20 | 59 | 66.9 | L | 35 |
| WNU70 | 78104.1 | 4.77 | 0.12 | 63 | 80.5 | 0.02 | 63 |
| WNU61 | 78014.2 | 6.43 | 0.14 | 119 | 115.2 | 0.04 | 133 |
| WNU6 | 76542.5 | 6.12 | 0.10 | 109 | 108.5 | 0.09 | 120 |
| WNU6 | 76544.1 | 4.45 | 0.25 | 51 | 71.5 | 0.18 | 45 |
| WNU6 | 76544.4 | 5.77 | 0.02 | 97 | 81.7 | L | 65 |
| WNU55 | 77632.3 | 6.28 | 0.01 | 114 | 115.5 | L | 134 |
| WNU55 | 77632.6 | 7.03 | 0.01 | 139 | 102.3 | 0.10 | 107 |
| WNU55 | 77634.1 | 4.35 | L | 48 | 73.5 | L | 49 |
| WNU51 | 79018.4 | 3.60 | L | 23 | 61.8 | 0.12 | 25 |
| WNU51 | 79018.6 | 4.12 | 0.24 | 40 | 71.1 | 0.18 | 44 |
| WNU11 | 76397.2 | 5.47 | L | 86 | 105.4 | L | 113 |
| WNU105 | 77261.2 | 7.58 | 0.01 | 158 | 133.4 | L | 170 |
| WNU105 | 77261.4 | 5.88 | L | 100 | 102.8 | 0.08 | 108 |
| WNU105 | 77263.4 | 4.57 | 0.07 | 55 | 62.8 | 0.19 | 27 |
| CONT. | — | 2.94 | — | — | 49.4 | — | — |
| WNU99 | 77097.4 | 4.80 | 0.24 | 121 | 67.2 | L | 78 |
| WNU99 | 77099.4 | 4.75 | 0.06 | 118 | 72.5 | 0.02 | 92 |
| WNU99 | 77100.3 | 3.67 | 0.06 | 69 | 59.5 | 0.08 | 57 |
| WNU98 | 77462.4 | 3.43 | 0.02 | 57 | 49.8 | 0.07 | 32 |
| WNU98 | 77463.13 | 3.95 | L | 82 | 60.8 | L | 61 |
| WNU98 | 77465.1 | — | — | — | 48.3 | 0.19 | 28 |
| WNU97 | 77181.4 | 3.17 | 0.09 | 46 | 54.8 | 0.06 | 45 |
| WNU97 | 77182.2 | 2.75 | 0.03 | 26 | 46.9 | 0.04 | 24 |
| WNU94 | 78108.3 | 3.38 | L | 55 | 58.4 | 0.03 | 54 |
| WNU94 | 78109.1 | 3.32 | L | 53 | 46.4 | 0.17 | 22 |
| WNU94 | 78110.3 | 3.67 | 0.06 | 69 | 53.5 | 0.21 | 41 |
| WNU9 | 76612.1 | 2.80 | 0.06 | 29 | 49.5 | 0.09 | 31 |
| WNU9 | 76615.4 | 2.58 | 0.14 | 18 | — | — | — |
| WNU9 | 76615.6 | 4.38 | L | 101 | 65.2 | 0.02 | 72 |
| WNU83 | 75821.8 | 3.67 | L | 69 | 51.3 | 0.01 | 36 |
| WNU83 | 75823.10 | 4.68 | L | 115 | 65.9 | 0.01 | 74 |
| WNU81 | 78097.2 | 2.82 | 0.02 | 30 | — | — | — |
| WNU81 | 78097.5 | 4.60 | L | 111 | 69.4 | 0.05 | 83 |
| WNU81 | 78098.2 | 2.73 | 0.12 | 25 | 44.5 | 0.17 | 17 |
| WNU5 | 76044.2 | 3.75 | 0.02 | 72 | 61.2 | L | 62 |
| WNU5 | 76045.7 | 3.17 | 0.08 | 46 | 47.7 | 0.20 | 26 |
| WNU46 | 77021.3 | 4.73 | 0.04 | 118 | 62.8 | 0.01 | 66 |
| WNU46 | 77022.1 | 3.37 | L | 55 | — | — | — |
| WNU46 | 77024.3 | 2.82 | 0.02 | 30 | — | — | — |
| WNU43 | 77270.2 | 3.32 | L | 53 | 44.9 | 0.19 | 19 |
| WNU41 | 79012.2 | 3.32 | 0.01 | 53 | 55.3 | L | 46 |
| WNU41 | 79012.4 | 4.50 | L | 107 | 66.4 | 0.01 | 75 |
| WNU41 | 79013.1 | 3.12 | 0.13 | 44 | — | — | — |
| WNU38 | 76591.4 | 2.70 | 0.08 | 24 | — | — | — |
| WNU38 | 76594.5 | 2.93 | 0.14 | 34 | — | — | — |
| WNU38 | 76595.11 | 2.65 | 0.30 | 22 | — | — | — |
| WNU35 | 75792.2 | 3.58 | 0.01 | 64 | 59.7 | L | 58 |
| WNU35 | 75793.1 | 4.10 | L | 89 | 68.1 | 0.03 | 80 |
| WNU35 | 75794.1 | 2.93 | 0.02 | 34 | 45.4 | 0.10 | 20 |
| WNU31 | 75786.3 | 3.43 | L | 57 | 60.5 | 0.03 | 60 |
| WNU31 | 75790.2 | 3.97 | L | 82 | 54.6 | L | 44 |
| WNU31 | 75790.7 | 3.73 | L | 71 | 66.2 | L | 75 |
| WNU20 | 78340.1 | 3.38 | 0.03 | 55 | 46.3 | 0.10 | 22 |
| WNU20 | 78340.5 | 3.47 | 0.09 | 60 | 52.9 | 0.05 | 40 |
| WNU17 | 76556.4 | 3.85 | 0.02 | 77 | 59.9 | L | 58 |
| WNU17 | 76557.4 | 2.62 | 0.22 | 21 | 42.1 | 0.28 | 11 |
| WNU17 | 76559.1 | 3.12 | 0.05 | 44 | 59.4 | 0.05 | 57 |
| CONT. | — | 2.17 | — | — | 37.8 | — | — |

Table 80.
"CONT."—Control;
"Ave."—Average;
"% Incr." = % increment;
"p-val."—p-value;
L means that p-value is less than 0.01, p < 0.1 was considered as significant.

TABLE 81

Genes showing improved plant performance at standard nitrogen growth conditions (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| WNU91 | 76213.4 | 0.403 | 0.27 | 12 | — | — | — | 5.50 | 0.25 | 8 |
| WNU91 | 76215.5 | — | — | — | 5.60 | 0.17 | 34 | 5.81 | 0.10 | 15 |
| WNU70 | 78102.7 | 0.498 | 0.11 | 38 | 5.99 | 0.21 | 44 | 5.79 | 0.25 | 14 |
| WNU70 | 78104.1 | 0.485 | 0.05 | 35 | — | — | — | — | — | — |
| WNU70 | 78104.3 | — | — | — | 5.34 | 0.22 | 28 | 5.58 | 0.22 | 10 |
| WNU61 | 78014.1 | 0.451 | 0.05 | 25 | 5.34 | 0.20 | 28 | 5.77 | 0.10 | 14 |
| WNU61 | 78014.2 | 0.585 | 0.07 | 63 | 5.93 | 0.10 | 42 | — | — | — |
| WNU61 | 78015.10 | 0.387 | 0.26 | 8 | — | — | — | — | — | — |
| WNU6 | 76542.5 | 0.534 | 0.10 | 48 | 7.95 | 0.04 | 91 | 6.50 | 0.02 | 28 |
| WNU6 | 76544.4 | 0.468 | L | 30 | 7.51 | L | 80 | 6.29 | L | 24 |
| WNU55 | 77632.3 | 0.651 | L | 81 | 6.31 | L | 51 | 5.58 | 0.27 | 10 |
| WNU55 | 77632.6 | 0.597 | L | 66 | 6.90 | 0.05 | 65 | — | — | — |
| WNU55 | 77634.1 | 0.442 | 0.02 | 23 | — | — | — | — | — | — |
| WNU51 | 79018.6 | 0.465 | 0.05 | 29 | 6.09 | 0.06 | 46 | 5.58 | 0.22 | 10 |
| WNU11 | 76397.2 | 0.546 | L | 52 | 6.81 | L | 63 | 5.96 | 0.06 | 18 |
| WNU11 | 76400.2 | — | — | — | — | — | — | 5.63 | 0.28 | 11 |
| WNU105 | 77261.2 | 0.713 | L | 98 | 10.2 | L | 144 | 6.52 | L | 29 |
| WNU105 | 77261.4 | 0.531 | 0.02 | 48 | 6.30 | 0.04 | 51 | 5.94 | 0.12 | 17 |
| WNU105 | 77263.4 | 0.410 | 0.08 | 14 | — | — | — | — | — | — |
| CONT. | — | 0.360 | — | — | 4.17 | — | — | 5.07 | — | — |
| WNU99 | 77097.4 | 0.409 | L | 39 | 5.03 | 0.04 | 48 | — | — | — |
| WNU99 | 77099.4 | 0.440 | 0.01 | 49 | — | — | — | — | — | — |
| WNU99 | 77100.3 | 0.426 | 0.01 | 45 | — | — | — | — | — | — |
| WNU98 | 77462.4 | 0.393 | L | 34 | 4.94 | 0.02 | 46 | 6.13 | 0.02 | 15 |
| WNU98 | 77463.13 | 0.430 | L | 46 | 4.30 | 0.24 | 27 | — | — | — |
| WNU98 | 77465.1 | 0.352 | 0.11 | 20 | — | — | — | — | — | — |
| WNU97 | 77181.4 | 0.407 | 0.01 | 38 | 5.07 | 0.10 | 49 | — | — | — |
| WNU97 | 77182.2 | 0.356 | 0.04 | 21 | — | — | — | — | — | — |
| WNU94 | 78108.3 | 0.407 | 0.02 | 38 | 5.24 | 0.02 | 54 | 5.71 | 0.22 | 7 |
| WNU94 | 78109.1 | 0.358 | 0.04 | 22 | — | — | — | — | — | — |
| WNU94 | 78110.3 | 0.411 | L | 40 | 4.63 | 0.05 | 36 | — | — | — |
| WNU9 | 76612.1 | 0.416 | L | 41 | 5.41 | 0.01 | 59 | 6.27 | 0.03 | 17 |
| WNU9 | 76615.4 | 0.336 | 0.14 | 14 | 4.31 | 0.21 | 27 | 5.85 | 0.25 | 10 |
| WNU9 | 76615.6 | 0.461 | L | 57 | 5.87 | L | 73 | 6.37 | L | 19 |
| WNU83 | 75821.8 | 0.448 | L | 52 | 4.04 | 0.27 | 19 | — | — | — |
| WNU83 | 75823.10 | 0.485 | L | 65 | 6.15 | L | 81 | 6.29 | L | 18 |
| WNU83 | 75824.4 | — | — | — | 4.26 | 0.23 | 25 | 5.84 | 0.21 | 9 |
| WNU81 | 78097.2 | 0.344 | 0.12 | 17 | 4.62 | 0.04 | 36 | 5.82 | 0.14 | 9 |
| WNU81 | 78097.5 | 0.442 | L | 50 | 5.63 | L | 66 | 6.34 | 0.04 | 19 |
| WNU5 | 76044.2 | 0.413 | L | 41 | 6.57 | L | 93 | 6.44 | L | 21 |
| WNU5 | 76045.7 | 0.355 | 0.06 | 21 | 3.96 | 0.29 | 16 | 5.75 | 0.27 | 8 |
| WNU46 | 77021.3 | 0.454 | L | 55 | — | — | — | — | — | — |
| WNU46 | 77022.1 | 0.359 | 0.29 | 22 | 4.52 | 0.05 | 33 | — | — | — |
| WNU46 | 77024.3 | 0.358 | 0.04 | 22 | 4.56 | 0.04 | 34 | 6.28 | L | 18 |
| WNU41 | 79012.2 | 0.395 | L | 34 | 5.09 | 0.03 | 50 | — | — | — |
| WNU41 | 79012.4 | 0.479 | L | 63 | 5.45 | 0.08 | 61 | 6.01 | 0.23 | 13 |
| WNU41 | 79013.1 | 0.402 | L | 37 | 4.89 | 0.04 | 44 | 6.00 | 0.10 | 12 |
| WNU38 | 76591.4 | 0.357 | 0.04 | 22 | — | — | — | — | — | — |
| WNU38 | 76594.5 | 0.395 | 0.05 | 34 | 5.00 | 0.21 | 47 | — | — | — |
| WNU38 | 76595.1 | 0.346 | 0.13 | 17 | 4.69 | 0.22 | 38 | 5.90 | 0.24 | 10 |
| WNU35 | 75792.2 | 0.419 | L | 42 | 4.84 | 0.08 | 42 | — | — | — |
| WNU35 | 75793.1 | 0.460 | L | 56 | 5.04 | 0.01 | 48 | — | — | — |
| WNU35 | 75794.1 | 0.341 | 0.18 | 16 | 4.39 | 0.11 | 29 | 5.97 | 0.14 | 12 |
| WNU31 | 75786.3 | 0.389 | 0.02 | 32 | 5.11 | 0.01 | 50 | 5.83 | 0.13 | 9 |
| WNU31 | 75790.2 | 0.399 | 0.05 | 36 | 5.29 | L | 56 | — | — | — |
| WNU31 | 75790.7 | 0.430 | L | 46 | 4.44 | 0.08 | 31 | — | — | — |
| WNU20 | 78336.5 | — | — | — | 5.04 | 0.18 | 48 | 5.97 | 0.10 | 12 |
| WNU20 | 78340.1 | 0.406 | 0.01 | 38 | 5.63 | 0.03 | 66 | 6.63 | L | 24 |
| WNU20 | 78340.5 | 0.397 | 0.06 | 35 | 5.82 | 0.01 | 71 | 6.17 | 0.01 | 16 |
| WNU17 | 76556.4 | 0.409 | 0.03 | 39 | 4.67 | 0.12 | 37 | — | — | — |
| WNU17 | 76557.4 | 0.363 | 0.02 | 23 | — | — | — | — | — | — |

TABLE 81-continued

Genes showing improved plant performance at standard nitrogen growth conditions (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| WNU17 | 76559.1 | 0.389 | 0.05 | 32 | 5.19 | 0.10 | 53 | 6.07 | 0.09 | 14 |
| CONT. | — | 0.294 | — | — | 3.40 | — | — | 5.34 | — | — |

Table 81.
"CONT."—Control;
"Ave."—Average;
"% Incr." = % increment;
"p-val."—p-value;
L means that p-value is less than 0.01, p < 0.1 was considered as significant.

TABLE 82

Genes showing improved plant performance at standard nitrogen growth conditions (T1 generation)

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| WNU1 | 7.73 | 0.17 | 48 | 119.6 | 0.10 | 64 |
| CONT. | 5.23 | — | — | 73.2 | — | — |

Table 82.
"CONT."—Control;
"Ave."—Average;
"% Incr." = % increment;
"p-val."—p-value;
L means that p-value is less than 0.01, p < 0.1 was considered as significant.

TABLE 83

Genes showing improved plant performance at standard nitrogen growth conditions (T1 generation)

| Gene Name | Leaf Area [cm²] | | | Roots Coverage [cm²] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| WNU69 | 0.701 | 0.25 | 18 | 7.19 | 0.07 | 39 | 6.53 | 0.03 | 24 |
| WNU12 | — | — | — | — | — | — | 5.64 | 0.28 | 7 |
| CONT. | 0.592 | — | — | 5.18 | — | — | 5.28 | — | — |

Table 83: "CONT."—Control;
"Ave."—Average;
"% Incr." = % increment;
"p-val."—p-value;
L means that p-value is less than 0.01, p < 0.1 was considered as significant.

The genes listed in Table 84-85 improved plant relative growth rate (RGR of leaf area, root length and root coverage) when grown at standard nitrogen concentration levels. These genes produced plants that grew faster than control plants when grown under standard nitrogen growth conditions. Faster growth was observed when growth rate of leaf area, root length and root coverage was measured.

TABLE 84

Genes showing improved growth rate at standard nitrogen growth conditions (T2 generation)

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| WNU91 | 76215.5 | — | — | — | 0.650 | 0.16 | 34 | — | — | — |
| WNU70 | 78102.7 | 0.0473 | 0.05 | 34 | 0.706 | 0.09 | 46 | — | — | — |

TABLE 84-continued

Genes showing improved growth rate at standard nitrogen growth conditions (T2 generation)

| | | RGR Of Leaf Area | | | RGR Of Roots Coverage | | | RGR Of Root Length | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| WNU70 | 78104.1 | 0.0468 | 0.03 | 33 | — | — | — | — | — | — |
| WNU70 | 78104.3 | — | — | — | 0.618 | 0.25 | 28 | — | — | — |
| WNU61 | 78014.1 | 0.0430 | 0.13 | 22 | 0.636 | 0.17 | 32 | 0.512 | 0.23 | 16 |
| WNU61 | 78014.2 | 0.0583 | L | 66 | 0.698 | 0.10 | 44 | — | — | — |
| WNU6 | 76542.5 | 0.0518 | 0.03 | 47 | 0.921 | L | 90 | 0.528 | 0.19 | 20 |
| WNU6 | 76544.4 | 0.0410 | 0.20 | 16 | 0.879 | L | 82 | 0.527 | 0.16 | 20 |
| WNU55 | 77632.3 | 0.0599 | L | 70 | 0.736 | 0.02 | 52 | — | — | — |
| WNU55 | 77632.6 | 0.0581 | L | 65 | 0.808 | 0.01 | 67 | — | — | — |
| WNU55 | 77634.1 | 0.0428 | 0.12 | 22 | — | — | — | — | — | — |
| WNU51 | 79018.6 | 0.0462 | 0.04 | 31 | 0.740 | 0.03 | 53 | 0.562 | 0.05 | 28 |
| WNU11 | 76397.2 | 0.0522 | L | 48 | 0.807 | 0.01 | 67 | 0.546 | 0.13 | 24 |
| WNU105 | 77261.2 | 0.0705 | L | 100 | 1.17 | L | 141 | 0.546 | 0.08 | 24 |
| WNU105 | 77261.4 | 0.0507 | L | 44 | 0.710 | 0.05 | 47 | — | — | — |
| WNU105 | 77263.4 | 0.0414 | 0.24 | 18 | — | — | — | — | — | — |
| CONT. | — | 0.0352 | — | — | 0.484 | — | — | 0.440 | — | — |
| WNU99 | 77097.4 | 0.0393 | 0.08 | 38 | 0.594 | 0.05 | 51 | — | — | — |
| WNU99 | 77099.4 | 0.0422 | 0.02 | 49 | — | — | — | — | — | — |
| WNU99 | 77100.3 | 0.0398 | 0.03 | 40 | — | — | — | — | — | — |
| WNU98 | 77462.4 | 0.0361 | 0.11 | 27 | 0.567 | 0.03 | 44 | 0.504 | 0.17 | 15 |
| WNU98 | 77463.13 | 0.0430 | L | 51 | 0.495 | 0.22 | 25 | — | — | — |
| WNU97 | 77181.4 | 0.0402 | 0.02 | 42 | 0.585 | 0.04 | 48 | — | — | — |
| WNU97 | 77182.2 | 0.0347 | 0.29 | 22 | — | — | — | — | — | — |
| WNU94 | 78108.3 | 0.0399 | 0.03 | 40 | 0.623 | L | 58 | 0.497 | 0.20 | 14 |
| WNU94 | 78109.1 | 0.0340 | 0.22 | 20 | — | — | — | — | — | — |
| WNU94 | 78110.3 | 0.0415 | 0.02 | 46 | 0.552 | 0.08 | 40 | — | — | — |
| WNU9 | 76612.1 | 0.0393 | 0.03 | 38 | 0.651 | L | 65 | 0.538 | 0.05 | 23 |
| WNU9 | 76615.4 | — | — | — | 0.494 | 0.21 | 25 | — | — | — |
| WNU9 | 76615.6 | 0.0437 | L | 54 | 0.674 | L | 71 | 0.510 | 0.14 | 17 |
| WNU83 | 75821.8 | 0.0444 | L | 56 | 0.486 | 0.23 | 23 | — | — | — |
| WNU83 | 75823.10 | 0.0473 | L | 66 | 0.717 | L | 82 | 0.557 | 0.02 | 27 |
| WNU83 | 75824.4 | — | — | — | 0.486 | 0.25 | 23 | — | — | — |
| WNU81 | 78097.2 | — | — | — | 0.557 | 0.04 | 41 | 0.546 | 0.03 | 25 |
| WNU81 | 78097.5 | 0.0453 | L | 59 | 0.654 | L | 66 | 0.523 | 0.15 | 19 |
| WNU5 | 76044.2 | 0.0427 | L | 50 | 0.767 | L | 94 | 0.530 | 0.07 | 21 |
| WNU5 | 76045.7 | 0.0340 | 0.21 | 20 | — | — | — | — | — | — |
| WNU46 | 77021.3 | 0.0430 | 0.01 | 51 | — | — | — | — | — | — |
| WNU46 | 77022.1 | 0.0357 | 0.22 | 26 | 0.543 | 0.08 | 38 | 0.506 | 0.21 | 16 |
| WNU46 | 77024.3 | 0.0351 | 0.14 | 24 | 0.524 | 0.09 | 33 | 0.521 | 0.08 | 19 |
| WNU41 | 79012.2 | 0.0387 | 0.03 | 36 | 0.595 | 0.02 | 51 | — | — | — |
| WNU41 | 79012.4 | 0.0451 | L | 59 | 0.634 | 0.01 | 61 | — | — | — |
| WNU41 | 79013.1 | 0.0399 | 0.02 | 41 | 0.560 | 0.05 | 42 | — | — | — |
| WNU38 | 76591.4 | 0.0346 | 0.18 | 22 | — | — | — | — | — | — |
| WNU38 | 76594.5 | 0.0400 | 0.02 | 41 | 0.594 | 0.05 | 51 | 0.516 | 0.19 | 18 |
| WNU38 | 76595.11 | 0.0350 | 0.15 | 23 | 0.546 | 0.10 | 38 | — | — | — |
| WNU35 | 75792.2 | 0.0406 | 0.01 | 43 | 0.586 | 0.03 | 49 | 0.523 | 0.10 | 19 |
| WNU35 | 75793.1 | 0.0457 | L | 61 | 0.597 | 0.02 | 51 | — | — | — |
| WNU35 | 75794.1 | — | — | — | 0.508 | 0.14 | 29 | — | — | — |
| WNU31 | 75786.3 | 0.0376 | 0.06 | 32 | 0.608 | L | 54 | — | — | — |
| WNU31 | 75790.2 | 0.0366 | 0.13 | 29 | 0.628 | L | 59 | 0.504 | 0.22 | 15 |
| WNU31 | 75790.7 | 0.0409 | 0.01 | 44 | 0.515 | 0.12 | 31 | — | — | — |
| WNU20 | 78336.5 | — | — | — | 0.600 | 0.04 | 52 | 0.508 | 0.16 | 16 |
| WNU20 | 78340.1 | 0.0403 | 0.02 | 42 | 0.649 | L | 65 | 0.558 | 0.02 | 28 |
| WNU20 | 78340.5 | 0.0388 | 0.06 | 37 | 0.690 | L | 75 | 0.494 | 0.22 | 13 |
| WNU17 | 76556.4 | 0.0396 | 0.04 | 39 | 0.537 | 0.10 | 36 | — | — | — |
| WNU17 | 76557.4 | 0.0352 | 0.14 | 24 | — | — | — | 0.509 | 0.15 | 16 |
| WNU17 | 76559.1 | 0.0383 | 0.06 | 35 | 0.613 | 0.02 | 55 | 0.517 | 0.14 | 18 |
| CONT. | — | 0.0284 | — | — | 0.394 | — | — | 0.437 | — | — |

Table 84: "CONT."—Control;
"Ave."—Average;
"% Incr." = % increment;
"p-val."—p-value;
L means that p-value is less than 0.01, p < 0.1 was considered as significant.

TABLE 85

Genes showing improved growth rate at standard nitrogen growth conditions (T1 generation)

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| WNU69 | 0.0721 | 0.11 | 31 | 0.864 | 0.02 | 43 | 0.672 | L | 33 |
| WNU12 | — | — | — | — | — | — | 0.550 | 0.23 | 9 |
| CONT. | 0.0550 | — | — | 0.604 | — | — | 0.506 | — | — |

Table 85. "CONT."—Control;
"Ave."—Average;
"% Incr." = % increment;
"p-val."—p-value;
L means that p-value is less than 0.01, p < 0.1 was considered as significant.

Example 19

Evaluation of Transgenic *Arabidopsis* Nue, Yield and Plant Growth Rate Under Low or Normal Nitrogen Fertilization in Greenhouse Assay Assay 1: Nitrogen Use Efficiency: Seed Yield, Plant Biomass and Plant Growth Rate at Limited and Optimal Nitrogen Concentration Under Greenhouse Conditions (Greenhouse-Seed Maturation)—

This assay follows seed yield production, the biomass formation and the rosette area growth of plants grown in the greenhouse at limiting and non-limiting (optimal) nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 1.5 mM inorganic nitrogen in the form of $KNO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $KNO_3$ with 1 mM $KH_2PO_4$, 1 mM $MgSO_4$, 2 mM $CaCl_2$ and microelements. All plants were grown in the greenhouse until mature seeds. Seeds were harvested, extracted and weighted. The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying the At6669 promoter and the selectable marker was used as control.

The plants were analyzed for their overall size, growth rate, flowering, seed yield, 1,000-seed weight, dry matter and harvest index (HI-seed yield/dry matter). Transgenic plants performance was compared to control plants grown in parallel under identical growth conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which is developed at the U.S. National Institutes of Health and freely available on the internet at rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, leaf blade area.

Vegetative growth rate: the relative growth rate (RGR) of leaf number [Formula VIII (described above)], rosette area [Formula IX (described above)], plot coverage [Formula XI (described above)] and harvest index [Formula XV (described above)] was calculated with the indicated formulas.

Seeds average weight—At the end of the experiment all seeds were collected. The seeds were scattered on a glass tray and a picture was taken. Using the digital analysis, the number of seeds in each sample was calculated.

Dry weight and seed yield—On about day 80 from sowing, the plants were harvested and left to dry at 30° C. in a drying chamber. The biomass and seed weight of each plot were measured and divided by the number of plants in each plot. Dry weight=total weight of the vegetative portion above ground (excluding roots) after drying at 30° C. in a drying chamber; Seed yield per plant=total seed weight per plant (gr). 1000 seed weight (the weight of 1000 seeds) (gr.).

The harvest index (HI) was calculated using Formula XV as described above.

Oil percentage in seeds—At the end of the experiment all seeds from each plot were collected. Seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra-Oxford Instrument) and its MultiQuant software package Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Tables 86-95 summarize the observed phenotypes of transgenic plants exogenously expressing the gene constructs using the greenhouse seed maturation (GH-SM) assays under low nitrogen (Tables 86-90) or normal (standard) nitrogen (Tables 91-95) growth conditions. The evaluation of each gene was performed by testing the performance of different number of events. Event with p-value<0.1 was considered statistically significant.

TABLE 86

Genes showing improved plant performance at low Nitrogen growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| WNU30 | 76575.3 | — | — | — | 16.4 | 0.27 | −3 | 12.6 | 0.14 | −3 |
| WNU101 | 75778.9 | 382.5 | 0.11 | 4 | — | — | — | — | — | — |
| CONT. | | 366.6 | — | — | 17.0 | — | — | 13.0 | — | — |
| WNU85 | 76838.1 | 445.4 | 0.17 | 19 | — | — | — | — | — | — |
| WNU85 | 76840.5 | 419.2 | 0.28 | 12 | — | — | — | — | — | — |
| WNU82 | 75806.2 | 412.5 | 0.26 | 10 | — | — | — | — | — | — |
| WNU82 | 75806.4 | 415.6 | 0.01 | 11 | — | — | — | — | — | — |
| WNU82 | 75807.5 | 427.1 | 0.08 | 14 | — | — | — | — | — | — |
| WNU82 | 75807.6 | 430.4 | 0.12 | 15 | — | — | — | — | — | — |
| WNU82 | 75809.3 | 485.0 | 0.02 | 29 | — | — | — | — | — | — |
| WNU80 | 76403.8 | 397.5 | 0.13 | 6 | — | — | — | — | — | — |
| WNU68 | 76831.4 | 411.7 | 0.04 | 10 | — | — | — | — | — | — |
| WNU68 | 76832.3 | 453.5 | 0.02 | 21 | — | — | — | — | — | — |
| WNU68 | 76835.2 | 420.4 | 0.07 | 12 | — | — | — | — | — | — |
| WNU56 | 75801.6 | 402.9 | 0.08 | 8 | — | — | — | — | — | — |
| WNU56 | 75803.7 | — | — | — | 17.3 | 0.19 | −3 | 13.2 | 0.26 | −2 |
| WNU56 | 75804.3 | 435.3 | L | 16 | — | — | — | — | — | — |
| CONT. | | 374.7 | — | — | 17.8 | — | — | 13.5 | — | — |
| WNU77 | 78016.1 | 491.1 | 0.12 | 16 | — | — | — | — | — | — |
| WNU77 | 78016.3 | 470.0 | 0.23 | 11 | — | — | — | — | — | — |
| WNU77 | 78016.6 | 466.2 | 0.12 | 10 | — | — | — | — | — | — |
| WNU77 | 78016.8 | 499.6 | 0.07 | 18 | 22.5 | 0.16 | −1 | 17.6 | 0.04 | −2 |
| WNU77 | 78016.9 | 805.9 | 0.10 | 91 | — | — | — | — | — | — |
| WNU77 | 78017.1 | 477.1 | 0.20 | 13 | 22.5 | 0.16 | −1 | — | — | — |
| WNU77 | 78018.10 | — | — | — | — | — | — | 17.1 | 0.10 | −4 |
| WNU65 | 78006.10 | 481.0 | 0.03 | 14 | — | — | — | — | — | — |
| WNU65 | 78006.4 | 446.5 | 0.22 | 6 | — | — | — | — | — | — |
| WNU65 | 78006.7 | 566.6 | 0.21 | 34 | — | — | — | — | — | — |
| WNU65 | 78006.8 | — | — | — | 21.8 | 0.13 | −4 | 17.0 | 0.11 | −5 |
| WNU65 | 78007.11 | 470.4 | 0.06 | 11 | — | — | — | — | — | — |
| WNU65 | 78007.14 | 473.4 | 0.05 | 12 | — | — | — | — | — | — |
| WNU63 | 76766.5 | 454.6 | 0.18 | 8 | — | — | — | — | — | — |
| WNU63 | 76768.2 | — | — | — | 22.2 | 0.26 | −2 | — | — | — |
| WNU63 | 76768.5 | 497.9 | 0.05 | 18 | — | — | — | 17.6 | 0.27 | −2 |
| WNU63 | 76768.9 | 473.4 | 0.20 | 12 | — | — | — | — | — | — |
| WNU63 | 76770.1 | 485.2 | 0.26 | 15 | — | — | — | — | — | — |
| WNU50 | 78114.2 | 531.3 | L | 26 | — | — | — | — | — | — |
| WNU50 | 78114.6 | — | — | — | 22.5 | 0.16 | −1 | — | — | — |
| WNU50 | 78130.2 | 482.0 | L | 14 | 22.5 | 0.16 | −1 | 17.7 | 0.24 | −1 |
| WNU50 | 78130.8 | 472.4 | 0.14 | 12 | — | — | — | — | — | — |
| WNU19 | 76567.1 | 488.8 | 0.07 | 16 | — | — | — | — | — | — |
| WNU19 | 76568.2 | 464.4 | 0.16 | 10 | — | — | — | 17.2 | 0.12 | −4 |
| WNU19 | 76569.2 | 469.0 | 0.17 | 11 | — | — | — | — | — | — |
| WNU19 | 76570.3 | — | — | — | 22.2 | 0.26 | −2 | 16.8 | 0.07 | −6 |
| WNU16 | 77166.4 | 605.1 | 0.01 | 43 | 21.8 | L | −4 | 17.4 | L | −3 |
| WNU16 | 77167.1 | 457.0 | 0.14 | 8 | — | — | — | — | — | — |
| WNU16 | 77167.2 | 526.3 | 0.05 | 25 | 21.8 | 0.13 | −4 | 17.2 | 0.20 | −4 |
| WNU16 | 77167.3 | — | — | — | 22.2 | 0.26 | −2 | 17.3 | 0.28 | −3 |
| WNU16 | 77167.5 | — | — | — | 22.5 | 0.16 | −1 | 16.6 | L | −7 |
| WNU16 | 77169.1 | 504.6 | 0.02 | 19 | 22.0 | 0.11 | −3 | 16.8 | 0.07 | −6 |
| WNU16 | 77169.2 | — | — | — | 22.0 | 0.11 | −3 | 16.6 | L | −7 |
| WNU16 | 77169.5 | — | — | — | — | — | — | 17.1 | 0.13 | −4 |
| CONT. | | 422.5 | — | — | 22.7 | — | — | 17.9 | — | — |

Table 86: "CONT."—Control;
"Ave."—Average;
"% Incr." = % increment;
"p-val."—pvalue;
L means that p-value is less than 0.01, p < 0.1 was considered as significant. The transgenes were under the transcriptional regulation of the new At6669 promoter (SEQ ID NO: 6918). It should be noted that a negative increment (in percentages) when found in flowering or inflorescence emergence indicates potential for drought avoidance.

TABLE 87

Genes showing improved plant performance at Low N growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| WNU30 | 76572.4 | 1.20 | L | 21 | — | — | — | 63.9 | L | 16 |
| WNU30 | 76574.1 | 1.16 | 0.08 | 16 | — | — | — | 63.8 | 0.09 | 16 |
| WNU30 | 76575.3 | 1.15 | 0.08 | 16 | — | — | — | 60.9 | 0.02 | 11 |
| WNU101 | 75778.2 | 1.11 | 0.04 | 12 | — | — | — | 60.7 | 0.13 | 10 |
| WNU101 | 75778.3 | 1.10 | 0.19 | 10 | — | — | — | — | — | — |
| WNU101 | 75778.4 | 1.12 | 0.15 | 12 | — | — | — | 63.2 | 0.14 | 15 |
| WNU101 | 75778.9 | — | — | — | — | — | — | 57.5 | 0.29 | 5 |
| WNU101 | 75780.1 | — | — | — | — | — | — | 62.9 | 0.20 | 14 |
| CONT. | — | 0.995 | — | — | 9.75 | — | — | 55.1 | — | — |
| WNU85 | 76836.2 | 1.50 | 0.22 | 9 | — | — | — | 88.4 | 0.19 | 11 |
| WNU85 | 76837.7 | 1.60 | 0.03 | 16 | — | — | — | 90.0 | 0.15 | 13 |
| WNU82 | 75806.2 | 1.49 | 0.13 | 8 | — | — | — | 84.6 | 0.24 | 6 |
| WNU82 | 75809.3 | 1.49 | 0.12 | 8 | — | — | — | 86.9 | 0.09 | 9 |
| WNU80 | 76404.3 | — | — | — | — | — | — | 89.9 | 0.23 | 13 |
| WNU80 | 76405.5 | 1.56 | 0.02 | 13 | — | — | — | 88.1 | 0.05 | 11 |
| WNU68 | 76831.4 | 1.48 | 0.23 | 7 | — | — | — | 85.6 | 0.17 | 8 |
| WNU68 | 76833.7 | 1.63 | 0.02 | 18 | — | — | — | 96.9 | 0.04 | 22 |
| WNU68 | 76835.2 | 1.47 | 0.14 | 6 | — | — | — | 87.2 | 0.06 | 10 |
| WNU56 | 75801.10 | 1.50 | 0.16 | 9 | — | — | — | — | — | — |
| WNU56 | 75803.9 | — | — | — | 11.6 | 0.28 | 2 | — | — | — |
| CONT. | — | 1.38 | — | — | 11.4 | — | — | 79.6 | — | — |
| WNU77 | 78016.3 | 1.12 | 0.20 | 21 | — | — | — | 64.2 | 0.22 | 20 |
| WNU77 | 78016.6 | 0.974 | 0.12 | 6 | — | — | — | — | — | — |
| WNU77 | 78016.8 | 1.17 | 0.04 | 27 | 10.4 | L | 4 | 69.6 | L | 30 |
| WNU77 | 78017.1 | 1.07 | 0.17 | 16 | — | — | — | 62.2 | 0.25 | 16 |
| WNU77 | 78018.10 | 1.10 | L | 19 | 10.5 | 0.18 | 6 | 64.3 | L | 20 |
| WNU65 | 78006.8 | 0.970 | 0.10 | 5 | 10.2 | 0.14 | 3 | 57.1 | 0.05 | 7 |
| WNU50 | 78114.5 | 1.01 | 0.09 | 9 | — | — | — | 56.9 | 0.23 | 7 |
| WNU50 | 78130.2 | 1.02 | 0.27 | 11 | — | — | — | — | — | — |
| WNU19 | 76569.3 | — | — | — | 10.2 | 0.24 | 2 | — | — | — |
| WNU16 | 77167.5 | 1.03 | 0.22 | 12 | — | — | — | — | — | — |
| WNU16 | 77169.1 | 1.06 | 0.01 | 15 | 10.6 | 0.03 | 6 | 62.3 | L | 17 |
| WNU16 | 77169.2 | 1.04 | 0.07 | 13 | — | — | — | 61.8 | L | 16 |
| CONT. | — | 0.922 | — | — | 9.97 | — | — | 53.4 | — | — |

Table 87. "CONT."—Control;
"Ave."—Average;
"% Incr " = % increment;
"p-val."—p-value;
L means that p-value is less than 0.01, p < 0.1 was considered as significant. The transgenes were under the transcriptional regulation of the new At6669 promoter (SEQ ID NO: 6918).

TABLE 88

Genes showing improved plant performance at low Nitrogen growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| WNU30 | 76572.4 | — | — | — | 10.1 | 0.20 | 11 | 0.437 | 0.29 | 5 |
| WNU30 | 76574.1 | — | — | — | 10.2 | 0.20 | 11 | 0.446 | 0.15 | 7 |
| WNU101 | 75778.4 | 0.732 | 0.24 | 9 | 9.99 | 0.28 | 9 | 0.452 | 0.09 | 9 |
| WNU101 | 75780.1 | — | — | — | 10.2 | 0.20 | 11 | 0.464 | 0.04 | 12 |
| CONT. | — | 0.671 | — | — | 9.14 | — | — | 0.415 | — | — |
| WNU85 | 76836.1 | 0.856 | 0.13 | 13 | — | — | — | — | — | — |
| WNU85 | 76836.2 | — | — | — | 12.7 | 0.23 | 12 | 0.508 | 0.29 | 9 |
| WNU85 | 76837.7 | — | — | — | 12.6 | 0.24 | 12 | 0.515 | 0.22 | 11 |
| WNU82 | 75809.3 | — | — | — | 12.6 | 0.27 | 11 | 0.511 | 0.25 | 10 |
| WNU80 | 76404.3 | 0.829 | 0.27 | 9 | 13.2 | 0.10 | 17 | — | — | — |
| WNU80 | 76405.5 | — | — | — | — | — | — | 0.538 | 0.14 | 16 |
| WNU68 | 76831.4 | — | — | — | — | — | — | 0.513 | 0.24 | 10 |
| WNU68 | 76833.7 | — | — | — | 13.8 | 0.03 | 22 | 0.538 | 0.07 | 16 |
| WNU68 | 76835.2 | — | — | — | 12.5 | 0.30 | 10 | 0.511 | 0.25 | 10 |
| WNU56 | 75801.10 | — | — | — | — | — | — | 0.525 | 0.14 | 13 |
| WNU56 | 75801.6 | — | — | — | — | — | — | 0.511 | 0.26 | 10 |
| WNU56 | 75803.9 | 0.825 | 0.30 | 9 | — | — | — | — | — | — |

TABLE 88-continued

Genes showing improved plant performance at low Nitrogen growth conditions under regulation of At6669 promoter

| Gene Name | Event # | RGR Of Leaf Number Ave. | P-Val. | % Incr. | RGR Of Plot Coverage Ave. | P-Val. | % Incr. | RGR Of Rosette Diameter Ave. | P-Val. | % Incr. |
|---|---|---|---|---|---|---|---|---|---|---|
| WNU56 | 75804.3 | 0.826 | 0.27 | 9 | — | — | — | — | — | — |
| CONT. | — | 0.757 | — | — | 11.3 | — | — | 0.465 | — | — |
| WNU77 | 78016.3 | 0.734 | 0.29 | 7 | 9.70 | 0.01 | 24 | 0.436 | 0.02 | 17 |
| WNU77 | 78016.6 | — | — | — | 8.54 | 0.27 | 9 | 0.413 | 0.10 | 11 |
| WNU77 | 78016.8 | — | — | — | 10.5 | L | 34 | 0.444 | L | 19 |
| WNU77 | 78017.1 | — | — | — | 9.30 | 0.03 | 19 | 0.414 | 0.12 | 11 |
| WNU77 | 78018.10 | — | — | — | 9.40 | 0.01 | 20 | 0.412 | 0.11 | 11 |
| WNU65 | 78007.3 | 0.738 | 0.23 | 7 | — | — | — | — | — | — |
| WNU63 | 76766.5 | — | — | — | — | — | — | 0.399 | 0.29 | 7 |
| WNU63 | 76768.8 | — | — | — | — | — | — | 0.407 | 0.20 | 9 |
| WNU50 | 78114.5 | — | — | — | — | — | — | 0.411 | 0.12 | 10 |
| WNU50 | 78130.1 | — | — | — | — | — | — | 0.406 | 0.19 | 9 |
| WNU50 | 78130.2 | — | — | — | 8.81 | 0.17 | 13 | — | — | — |
| WNU19 | 76568.2 | — | — | — | — | — | — | 0.407 | 0.30 | 9 |
| WNU19 | 76570.3 | — | — | — | 8.75 | 0.21 | 12 | — | — | — |
| WNU16 | 77167.3 | — | — | — | 9.43 | 0.07 | 20 | — | — | — |
| WNU16 | 77167.5 | — | — | — | 8.75 | 0.18 | 12 | 0.401 | 0.28 | 8 |
| WNU16 | 77169.1 | — | — | — | 8.93 | 0.08 | 14 | 0.402 | 0.24 | 8 |
| WNU16 | 77169.2 | — | — | — | 8.84 | 0.11 | 13 | — | — | — |
| CONT. | — | 0.689 | — | — | 7.83 | — | — | 0.373 | — | — |

Table 88. "CONT."—Control;
"Ave."—Average;
"% Incr." = % increment;
"p-val."—p-value;
L means that p-value is less than 0.01 $p < 0.1$ was considered as significant. The transgenes were under the transcriptional regulation of the new At6669 promoter (SEQ ID NO: 6918).

TABLE 89

Genes showing improved plant performance at low Nitrogen growth conditions under regulation of At6669 promoter

| Gene Name | Event # | Harvest Index Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| WNU30 | 76572.4 | — | — | — | 7.99 | L | 16 | 4.62 | L | 8 |
| WNU30 | 76574.1 | — | — | — | 7.98 | 0.09 | 16 | 4.70 | 0.06 | 9 |
| WNU30 | 76575.3 | 0.395 | 0.18 | 14 | 7.61 | 0.02 | 11 | 4.56 | 0.01 | 6 |
| WNU101 | 75778.2 | 0.374 | 0.12 | 8 | 7.58 | 0.13 | 10 | 4.52 | 0.13 | 5 |
| WNU101 | 75778.4 | — | — | — | 7.90 | 0.14 | 15 | 4.73 | 0.10 | 10 |
| WNU101 | 75778.9 | — | — | — | 7.19 | 0.29 | 5 | — | — | — |
| WNU101 | 75780.1 | — | — | — | 7.87 | 0.20 | 14 | 4.82 | 0.17 | 12 |
| WNU101 | 75780.2 | 0.384 | 0.03 | 11 | — | — | — | — | — | — |
| CONT. | — | 0.347 | — | — | 6.88 | — | — | 4.29 | — | — |
| WNU85 | 76836.1 | 0.418 | L | 19 | — | — | — | — | — | — |
| WNU85 | 76836.2 | 0.375 | 0.07 | 6 | 11.1 | 0.19 | 11 | 5.50 | 0.03 | 9 |
| WNU85 | 76837.2 | 0.399 | 0.08 | 13 | — | — | — | — | — | — |
| WNU85 | 76837.7 | 0.383 | 0.02 | 9 | 11.2 | 0.15 | 13 | 5.54 | 0.07 | 9 |
| WNU85 | 76838.2 | 0.389 | 0.03 | 10 | — | — | — | — | — | — |
| WNU85 | 76839.1 | 0.394 | 0.14 | 12 | — | — | — | — | — | — |
| WNU85 | 76840.1 | 0.377 | 0.26 | 7 | — | — | — | — | — | — |
| WNU82 | 75806.2 | — | — | — | 10.6 | 0.24 | 6 | 5.35 | 0.19 | 6 |
| WNU82 | 75806.3 | 0.378 | 0.02 | 7 | — | — | — | — | — | — |
| WNU82 | 75809.3 | — | — | — | 10.9 | 0.09 | 9 | 5.42 | 0.13 | 7 |
| WNU82 | 75809.4 | — | — | — | 11.0 | 0.25 | 11 | 5.36 | 0.27 | 6 |
| WNU80 | 76403.1 | 0.383 | 0.22 | 9 | — | — | — | — | — | — |
| WNU80 | 76403.8 | 0.377 | 0.04 | 7 | — | — | — | — | — | — |
| WNU80 | 76404.3 | 0.384 | 0.24 | 9 | 11.2 | 0.23 | 13 | 5.44 | 0.15 | 7 |
| WNU80 | 76404.5 | 0.383 | 0.17 | 9 | — | — | — | — | — | — |
| WNU80 | 76405.5 | — | — | — | 11.0 | 0.05 | 11 | 5.53 | 0.08 | 9 |
| WNU68 | 76831.2 | — | — | — | — | — | — | 5.42 | 0.19 | 7 |
| WNU68 | 76831.4 | — | — | — | 10.7 | 0.17 | 8 | 5.48 | 0.06 | 8 |
| WNU68 | 76833.10 | 0.373 | 0.14 | 6 | — | — | — | — | — | — |
| WNU68 | 76833.7 | 0.387 | 0.29 | 10 | 12.1 | 0.04 | 22 | 5.73 | 0.02 | 13 |
| WNU68 | 76835.2 | — | — | — | 10.9 | 0.06 | 10 | 5.46 | 0.02 | 8 |
| WNU56 | 75801.10 | — | — | — | — | — | — | 5.44 | 0.12 | 7 |

TABLE 89-continued

Genes showing improved plant performance at low Nitrogen growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| WNU56 | 75801.9 | 0.382 | 0.11 | 8 | — | — | — | — | — | — |
| WNU56 | 75803.7 | — | — | — | — | — | — | 5.28 | 0.24 | 4 |
| WNU56 | 75804.1 | 0.386 | 0.25 | 10 | — | — | — | — | — | — |
| CONT. | — | 0.352 | — | — | 9.94 | — | — | 5.07 | — | — |
| WNU77 | 78016.3 | — | — | — | 8.02 | 0.22 | 20 | 4.76 | 0.14 | 12 |
| WNU77 | 78016.5 | 0.401 | 0.28 | 18 | — | — | — | — | — | — |
| WNU77 | 78016.6 | — | — | — | — | — | — | 4.54 | 0.01 | 6 |
| WNU77 | 78016.8 | — | — | — | 8.70 | L | 30 | 4.91 | L | 15 |
| WNU77 | 78017.1 | — | — | — | 7.77 | 0.25 | 16 | 4.64 | 0.19 | 9 |
| WNU77 | 78018.10 | — | — | — | 8.03 | L | 20 | 4.70 | L | 10 |
| WNU77 | 78018.4 | 0.363 | 0.26 | 7 | — | — | — | — | — | — |
| WNU65 | 78006.8 | — | — | — | 7.14 | 0.05 | 7 | 4.44 | 0.04 | 4 |
| WNU65 | 78007.11 | 0.370 | 0.13 | 9 | — | — | — | — | — | — |
| WNU63 | 76766.5 | 0.416 | 0.09 | 22 | — | — | — | — | — | — |
| WNU63 | 76766.7 | 0.384 | L | 13 | — | — | — | — | — | — |
| WNU63 | 76768.1 | 0.402 | 0.05 | 18 | — | — | — | — | — | — |
| WNU63 | 76768.2 | 0.397 | 0.20 | 17 | — | — | — | — | — | — |
| WNU50 | 78114.5 | — | — | — | 7.12 | 0.23 | 7 | 4.51 | 0.01 | 6 |
| WNU50 | 78130.1 | 0.403 | 0.27 | 18 | — | — | — | — | — | — |
| WNU50 | 78130.4 | 0.359 | 0.28 | 5 | — | — | — | — | — | — |
| WNU50 | 78144.2 | 0.372 | 0.11 | 9 | — | — | — | — | — | — |
| WNU19 | 76567.1 | 0.394 | 0.24 | 16 | — | — | — | — | — | — |
| WNU19 | 76568.3 | 0.387 | 0.14 | 14 | — | — | — | — | — | — |
| WNU19 | 76569.3 | 0.403 | L | 18 | — | — | — | — | — | — |
| WNU16 | 77166.3 | 0.437 | 0.11 | 28 | — | — | — | — | — | — |
| WNU16 | 77166.4 | — | — | — | — | — | — | 4.48 | 0.24 | 5 |
| WNU16 | 77168.2 | 0.395 | 0.27 | 16 | — | — | — | — | — | — |
| WNU16 | 77169.1 | — | — | — | 7.79 | L | 17 | 4.66 | L | 9 |
| WNU16 | 77169.2 | 0.423 | L | 24 | 7.72 | L | 16 | 4.56 | L | 7 |
| CONT. | — | 0.340 | — | — | 6.67 | — | — | 4.27 | — | — |

Table 89. "CONT."—Control;
"Ave."—Average;
"% Incr." = % increment;
"p-val."—p-value;
L means that p-value is less than 0.01, p < 0.1 was considered as significant. The transgenes were under the transcriptional regulation of the new At6669 promoter (SEQ ID NO: 6918).

TABLE 90

Genes showing improved plant performance at low Nitrogen growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| WNU30 | 76572.1 | 140.7 | 0.19 | 11 | — | — | — |
| WNU30 | 76575.3 | 140.0 | 0.19 | 11 | — | — | — |
| WNU101 | 75780.2 | 137.6 | 0.17 | 9 | — | — | — |
| CONT. | — | 126.5 | — | — | 19.9 | — | — |
| WNU85 | 76836.2 | 141.1 | 0.29 | 7 | — | — | — |
| WNU85 | 76837.2 | 154.8 | 0.09 | 17 | — | — | — |
| WNU85 | 76838.1 | — | — | — | 23.2 | 0.04 | 15 |
| WNU85 | 76840.5 | — | — | — | 23.7 | 0.17 | 18 |
| WNU82 | 75806.3 | 147.8 | 0.13 | 12 | — | — | — |
| WNU82 | 75806.4 | — | — | — | 22.2 | L | 11 |
| WNU82 | 75807.5 | 155.9 | 0.03 | 18 | — | — | — |
| WNU80 | 76403.1 | 144.0 | 0.22 | 9 | — | — | — |
| WNU80 | 76403.2 | — | — | — | 21.8 | 0.07 | 8 |
| WNU80 | 76403.8 | 149.8 | 0.02 | 14 | — | — | — |
| WNU80 | 76404.3 | 148.9 | 0.12 | 13 | — | — | — |
| WNU80 | 76404.5 | 141.9 | 0.20 | 8 | — | — | — |
| WNU80 | 76405.6 | — | — | — | 22.3 | 0.24 | 11 |
| WNU68 | 76831.2 | 146.2 | 0.19 | 11 | — | — | — |
| WNU68 | 76831.4 | 145.6 | 0.20 | 10 | — | — | — |
| WNU68 | 76832.3 | — | — | — | 22.6 | 0.16 | 13 |
| WNU68 | 76833.7 | 146.7 | 0.14 | 11 | — | — | — |
| WNU68 | 76834.1 | 141.6 | 0.25 | 7 | — | — | — |
| WNU68 | 76834.3 | — | — | — | 20.8 | 0.21 | 4 |
| WNU68 | 76835.2 | 151.0 | 0.22 | 15 | — | — | — |
| WNU56 | 75801.10 | 145.6 | 0.21 | 10 | — | — | — |
| WNU56 | 75801.6 | 147.1 | 0.07 | 12 | — | — | — |
| WNU56 | 75801.8 | 151.3 | 0.26 | 15 | — | — | — |
| WNU56 | 75801.9 | 146.8 | 0.21 | 11 | — | — | — |
| WNU56 | 75803.7 | — | — | — | 22.2 | 0.20 | 11 |
| WNU56 | 75804.1 | 147.2 | 0.12 | 12 | — | — | — |
| CONT. | — | 131.8 | — | — | 20.1 | — | — |
| WNU77 | 78016.1 | 182.5 | L | 27 | — | — | — |
| WNU77 | 78016.3 | 163.6 | 0.03 | 14 | — | — | — |
| WNU77 | 78016.5 | 175.8 | 0.29 | 22 | — | — | — |
| WNU77 | 78016.6 | 174.1 | 0.25 | 21 | — | — | — |
| WNU77 | 78016.8 | — | — | — | 21.5 | 0.08 | 7 |
| WNU77 | 78016.9 | — | — | — | 25.2 | 0.06 | 26 |
| WNU77 | 78017.1 | 168.2 | 0.02 | 17 | — | — | — |
| WNU77 | 78018.10 | — | — | — | 21.9 | L | 9 |
| WNU65 | 78006.4 | 168.9 | 0.29 | 17 | — | — | — |
| WNU65 | 78006.6 | — | — | — | 21.6 | 0.07 | 8 |
| WNU65 | 78006.7 | — | — | — | 21.8 | 0.17 | 9 |

TABLE 90-continued

Genes showing improved plant performance at low Nitrogen growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| WNU65 | 78007.11 | 174.2 | 0.07 | 21 | — | — | — |
| WNU63 | 76766.5 | 188.8 | 0.02 | 31 | — | — | — |
| WNU63 | 76766.7 | 165.0 | 0.28 | 15 | — | — | — |
| WNU63 | 76768.5 | — | — | — | 21.8 | 0.06 | 9 |
| WNU63 | 76768.8 | 176.6 | L | 23 | — | — | — |
| WNU63 | 76770.1 | 185.3 | 0.21 | 29 | — | — | — |
| WNU50 | 78114.2 | — | — | — | 22.0 | 0.07 | 10 |
| WNU50 | 78114.6 | — | — | — | 21.5 | L | 8 |
| WNU50 | 78130.1 | 169.3 | 0.19 | 18 | — | — | — |
| WNU50 | 78130.2 | — | — | — | 21.0 | 0.22 | 5 |
| WNU50 | 78130.8 | 156.7 | 0.14 | 9 | — | — | — |
| WNU50 | 78144.2 | 155.1 | 0.29 | 8 | — | — | — |
| WNU19 | 76567.1 | 191.5 | 0.02 | 33 | — | — | — |
| WNU19 | 76568.2 | — | — | — | 22.2 | 0.01 | 11 |
| WNU19 | 76568.3 | 176.1 | 0.24 | 22 | — | — | — |
| WNU19 | 76569.2 | — | — | — | 23.0 | L | 15 |
| WNU19 | 76569.3 | 154.4 | 0.25 | 7 | — | — | — |
| WNU19 | 76569.4 | — | — | — | 20.1 | 0.20 | 1 |
| WNU19 | 76570.3 | — | — | — | 21.8 | 0.09 | 9 |
| WNU16 | 77166.3 | 175.5 | 0.12 | 22 | — | — | — |
| WNU16 | 77166.4 | — | — | — | 23.0 | 0.03 | 15 |
| WNU16 | 77167.1 | 182.0 | 0.20 | 27 | — | — | — |
| WNU16 | 77167.2 | — | — | — | 22.7 | 0.12 | 14 |
| WNU16 | 77167.3 | — | — | — | 22.1 | 0.03 | 11 |
| WNU16 | 77167.5 | — | — | — | 20.3 | 0.10 | 1 |
| WNU16 | 77169.1 | — | — | — | 22.3 | 0.23 | 12 |
| WNU16 | 77169.2 | 179.7 | 0.19 | 25 | — | — | — |
| CONT. | — | 143.8 | — | — | 20.0 | — | — |

Table 90. "CONT."—Control;
"Ave."—Average;
"% Incr." = % increment;
"p-val."—p-value;
L means that p-value is less than 0.01, p < 0.1 was considered as significant. The transgenes were under the transcriptional regulation of the new At6669 promoter (SEQ ID NO: 6918).

TABLE 91

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| WNU30 | 76575.1 | — | — | — | 16.8 | 0.15 | −3 | 12.3 | 0.02 | −6 |
| WNU101 | 75778.8 | 721.7 | 0.10 | 9 | — | — | — | — | — | — |
| CONT. | — | 659.7 | — | — | 17.4 | — | — | 13.1 | — | — |
| WNU85 | 76838.1 | — | — | — | — | — | — | 13.3 | 0.22 | −4 |
| WNU85 | 76840.5 | 860.4 | 0.09 | 13 | — | — | — | — | — | — |
| WNU68 | 76831.4 | 799.2 | 0.25 | 5 | — | — | — | — | — | — |
| WNU68 | 76833.10 | 807.0 | 0.29 | 6 | — | — | — | — | — | — |
| WNU56 | 75801.8 | — | — | — | 17.3 | 0.08 | −7 | 12.8 | L | −7 |
| WNU56 | 75803.7 | — | — | — | 17.9 | L | −3 | — | — | — |
| WNU56 | 75804.1 | — | — | — | 18.0 | 0.16 | −3 | — | — | — |
| CONT. | — | 758.9 | — | — | 18.5 | — | — | 13.8 | — | — |
| WNU77 | 78016.8 | 854.2 | 0.05 | 5 | 22.6 | 0.03 | −3 | 17.3 | 0.20 | −4 |
| WNU77 | 78016.9 | 1234.4 | L | 52 | — | — | — | 17.3 | 0.27 | −3 |
| WNU77 | 78018.10 | 897.9 | 0.01 | 11 | — | — | — | 17.3 | 0.24 | −4 |
| WNU65 | 78006.6 | 884.9 | 0.23 | 9 | — | — | — | — | — | — |
| WNU65 | 78006.7 | 985.7 | 0.03 | 21 | — | — | — | — | — | — |
| WNU65 | 78006.8 | — | — | — | — | — | — | 17.0 | 0.04 | −5 |
| WNU63 | 76768.2 | — | — | — | 22.6 | 0.03 | −3 | 16.8 | 0.02 | −7 |
| WNU63 | 76768.8 | — | — | — | 22.6 | 0.04 | −3 | 16.6 | L | −8 |
| WNU50 | 78114.2 | 937.1 | L | 15 | — | — | — | — | — | — |
| WNU50 | 78114.6 | 873.8 | 0.04 | 8 | — | — | — | — | — | — |
| WNU50 | 78130.2 | 911.7 | 0.27 | 12 | — | — | — | — | — | — |
| WNU19 | 76567.1 | — | — | — | 22.8 | 0.30 | −2 | — | — | — |
| WNU19 | 76568.2 | — | — | — | 21.8 | L | −6 | 16.8 | 0.06 | −6 |
| WNU19 | 76569.2 | — | — | — | 22.8 | 0.30 | −2 | 17.5 | 0.02 | −2 |
| WNU19 | 76569.3 | — | — | — | 22.5 | L | −3 | 17.4 | 0.03 | −3 |
| WNU19 | 76569.4 | 866.1 | 0.22 | 7 | — | — | — | — | — | — |
| WNU19 | 76570.3 | 935.2 | 0.05 | 15 | — | — | — | 17.0 | 0.05 | −5 |
| WNU19 | 76570.7 | — | — | — | 22.6 | 0.03 | −3 | 17.6 | 0.23 | −2 |
| WNU16 | 77166.4 | 1104.9 | 0.05 | 36 | 22.1 | 0.07 | −5 | 16.7 | L | −7 |
| WNU16 | 77167.2 | 939.5 | 0.04 | 16 | 22.0 | L | −5 | 16.1 | 0.02 | −10 |
| WNU16 | 77167.3 | 942.6 | 0.01 | 16 | 22.6 | 0.04 | −3 | 17.2 | 0.10 | −4 |
| WNU16 | 77169.1 | 904.9 | 0.18 | 12 | — | — | — | 17.3 | 0.15 | −3 |
| WNU16 | 77169.2 | 863.9 | 0.21 | 6 | 22.2 | 0.04 | −5 | 16.5 | L | −8 |

TABLE 91-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| WNU16 | 77169.5 | — | — | — | 22.5 | 0.15 | −3 | — | — | — |
| CONT. | — | 811.5 | — | — | 23.3 | — | — | 17.9 | — | — |

Table 91. "CONT."—Control;
"Ave."—Average;
"% Incr." = % increment;
"p-val."—p-value;
L means that p-value is less than 0.01, p < 0.1 was considered as significant. The transgenes were under the transcriptional regulation of the new At6669 promoter (SEQ ID NO: 6918).

TABLE 92

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| WNU30 | 76572.1 | 1.15 | 0.22 | 7 | — | — | — | — | — | — |
| WNU30 | 76575.1 | 1.20 | 0.05 | 12 | — | — | — | 67.5 | 0.06 | 10 |
| WNU30 | 76575.3 | 1.19 | 0.27 | 10 | — | — | — | — | — | — |
| WNU101 | 75778.5 | 1.18 | 0.08 | 10 | — | — | — | — | — | — |
| WNU101 | 75778.8 | — | — | — | 10.2 | 0.24 | 3 | — | — | — |
| WNU101 | 75780.1 | — | — | — | 10.2 | 0.21 | 3 | — | — | — |
| CONT. | — | 1.07 | — | — | 9.91 | — | — | 61.1 | — | — |
| WNU85 | 76836.1 | 1.62 | 0.02 | 13 | 11.7 | 0.29 | 4 | 98.4 | 0.04 | 16 |
| WNU85 | 76836.2 | 1.57 | 0.06 | 10 | 11.9 | 0.15 | 6 | 94.5 | 0.04 | 11 |
| WNU85 | 76840.5 | 1.57 | 0.10 | 10 | — | — | — | 93.3 | 0.08 | 10 |
| WNU82 | 75806.4 | 1.57 | 0.21 | 10 | — | — | — | — | — | — |
| WNU82 | 75807.6 | — | — | — | 11.8 | 0.23 | 4 | — | — | — |
| WNU82 | 75809.4 | — | — | — | 11.7 | 0.12 | 3 | — | — | — |
| WNU80 | 76404.3 | 1.50 | 0.29 | 5 | — | — | — | — | — | — |
| WNU68 | 76833.7 | 1.55 | 0.10 | 8 | — | — | — | 91.8 | 0.23 | 8 |
| WNU56 | 75801.10 | 1.57 | 0.05 | 10 | — | — | — | — | — | — |
| WNU56 | 75801.9 | 1.56 | 0.16 | 9 | — | — | — | 90.5 | 0.27 | 7 |
| WNU56 | 75803.7 | 1.57 | 0.12 | 9 | — | — | — | 94.2 | 0.08 | 11 |
| WNU56 | 75804.1 | 1.59 | 0.06 | 11 | — | — | — | 92.0 | 0.27 | 9 |
| CONT. | — | 1.43 | — | — | 11.3 | — | — | 84.8 | — | — |
| WNU77 | 78016.8 | 1.17 | 0.20 | 16 | 10.3 | 0.28 | 4 | 66.2 | 0.28 | 16 |
| WNU63 | 76768.5 | — | — | — | 10.4 | 0.25 | 5 | — | — | — |
| WNU63 | 76768.8 | 1.12 | 0.20 | 11 | 10.2 | 0.25 | 4 | 69.0 | 0.10 | 20 |
| WNU19 | 76568.2 | 1.10 | 0.06 | 9 | — | — | — | 63.3 | 0.10 | 11 |
| WNU19 | 76569.2 | — | — | — | 10.1 | 0.21 | 2 | — | — | — |
| WNU19 | 76570.3 | 1.10 | 0.24 | 9 | 10.4 | L | 5 | 65.2 | 0.02 | 14 |
| WNU19 | 76570.7 | — | — | — | 10.5 | 0.02 | 6 | — | — | — |
| WNU16 | 77167.2 | — | — | — | 10.7 | 0.19 | 8 | 67.0 | 0.22 | 17 |
| WNU16 | 77169.2 | — | — | — | 10.9 | 0.05 | 10 | 68.1 | 0.22 | 19 |
| CONT. | — | 1.01 | — | — | 9.89 | — | — | 57.2 | — | — |

Table 92. "CONT."—Control;
"Ave."—Average;
"% Incr." = % increment;
"p-val."—p-value;
L means that p-value is less than 0.01, p < 0.1 was considered as significant. The transgenes were under the transcriptional regulation of the new At6669 promoter (SEQ ID NO: 6918).

TABLE 93

Genes showing improved plant performance at Normal growth conditions under regulation of At6669 promoter

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| WNU101 | 75780.1 | — | — | — | — | — | — | 0.520 | 0.22 | 7 |
| CONT. | — | 0.681 | — | — | 11.1 | — | — | 0.485 | — | — |

TABLE 93-continued

Genes showing improved plant performance at Normal growth conditions under regulation of At6669 promoter

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| WNU85 | 76836.1 | — | — | — | 14.7 | 0.19 | 13 | 0.594 | 0.26 | 9 |
| CONT. | — | — | — | — | 13.0 | — | — | 0.543 | — | — |
| WNU77 | 78016.8 | — | — | — | 9.76 | 0.20 | 14 | — | — | — |
| WNU77 | 78018.10 | — | — | — | 9.99 | 0.19 | 17 | — | — | — |
| WNU77 | 78018.9 | 0.735 | 0.17 | 12 | — | — | — | — | — | — |
| WNU65 | 78006.8 | — | — | — | 10.1 | 0.14 | 18 | — | — | — |
| WNU63 | 76768.5 | 0.723 | 0.27 | 10 | — | — | — | — | — | — |
| WNU63 | 76768.8 | — | — | — | 10.1 | 0.10 | 18 | 0.460 | 0.14 | 12 |
| WNU19 | 76568.2 | — | — | — | 9.63 | 0.23 | 13 | — | — | — |
| WNU19 | 76570.3 | — | — | — | 9.54 | 0.27 | 12 | — | — | — |
| WNU19 | 76570.7 | 0.733 | 0.19 | 12 | — | — | — | — | — | — |
| WNU16 | 77167.2 | 0.730 | 0.20 | 11 | 9.82 | 0.18 | 15 | — | — | — |
| WNU16 | 77167.5 | 0.729 | 0.21 | 11 | — | — | — | — | — | — |
| WNU16 | 77169.2 | 0.726 | 0.24 | 11 | 9.83 | 0.18 | 15 | — | — | — |
| CONT. | — | 0.656 | — | — | 8.54 | — | — | 0.410 | — | — |

Table 93. "CONT."—Control;

"Ave."—Average;

"% Incr." = % increment;

"p-val."—p-value;

L means that p-value is less than 0.01, p < 0.1 was considered as significant. The transgenes were under the transcriptional regulation of the new At6669 promoter (SEQ ID NO: 6918).

TABLE 94

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| WNU30 | 76572.5 | 0.476 | 0.11 | 12 | — | — | — | — | — | — |
| WNU30 | 76574.1 | 0.466 | 0.10 | 9 | — | — | — | — | — | — |
| WNU30 | 76575.1 | — | — | — | 8.44 | 0.06 | 10 | 4.83 | 0.08 | 5 |
| WNU30 | 76575.3 | 0.457 | 0.08 | 7 | — | — | — | — | — | — |
| WNU101 | 75778.2 | 0.463 | 0.15 | 8 | — | — | — | — | — | — |
| WNU101 | 75778.3 | 0.459 | 0.19 | 7 | — | — | — | — | — | — |
| WNU101 | 75780.1 | — | — | — | — | — | — | 4.96 | 0.09 | 8 |
| CONT. | — | 0.427 | — | — | 7.64 | — | — | 4.60 | — | — |
| WNU85 | 76836.1 | — | — | — | 12.3 | 0.04 | 16 | 5.91 | 0.03 | 9 |
| WNU85 | 76836.2 | — | — | — | 11.8 | 0.04 | 11 | 5.75 | 0.08 | 6 |
| WNU85 | 76837.7 | 0.421 | 0.15 | 12 | — | — | — | — | — | — |
| WNU85 | 76840.5 | — | — | — | 11.7 | 0.08 | 10 | 5.88 | 0.02 | 8 |
| WNU82 | 75806.2 | 0.406 | 0.13 | 8 | — | — | — | — | — | — |
| WNU80 | 76403.1 | 0.433 | 0.22 | 15 | — | — | — | — | — | — |
| WNU80 | 76404.3 | 0.431 | 0.05 | 14 | — | — | — | 5.66 | 0.21 | 4 |
| WNU68 | 76831.4 | 0.400 | 0.03 | 6 | — | — | — | — | — | — |
| WNU68 | 76833.7 | — | — | — | 11.5 | 0.23 | 8 | 5.71 | 0.12 | 5 |
| WNU56 | 75801.10 | — | — | — | — | — | — | 5.83 | 0.03 | 7 |
| WNU56 | 75801.8 | 0.395 | 0.14 | 5 | — | — | — | — | — | — |
| WNU56 | 75801.9 | 0.412 | 0.04 | 9 | 11.3 | 0.27 | 7 | 5.64 | 0.30 | 4 |
| WNU56 | 75803.1 | 0.468 | 0.23 | 24 | — | — | — | — | — | — |
| WNU56 | 75803.7 | — | — | — | 11.8 | 0.08 | 11 | 5.69 | 0.16 | 5 |
| WNU56 | 75804.1 | — | — | — | 11.5 | 0.27 | 9 | 5.72 | 0.26 | 5 |
| CONT. | — | 0.377 | — | — | 10.6 | — | — | 5.44 | — | — |
| WNU77 | 78016.8 | — | — | — | — | — | — | 4.80 | 0.27 | 7 |
| WNU63 | 76766.5 | 0.471 | 0.07 | 4 | — | — | — | — | — | — |
| WNU63 | 76768.8 | — | — | — | 8.62 | 0.11 | 19 | 4.99 | 0.05 | 11 |
| WNU50 | 78130.1 | 0.464 | 0.18 | 3 | — | — | — | — | — | — |
| WNU50 | 78130.8 | 0.499 | L | 11 | — | — | — | — | — | — |
| WNU19 | 76568.1 | 0.492 | L | 9 | — | — | — | — | — | — |
| WNU19 | 76568.2 | — | — | — | 7.91 | 0.13 | 9 | 4.84 | L | 8 |
| WNU19 | 76569.3 | 0.477 | 0.21 | 6 | — | — | — | — | — | — |
| WNU19 | 76570.3 | — | — | — | 8.34 | 0.06 | 16 | 4.85 | 0.16 | 8 |
| WNU16 | 77167.2 | — | — | — | 8.38 | 0.24 | 16 | — | — | — |
| WNU16 | 77168.2 | 0.472 | 0.03 | 5 | — | — | — | — | — | — |

TABLE 94-continued

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| WNU16 | 77169.2 | — | — | — | 8.51 | 0.24 | 18 | — | — | — |
| CONT. | — | 0.451 | — | — | 7.22 | — | — | 4.49 | — | — |

Table 94. "CONT."—Control;
"Ave."—Average;
"% Incr." = % increment;
"p-val."—p-value;
L means that p-value is less than 0.01, p < 0.1 was considered as significant. The transgenes were under the transcriptional regulation of the new At6669 promoter (SEQ ID NO: 6918).

TABLE 95

Genes showing improved plant performance at Normal growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| WNU30 | 76572.5 | 328.7 | 0.16 | 17 | — | — | — |
| WNU30 | 76574.1 | 293.5 | 0.07 | 4 | — | — | — |
| WNU30 | 76574.2 | 293.4 | 0.30 | 4 | — | — | — |
| WNU101 | 75777.3 | 304.4 | L | 8 | 21.2 | 0.16 | 2 |
| WNU101 | 75778.2 | — | — | — | 22.7 | L | 9 |
| WNU101 | 75778.3 | 301.2 | 0.18 | 7 | — | — | — |
| CONT. | — | 281.3 | — | — | 20.8 | — | — |
| WNU85 | 76840.1 | — | — | — | 20.1 | 0.13 | 3 |
| WNU85 | 76840.5 | 317.6 | L | 12 | 21.8 | 0.11 | 11 |
| WNU82 | 75806.4 | — | — | — | 23.9 | 0.03 | 22 |
| WNU82 | 75807.5 | — | — | — | 20.3 | 0.09 | 4 |
| WNU82 | 75807.6 | — | — | — | 21.9 | L | 12 |
| WNU82 | 75808.6 | — | — | — | 20.5 | 0.13 | 5 |
| WNU82 | 75809.3 | — | — | — | 21.5 | 0.03 | 10 |
| WNU80 | 76403.2 | — | — | — | 24.0 | L | 23 |
| WNU80 | 76404.3 | — | — | — | 20.2 | 0.25 | 3 |
| WNU80 | 76405.6 | — | — | — | 23.6 | 0.02 | 21 |
| WNU68 | 76831.4 | 319.2 | L | 12 | — | — | — |
| WNU68 | 76832.1 | — | — | — | 20.8 | 0.26 | 6 |
| WNU68 | 76832.3 | — | — | — | 22.7 | 0.08 | 16 |
| WNU68 | 76833.10 | 320.8 | 0.04 | 13 | — | — | — |
| WNU56 | 75801.1 | — | — | — | 20.9 | 0.08 | 7 |
| WNU56 | 75803.7 | — | — | — | 21.7 | 0.17 | 11 |
| CONT. | — | 284.7 | — | — | 19.6 | — | — |
| WNU77 | 78016.8 | — | — | — | 23.3 | 0.07 | 11 |
| WNU77 | 78016.9 | — | — | — | 29.4 | 0.03 | 40 |
| WNU77 | 78018.10 | — | — | — | 24.3 | 0.11 | 15 |
| WNU65 | 78006.6 | — | — | — | 23.4 | 0.05 | 11 |
| WNU65 | 78006.7 | — | — | — | 23.4 | 0.20 | 11 |
| WNU65 | 78007.1 | — | — | — | 22.3 | 0.09 | 6 |
| WNU63 | 76766.5 | 378.4 | 0.11 | 4 | — | — | — |
| WNU63 | 76768.5 | — | — | — | 23.9 | 0.02 | 14 |
| WNU50 | 78114.2 | — | — | — | 22.8 | 0.19 | 8 |
| WNU50 | 78114.5 | 384.5 | 0.02 | 5 | — | — | — |
| WNU50 | 78114.6 | — | — | — | 24.6 | 0.04 | 17 |
| WNU50 | 78130.2 | — | — | — | 23.3 | 0.07 | 10 |
| WNU19 | 76568.1 | 397.5 | 0.04 | 9 | — | — | — |
| WNU19 | 76568.2 | — | — | — | 23.0 | 0.08 | 9 |
| WNU19 | 76569.2 | — | — | — | 22.6 | 0.15 | 7 |
| WNU19 | 76569.3 | — | — | — | 21.6 | 0.02 | 3 |
| WNU19 | 76569.4 | 403.2 | 0.11 | 10 | 21.7 | 0.28 | 3 |
| WNU19 | 76570.3 | — | — | — | 23.9 | 0.02 | 14 |
| WNU16 | 77166.4 | — | — | — | 26.6 | 0.01 | 26 |
| WNU16 | 77167.2 | — | — | — | 23.6 | 0.14 | 12 |
| WNU16 | 77167.3 | — | — | — | 24.4 | 0.08 | 16 |
| WNU16 | 77169.1 | — | — | — | 24.0 | 0.08 | 14 |
| WNU16 | 77169.2 | 397.4 | 0.11 | 9 | 21.8 | 0.19 | 4 |
| CONT. | — | 364.9 | — | — | 21.1 | — | — |

Table 95. "CONT."—Control;
"Ave."—Average;
"% Incr." = % increment;
"p-val."—p-value;
L means that p-value is less than 0.01, p < 0.1 was considered as significant. The transgenes were under the transcriptional regulation of the new At6669 promoter (SEQ ID NO: 6918).

Example 20

Evaluation of Transgenic Arabidopsis Nue, Yield and Plant Growth Rate Under Low or Normal Nitrogen Fertilization in Greenhouse Assay Assay 2: Nitrogen Use Efficiency Measured Until Bolting Stage: Plant Biomass and Plant Growth Rate at Limited and Optimal Nitrogen Concentration Under Greenhouse Conditions—

This assay follows the plant biomass formation and the rosette area growth of plants grown in the greenhouse at limiting and non-limiting nitrogen growth conditions. Transgenic Arabidopsis seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 1.5 mM inorganic nitrogen in the form of $KNO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $KNO_3$ with 1 mM $KH_2PO_4$, 1 mM $MgSO_4$, 2 mM $CaCl_2$ and microelements. All plants were grown in the greenhouse until bolting. Plant biomass (the above ground tissue) was weighted in directly after harvesting the rosette (plant fresh weight [FW]). Following plants were dried in an oven at 50° C. for 48 hours and weighted (plant dry weight [DW]).

Each construct was validated at its $T_2$ generation. Transgenic plants transformed with a construct conformed by an empty vector carrying the At6669 promoter and the selectable marker was used as control.

The plants were analyzed for their overall size, growth rate, fresh weight and dry matter. Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which is developed at the U.S. National Institutes of Health and freely available on the internet at rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number (Formula VIII, described above), rosette area (Formula IX described above) and plot coverage (Formula XI, described above) was calculated using the indicated formulas.

Plant Fresh and Dry weight—On about day 80 from sowing, the plants were harvested and directly weighted for the determination of the plant fresh weight (FW) and left to dry at 50° C. in a drying chamber for about 48 hours before weighting to determine plant dry weight (DW).

Statistical analyses—To identify genes conferring significantly improved tolerance to abiotic stresses and improved nitrogen use efficiency, the results obtained from the transgenic plants were compared to those obtained from control plants when grown under identical growth conditions. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

The genes listed in Tables 96-97 improved plant NUE when grown at limiting nitrogen concentration levels. These genes produced larger plants with a larger photosynthetic area, biomass (fresh weight, dry weight, leaf number, rosette diameter, rosette area and plot coverage) when grown under limiting nitrogen conditions (nutrient deficiency stress) as compared to control plants grown under identical growth conditions.

TABLE 96

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr |
| WNU78 | 76661.4 | — | — | — | — | — | — | 11.0 | 0.11 | 8 |
| WNU78 | 76662.2 | — | — | — | — | — | — | 11.2 | L | 10 |
| WNU74 | 77576.6 | — | — | — | — | — | — | 10.8 | 0.19 | 6 |
| WNU74 | 77578.4 | 164.6 | 0.21 | 20 | 1112.5 | 0.10 | 18 | — | — | — |
| WNU74 | 77579.5 | 178.8 | 0.18 | 30 | 1270.8 | 0.08 | 34 | 11.0 | 0.02 | 8 |
| WNU67 | 79473.3 | 182.5 | 0.26 | 33 | 1166.7 | 0.28 | 23 | — | — | — |
| WNU67 | 79473.4 | — | — | — | — | — | — | 10.8 | 0.12 | 6 |
| WNU32 | 76576.4 | — | — | — | — | — | — | 11.4 | 0.02 | 12 |
| WNU32 | 76576.5 | — | — | — | 1116.7 | 0.02 | 18 | — | — | — |
| WNU32 | 76578.1 | — | — | — | — | — | — | 11.2 | 0.07 | 10 |
| WNU32 | 76578.3 | 171.1 | 0.13 | 25 | 1202.4 | L | 27 | 10.8 | 0.19 | 6 |
| WNU32 | 76578.5 | — | — | — | — | — | — | 10.8 | L | 7 |
| WNU32 | 76580.2 | — | — | — | 1125.0 | 0.19 | 19 | — | — | — |
| WNU32 | 76580.6 | 210.0 | 0.22 | 53 | 1383.3 | 0.09 | 46 | — | — | — |
| WNU25 | 76624.8 | 252.5 | 0.26 | 84 | 1500.0 | 0.26 | 59 | — | — | — |
| WNU25 | 78806.8 | — | — | — | 1125.0 | 0.23 | 19 | — | — | — |
| WNU25 | 78808.4 | — | — | — | 1097.6 | 0.21 | 16 | — | — | — |
| CONT. | — | 137.0 | — | — | 946.3 | — | — | 10.2 | — | — |
| WNU75 | 76657.4 | — | — | — | 1757.1 | 0.09 | 12 | — | — | — |
| WNU75 | 76657.5 | 177.6 | 0.04 | 13 | 1764.3 | L | 13 | — | — | — |
| WNU75 | 76658.4 | — | — | — | 1690.5 | 0.20 | 8 | — | — | — |
| WNU75 | 76659.5 | — | — | — | 1735.7 | 0.02 | 11 | — | — | — |
| WNU54 | 76641.1 | 169.2 | 0.18 | 7 | — | — | — | — | — | — |
| WNU54 | 76643.5 | 166.5 | 0.25 | 6 | — | — | — | — | — | — |
| WNU54 | 76645.5 | — | — | — | — | — | — | 9.52 | 0.23 | 3 |
| WNU44 | 76636.1 | — | — | — | 1695.8 | 0.29 | 8 | — | — | — |
| WNU29 | 76628.4 | 167.1 | 0.28 | 6 | 1908.3 | 0.01 | 22 | — | — | — |
| WNU29 | 76628.9 | — | — | — | 1691.7 | 0.21 | 8 | — | — | — |
| WNU29 | 76629.1 | — | — | — | 1712.5 | 0.05 | 9 | — | — | — |

TABLE 96-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr |
| WNU29 | 76630.2 | — | — | — | 1720.8 | 0.16 | 10 | — | — | — |
| WNU18 | 76563.3 | — | — | — | — | — | — | 9.62 | 0.12 | 4 |
| WNU18 | 76563.5 | — | — | — | 1701.0 | 0.07 | 9 | — | — | — |
| WNU18 | 76564.2 | 170.0 | 0.24 | 8 | 1758.3 | 0.08 | 12 | — | — | — |
| WNU18 | 76565.6 | — | — | — | — | — | — | 9.50 | 0.27 | 3 |
| WNU104 | 76618.3 | — | — | — | 1658.3 | 0.22 | 6 | — | — | — |
| WNU104 | 76619.6 | 163.8 | 0.26 | 4 | — | — | — | — | — | — |
| WNU104 | 76620.5 | 171.0 | 0.19 | 9 | 1898.2 | 0.13 | 21 | — | — | — |
| WNU104 | 76620.7 | 187.9 | 0.12 | 19 | 1750.0 | 0.20 | 12 | — | — | — |
| CONT. | — | 157.6 | — | — | 1564.3 | — | — | 9.23 | — | — |
| WNU87 | 76667.1 | — | — | — | 1583.3 | 0.13 | 7 | — | — | — |
| WNU87 | 76667.3 | — | — | — | 1750.0 | 0.08 | 18 | 10.1 | 0.10 | 6 |
| WNU87 | 76670.3 | — | — | — | 1537.5 | 0.26 | 4 | — | — | — |
| WNU73 | 76653.1 | — | — | — | — | — | — | 10.0 | 0.29 | 5 |
| WNU73 | 76654.1 | — | — | — | 1708.3 | 0.27 | 15 | — | — | — |
| WNU58 | 76761.5 | — | — | — | — | — | — | 9.88 | 0.27 | 3 |
| WNU58 | 76762.2 | — | — | — | 1570.8 | 0.13 | 6 | — | — | — |
| WNU58 | 76764.2 | — | — | — | 1629.2 | 0.07 | 10 | 10.1 | 0.06 | 6 |
| WNU39 | 77171.4 | — | — | — | 1583.3 | 0.20 | 7 | — | — | — |
| WNU39 | 77171.5 | — | — | — | 1583.3 | 0.24 | 7 | — | — | — |
| CONT. | — | 133.9 | — | — | 1481.7 | — | — | 9.54 | — | — |
| WNU99 | 77099.2 | — | — | — | — | — | — | 10.1 | 0.04 | 5 |
| WNU97 | 77181.6 | — | — | — | 143.8 | 0.25 | 20 | — | — | — |
| WNU83 | 75821.7 | — | — | — | 150.0 | 0.14 | 25 | 10.4 | L | 8 |
| WNU83 | 75821.8 | — | — | — | — | — | — | 9.81 | 0.24 | 3 |
| WNU83 | 75823.9 | — | — | — | — | — | — | 9.88 | 0.22 | 3 |
| WNU61 | 78014.2 | — | — | — | — | — | — | 10.1 | 0.19 | 6 |
| WNU61 | 78015.10 | — | — | — | 143.8 | 0.25 | 20 | — | — | — |
| WNU6 | 76542.5 | — | — | — | 156.2 | 0.25 | 31 | — | — | — |
| WNU5 | 76045.4 | — | — | — | 143.8 | 0.25 | 20 | — | — | — |
| WNU43 | 77267.2 | — | — | — | — | — | — | 9.81 | 0.24 | 3 |
| WNU42 | 76599.4 | — | — | — | — | — | — | 10.1 | 0.14 | 5 |
| WNU35 | 75794.1 | — | — | — | — | — | — | 9.88 | 0.14 | 3 |
| WNU35 | 75794.3 | — | — | — | — | — | — | 10.1 | 0.05 | 6 |
| WNU34 | 76588.6 | — | — | — | — | — | — | 10.1 | 0.05 | 6 |
| WNU31 | 75786.3 | — | — | — | — | — | — | 10.2 | 0.09 | 7 |
| WNU31 | 75789.5 | — | — | — | 168.8 | 0.03 | 41 | 10.2 | 0.01 | 7 |
| WNU11 | 76398.1 | — | — | — | — | — | — | 10.1 | 0.14 | 5 |
| WNU105 | 77261.2 | — | — | — | — | — | — | 10.1 | 0.02 | 6 |
| WNU105 | 77262.1 | — | — | — | — | — | — | 10.0 | 0.10 | 5 |
| WNU102 | 76549.8 | — | — | — | — | — | — | 9.94 | 0.24 | 4 |
| CONT. | — | — | — | — | 119.6 | — | — | 9.56 | — | — |
| WNU28 | 76826.1 | 205.4 | L | 13 | 1804.2 | 0.17 | 10 | 10.0 | 0.23 | 1 |
| WNU28 | 76829.3 | — | — | — | — | — | — | 10.3 | 0.28 | 4 |
| WNU21 | 75781.10 | — | — | — | — | — | — | 10.3 | 0.27 | 4 |
| WNU21 | 75781.6 | — | — | — | 1762.5 | 0.19 | 7 | 10.3 | L | 4 |
| WNU21 | 75781.8 | — | — | — | — | — | — | 10.3 | 0.16 | 4 |
| WNU21 | 75784.7 | 195.8 | 0.26 | 7 | — | — | — | — | — | — |
| WNU13 | 78921.4 | 200.4 | 0.10 | 10 | 1879.2 | 0.22 | 14 | 10.4 | 0.20 | 6 |
| WNU13 | 78923.6 | 190.8 | 0.24 | 5 | — | — | — | — | — | — |
| WNU13 | 78923.8 | — | — | — | 1766.7 | 0.11 | 7 | — | — | — |
| WNU13 | 78924.3 | 200.4 | 0.30 | 10 | — | — | — | 10.6 | 0.04 | 8 |
| WNU13 | 78925.8 | — | — | — | — | — | — | 10.2 | 0.09 | 4 |
| CONT. | — | 182.3 | — | — | 1645.4 | — | — | 9.86 | — | — |
| WNU66 | 77753.1 | 212.3 | L | 21 | 1867.9 | 0.15 | 36 | — | — | — |
| WNU66 | 77753.4 | — | — | — | 1546.4 | 0.05 | 13 | — | — | — |
| WNU66 | 77754.10 | — | — | — | 1537.5 | 0.25 | 12 | — | — | — |
| WNU66 | 77754.2 | — | — | — | 1500.0 | 0.15 | 9 | — | — | — |
| WNU66 | 77754.4 | 192.5 | 0.15 | 10 | 1550.0 | 0.06 | 13 | — | — | — |
| WNU60 | 78877.12 | 190.0 | 0.07 | 9 | 1504.2 | 0.10 | 10 | — | — | — |
| WNU60 | 78877.7 | — | — | — | 1465.7 | 0.29 | 7 | — | — | — |
| WNU60 | 78877.8 | 194.2 | 0.21 | 11 | 1612.5 | 0.09 | 18 | — | — | — |
| WNU60 | 78877.9 | — | — | — | 1504.2 | 0.19 | 10 | — | — | — |
| WNU60 | 78878.10 | 200.8 | 0.09 | 15 | 1679.2 | 0.04 | 22 | — | — | — |
| WNU60 | 78878.9 | — | — | — | 1501.8 | 0.15 | 10 | — | — | — |
| WNU47 | 77176.3 | — | — | — | 1728.6 | 0.07 | 26 | — | — | — |
| WNU47 | 77177.2 | 200.0 | 0.08 | 14 | 1608.3 | L | 17 | — | — | — |
| WNU47 | 77178.5 | 188.3 | 0.15 | 8 | 1529.2 | 0.17 | 12 | — | — | — |
| WNU47 | 77178.8 | 185.4 | 0.19 | 6 | 1454.2 | 0.30 | 6 | — | — | — |
| WNU47 | 77178.9 | 201.2 | 0.03 | 15 | 1666.7 | L | 22 | — | — | — |
| WNU47 | 77180.2 | — | — | — | 1612.5 | 0.03 | 18 | — | — | — |
| WNU47 | 77180.5 | — | — | — | 1474.4 | 0.21 | 8 | — | — | — |
| WNU33 | 76581.3 | 200.4 | 0.11 | 15 | 1654.2 | 0.06 | 21 | — | — | — |

TABLE 96-continued

Genes showing improved plant biomass production at limiting nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr |
| WNU33 | 76581.5 | — | — | — | 1591.7 | 0.25 | 16 | — | — | — |
| WNU33 | 76582.1 | — | — | — | 1614.9 | 0.02 | 18 | — | — | — |
| WNU33 | 76584.1 | 199.3 | 0.18 | 14 | 1522.6 | 0.07 | 11 | — | — | — |
| WNU33 | 76584.3 | — | — | — | 1795.8 | 0.10 | 31 | — | — | — |
| WNU33 | 76584.4 | 188.7 | 0.15 | 8 | 1575.6 | 0.02 | 15 | — | — | — |
| WNU33 | 76585.4 | 193.5 | 0.16 | 11 | 1541.1 | 0.05 | 12 | — | — | — |
| WNU27 | 77747.3 | — | — | — | 1500.0 | 0.13 | 9 | — | — | — |
| WNU27 | 77747.4 | — | — | — | 1541.7 | 0.22 | 12 | — | — | — |
| WNU27 | 77747.5 | — | — | — | 1497.6 | 0.27 | 9 | — | — | — |
| WNU27 | 77748.2 | — | — | — | — | — | — | 10.5 | 0.16 | 6 |
| WNU27 | 77750.1 | 196.0 | 0.10 | 12 | 1535.7 | 0.15 | 12 | — | — | — |
| WNU27 | 77750.3 | 196.7 | 0.08 | 13 | 1583.3 | 0.15 | 15 | — | — | — |
| WNU26 | 76673.10 | 211.2 | 0.04 | 21 | 1712.5 | L | 25 | — | — | — |
| WNU26 | 76673.2 | 197.1 | 0.15 | 13 | 1716.7 | 0.03 | 25 | — | — | — |
| WNU26 | 76673.4 | — | — | — | 1511.9 | 0.29 | 10 | — | — | — |
| WNU26 | 76673.9 | — | — | — | 1529.2 | 0.12 | 12 | — | — | — |
| WNU26 | 76674.1 | — | — | — | 1486.9 | 0.14 | 8 | — | — | — |
| WNU26 | 76675.4 | — | — | — | 1533.3 | 0.07 | 12 | — | — | — |
| CONT. | — | 174.8 | — | — | 1371.0 | — | — | 9.84 | — | — |
| WNU92 | 77124.5 | 99.2 | 0.08 | 17 | 823.8 | 0.25 | 15 | 10.5 | 0.12 | 8 |
| WNU92 | 77125.3 | — | — | — | 854.2 | 0.17 | 19 | — | — | — |
| WNU72 | 77086.3 | 110.0 | L | 29 | 966.7 | 0.01 | 35 | — | — | — |
| WNU72 | 77088.5 | 96.2 | 0.16 | 13 | 831.5 | 0.19 | 16 | — | — | — |
| WNU72 | 77090.2 | 100.1 | 0.29 | 18 | 878.6 | 0.08 | 23 | — | — | — |
| WNU57 | 76647.1 | 116.7 | 0.23 | 37 | 1014.3 | 0.22 | 42 | — | — | — |
| WNU57 | 76649.5 | 97.2 | 0.12 | 14 | 869.0 | 0.08 | 21 | — | — | — |
| WNU57 | 76649.6 | 105.5 | 0.13 | 24 | 919.0 | 0.08 | 28 | — | — | — |
| WNU57 | 76650.2 | — | — | — | — | — | — | 10.1 | 0.21 | 4 |
| WNU52 | 76605.3 | 98.0 | 0.09 | 15 | — | — | — | — | — | — |
| WNU3 | 76633.10 | — | — | — | — | — | — | 10.2 | 0.28 | 5 |
| WNU3 | 76633.12 | — | — | — | — | — | — | 10.0 | 0.21 | 2 |
| WNU3 | 76633.13 | — | — | — | 825.0 | 0.16 | 15 | — | — | — |
| WNU3 | 76633.8 | 105.0 | 0.03 | 23 | 1000.0 | 0.08 | 40 | — | — | — |
| WNU3 | 76635.1 | 111.2 | 0.12 | 31 | 991.7 | 0.15 | 39 | — | — | — |
| WNU15 | 76552.7 | 103.0 | 0.18 | 21 | 946.0 | 0.01 | 32 | — | — | — |
| CONT. | — | 85.1 | — | — | 715.6 | — | — | 9.77 | — | — |

Table 96. "CONT."—Control;
"Ave."—Average;
"% Incr." = % increment;
"p-val."—p-value;
L means that p-value is less than 0.01, p < 0.1 was considered as significant

TABLE 97

Genes showing improved plant biomass production at limiting nitrogen growth conditions

| Gene Name | Event # | Plot Coverage [cm$^2$] | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| WNU78 | 76661.4 | 91.8 | L | 44 | 11.5 | L | 44 | 5.77 | L | 19 |
| WNU78 | 76662.2 | 82.7 | L | 30 | 10.3 | L | 30 | 5.49 | L | 14 |
| WNU78 | 76665.5 | — | — | — | — | — | — | 5.10 | 0.01 | 6 |
| WNU78 | 76665.6 | 73.7 | 0.11 | 16 | 9.21 | 0.11 | 16 | — | — | — |
| WNU74 | 77576.1 | 70.7 | 0.04 | 11 | 8.84 | 0.04 | 11 | 5.25 | 0.02 | 9 |
| WNU74 | 77576.2 | 67.0 | 0.21 | 5 | 8.38 | 0.21 | 5 | 5.02 | 0.04 | 4 |
| WNU74 | 77576.6 | 74.3 | 0.01 | 16 | 9.29 | 0.01 | 16 | 5.29 | L | 9 |
| WNU74 | 77576.8 | — | — | — | — | — | — | 5.08 | 0.15 | 5 |
| WNU74 | 77579.5 | 70.9 | 0.22 | 11 | 8.87 | 0.22 | 11 | 5.16 | 0.20 | 7 |
| WNU71 | 77656.1 | 70.6 | 0.18 | 11 | 8.82 | 0.18 | 11 | 5.24 | 0.04 | 8 |
| WNU67 | 79413.2 | — | — | — | — | — | — | 5.18 | 0.21 | 7 |
| WNU67 | 79413.5 | — | — | — | — | — | — | 5.01 | 0.16 | 4 |
| WNU67 | 79472.2 | — | — | — | — | — | — | 4.95 | 0.25 | 2 |
| WNU67 | 79473.4 | 79.9 | L | 25 | 9.99 | L | 25 | 5.39 | L | 11 |
| WNU32 | 76576.2 | 72.4 | 0.26 | 13 | 9.05 | 0.26 | 13 | 5.10 | 0.27 | 5 |
| WNU32 | 76576.4 | 93.1 | L | 46 | 11.6 | L | 46 | 5.76 | L | 19 |
| WNU32 | 76576.5 | 71.4 | L | 12 | 8.92 | L | 12 | 5.22 | 0.05 | 8 |

TABLE 97-continued

Genes showing improved plant biomass production at limiting nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| WNU32 | 76578.1 | 85.1 | L | 33 | 10.6 | L | 33 | 5.59 | L | 16 |
| WNU32 | 76578.3 | 74.0 | 0.17 | 16 | 9.25 | 0.17 | 16 | 5.09 | 0.17 | 5 |
| WNU32 | 76578.5 | 76.6 | L | 20 | 9.58 | L | 20 | 5.33 | L | 10 |
| WNU32 | 76580.2 | 70.8 | 0.01 | 11 | 8.85 | 0.01 | 11 | 5.17 | 0.03 | 7 |
| WNU32 | 76580.6 | 76.5 | L | 20 | 9.56 | L | 20 | 5.18 | L | 7 |
| CONT. | — | 63.8 | — | — | 7.97 | — | — | 4.83 | — | — |
| WNU75 | 76657.6 | 40.6 | 0.19 | 10 | 5.07 | 0.23 | 9 | 3.98 | 0.14 | 6 |
| WNU75 | 76658.3 | 40.9 | 0.16 | 11 | 5.11 | 0.19 | 10 | 4.00 | 0.13 | 7 |
| WNU54 | 76645.5 | — | — | — | 5.18 | 0.30 | 11 | 4.06 | 0.18 | 8 |
| WNU18 | 76565.5 | 46.3 | 0.10 | 25 | 5.78 | 0.11 | 24 | 4.24 | 0.12 | 13 |
| CONT. | — | 37.0 | — | — | 4.66 | — | — | 3.75 | — | — |
| WNU87 | 76667.1 | 61.5 | 0.17 | 7 | 7.69 | 0.17 | 7 | 4.88 | 0.02 | 7 |
| WNU87 | 76667.3 | 67.3 | 0.23 | 17 | 8.41 | 0.23 | 17 | 4.86 | 0.28 | 6 |
| WNU87 | 76670.3 | 61.9 | 0.16 | 7 | 7.74 | 0.16 | 7 | 4.78 | 0.10 | 4 |
| WNU39 | 77171.5 | 63.1 | 0.09 | 9 | 7.88 | 0.09 | 9 | 4.78 | 0.28 | 4 |
| WNU2 | 77867.3 | 65.4 | 0.20 | 13 | 8.18 | 0.20 | 13 | — | — | — |
| WNU2 | 77869.1 | — | — | — | — | — | — | 4.87 | 0.23 | 6 |
| WNU2 | 77869.3 | 61.6 | 0.20 | 7 | 7.70 | 0.20 | 7 | 4.77 | 0.11 | 4 |
| CONT. | — | 57.7 | — | — | 7.22 | — | — | 4.58 | — | — |
| WNU99 | 77097.4 | 36.9 | 0.06 | 10 | 4.62 | 0.06 | 10 | 4.05 | 0.05 | 6 |
| WNU99 | 77098.4 | — | — | — | — | — | — | 4.05 | 0.07 | 6 |
| WNU99 | 77099.4 | 38.4 | 0.28 | 14 | 4.80 | 0.28 | 14 | — | — | — |
| WNU98 | 77463.13 | — | — | — | — | — | — | 4.15 | 0.01 | 9 |
| WNU98 | 77465.1 | 38.1 | 0.02 | 13 | 4.76 | 0.02 | 13 | 4.09 | 0.03 | 7 |
| WNU98 | 77465.3 | 37.5 | 0.06 | 12 | 4.69 | 0.06 | 12 | 4.30 | L | 12 |
| WNU97 | 77181.6 | 40.7 | L | 21 | 5.09 | L | 21 | 4.28 | 0.08 | 12 |
| WNU94 | 78108.5 | — | — | — | — | — | — | 3.95 | 0.21 | 3 |
| WNU91 | 76211.3 | — | — | — | — | — | — | 3.94 | 0.25 | 3 |
| WNU83 | 75821.7 | 44.7 | L | 33 | 5.58 | L | 33 | 4.50 | L | 18 |
| WNU83 | 75821.8 | 37.4 | 0.06 | 11 | 4.67 | 0.06 | 11 | 4.08 | 0.04 | 7 |
| WNU83 | 75823.9 | — | — | — | — | — | — | 4.00 | 0.11 | 5 |
| WNU61 | 78014.1 | 37.7 | 0.20 | 12 | 4.71 | 0.20 | 12 | 4.17 | 0.01 | 9 |
| WNU61 | 78014.2 | 38.5 | 0.03 | 14 | 4.81 | 0.03 | 14 | 4.12 | 0.14 | 8 |
| WNU6 | 76542.5 | 38.9 | 0.01 | 16 | 4.86 | 0.01 | 16 | 4.15 | 0.04 | 9 |
| WNU6 | 76544.8 | 36.3 | 0.28 | 8 | 4.54 | 0.28 | 8 | 4.00 | 0.11 | 5 |
| WNU55 | 77631.1 | — | — | — | — | — | — | 4.02 | 0.24 | 5 |
| WNU51 | 79018.4 | — | — | — | — | — | — | 4.04 | 0.07 | 6 |
| WNU51 | 79020.6 | — | — | — | — | — | — | 3.99 | 0.21 | 4 |
| WNU5 | 76045.4 | 36.4 | 0.24 | 8 | 4.55 | 0.24 | 8 | — | — | — |
| WNU46 | 77024.6 | 36.2 | 0.17 | 8 | 4.52 | 0.17 | 8 | 3.98 | 0.21 | 4 |
| WNU43 | 77267.2 | 36.0 | 0.19 | 7 | 4.50 | 0.19 | 7 | — | — | — |
| WNU42 | 76598.1 | 37.6 | 0.06 | 12 | 4.70 | 0.06 | 12 | 4.05 | 0.08 | 6 |
| WNU42 | 76599.4 | 41.4 | L | 23 | 5.17 | L | 23 | 4.23 | L | 11 |
| WNU41 | 79012.4 | 39.2 | L | 16 | 4.90 | L | 16 | 4.25 | 0.05 | 11 |
| WNU35 | 75792.2 | — | — | — | — | — | — | 3.95 | 0.24 | 3 |
| WNU35 | 75794.1 | 35.8 | 0.19 | 7 | 4.48 | 0.19 | 7 | 3.97 | 0.20 | 4 |
| WNU35 | 75794.3 | 44.5 | 0.27 | 32 | 5.56 | 0.27 | 32 | 4.53 | 0.23 | 19 |
| WNU34 | 76588.3 | 38.3 | 0.02 | 14 | 4.78 | 0.02 | 14 | 4.06 | 0.04 | 6 |
| WNU34 | 76588.6 | — | — | — | — | — | — | 4.20 | 0.26 | 10 |
| WNU34 | 76588.8 | 36.7 | 0.21 | 9 | 4.58 | 0.21 | 9 | — | — | — |
| WNU31 | 75786.3 | 40.4 | L | 20 | 5.05 | L | 20 | 4.36 | L | 14 |
| WNU31 | 75786.7 | 39.9 | 0.02 | 19 | 4.99 | 0.02 | 19 | 4.20 | 0.08 | 10 |
| WNU31 | 75789.5 | 46.6 | L | 39 | 5.83 | L | 39 | 4.65 | L | 22 |
| WNU31 | 75790.8 | 38.3 | 0.21 | 14 | 4.79 | 0.21 | 14 | — | — | — |
| WNU17 | 76556.4 | 38.7 | 0.02 | 15 | 4.84 | 0.02 | 15 | 4.13 | 0.02 | 8 |
| WNU14 | 77113.4 | — | — | — | — | — | — | 3.98 | 0.14 | 4 |
| WNU11 | 76398.1 | 42.5 | 0.01 | 26 | 5.31 | 0.01 | 26 | 4.36 | L | 14 |
| WNU11 | 76400.2 | 37.8 | 0.03 | 13 | 4.73 | 0.03 | 13 | 4.20 | 0.15 | 10 |
| WNU105 | 77261.2 | 41.5 | L | 23 | 5.18 | L | 23 | 4.25 | L | 11 |
| WNU105 | 77262.1 | 36.2 | 0.17 | 8 | 4.53 | 0.17 | 8 | 3.99 | 0.26 | 4 |
| WNU102 | 76550.4 | 37.5 | 0.04 | 11 | 4.68 | 0.04 | 11 | 4.25 | 0.01 | 11 |
| CONT. | — | 33.6 | — | — | 4.20 | — | — | 3.82 | — | — |
| WNU28 | 76826.1 | 60.5 | 0.05 | 17 | 7.56 | 0.05 | 17 | 4.49 | 0.09 | 5 |
| WNU28 | 76827.3 | 56.4 | 0.18 | 9 | 7.05 | 0.18 | 9 | 4.45 | 0.19 | 4 |
| WNU28 | 76827.4 | 60.3 | 0.25 | 16 | 7.53 | 0.25 | 16 | — | — | — |
| WNU28 | 76829.3 | 61.7 | 0.04 | 19 | 7.71 | 0.04 | 19 | 4.62 | 0.17 | 8 |
| WNU21 | 75781.6 | 61.0 | L | 18 | 7.63 | L | 18 | 4.60 | L | 8 |
| WNU21 | 75781.8 | 63.0 | 0.03 | 21 | 7.87 | 0.03 | 21 | 4.69 | 0.07 | 10 |
| WNU21 | 75784.1 | 64.1 | 0.21 | 23 | 8.01 | 0.21 | 23 | 4.83 | 0.20 | 13 |
| WNU21 | 75784.4 | 58.8 | 0.16 | 13 | 7.35 | 0.16 | 13 | 4.47 | 0.28 | 5 |
| WNU21 | 75784.7 | 58.9 | 0.02 | 13 | 7.36 | 0.02 | 13 | 4.47 | 0.11 | 5 |

TABLE 97-continued

Genes showing improved plant biomass production at limiting nitrogen growth conditions

| Gene Name | Event # | Plot Coverage [cm²] Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| WNU13 | 78921.3 | 61.3 | 0.15 | 18 | 7.67 | 0.15 | 18 | 4.56 | 0.23 | 7 |
| WNU13 | 78921.4 | 63.8 | L | 23 | 7.98 | L | 23 | 4.61 | 0.06 | 8 |
| WNU13 | 78923.6 | 64.9 | 0.07 | 25 | 8.11 | 0.07 | 25 | 4.79 | 0.05 | 13 |
| WNU13 | 78924.2 | 55.6 | 0.17 | 7 | 6.95 | 0.17 | 7 | 4.39 | 0.30 | 3 |
| WNU13 | 78924.3 | 66.5 | 0.19 | 28 | 8.31 | 0.19 | 28 | 4.75 | 0.24 | 12 |
| WNU13 | 78925.3 | 60.8 | 0.04 | 17 | 7.60 | 0.04 | 17 | 4.57 | 0.12 | 7 |
| WNU13 | 78925.8 | 62.5 | 0.11 | 20 | 7.81 | 0.11 | 20 | 4.65 | 0.17 | 9 |
| CONT. | — | 51.9 | — | — | 6.49 | — | — | 4.26 | — | — |
| WNU66 | 77754.4 | 60.7 | 0.21 | 6 | 7.59 | 0.21 | 6 | 4.88 | 0.14 | 3 |
| WNU27 | 77748.1 | 65.1 | 0.11 | 14 | 8.14 | 0.11 | 14 | 5.00 | 0.17 | 5 |
| WNU27 | 77748.2 | 65.3 | 0.17 | 14 | 8.16 | 0.17 | 14 | 4.97 | 0.08 | 5 |
| WNU27 | 77750.1 | — | — | — | — | — | — | 5.04 | 0.21 | 6 |
| CONT. | — | 57.1 | — | — | 7.14 | — | — | 4.74 | — | — |
| WNU92 | 77124.5 | 70.5 | 0.26 | 12 | 8.82 | 0.29 | 11 | — | — | — |
| WNU92 | 77125.3 | 70.2 | 0.23 | 11 | 8.77 | 0.27 | 10 | — | — | — |
| WNU72 | 77086.3 | 69.4 | 0.15 | 10 | 8.68 | 0.18 | 9 | — | — | — |
| WNU72 | 77088.1 | 76.5 | 0.16 | 21 | 9.57 | 0.17 | 20 | 4.97 | 0.20 | 11 |
| WNU57 | 76647.1 | 71.5 | 0.27 | 13 | 9.33 | 0.14 | 17 | 4.92 | 0.15 | 10 |
| WNU57 | 76649.5 | 70.9 | 0.13 | 12 | 8.86 | 0.15 | 11 | 4.80 | 0.05 | 7 |
| WNU57 | 76649.7 | 72.6 | 0.09 | 15 | 9.08 | 0.10 | 14 | 4.84 | 0.14 | 8 |
| WNU57 | 76650.2 | 67.4 | 0.27 | 7 | — | — | — | — | — | — |
| CONT. | — | 63.1 | — | — | 7.96 | — | — | 4.48 | — | — |

Table 97: "CONT."—Control; "Ave."—Average; "% Incr." = % increment; "p-val."—p-value; L means that p-value is less than 0.01, p < 0.1 was considered as significant.

The genes listed in Table 98 improved plant NUE when grown at limiting nitrogen concentration levels. These genes produced faster developing plants when grown under limiting nitrogen growth conditions, compared to control plants, grown under identical conditions as measured by growth rate of leaf number, rosette diameter and plot coverage.

TABLE 98

Genes showing improved rosette growth performance at limiting nitrogen growth conditions

| Gene Name | Event # | RGR Of Leaf Number Ave. | P-Val. | % Incr. | RGR Of Plot Coverage [cm²/day] Ave. | P-Val. | % Incr. | RGR Of Rosette Diameter [cm/day] Ave. | P-Val. | % Incr. |
|---|---|---|---|---|---|---|---|---|---|---|
| WNU78 | 76661.4 | — | — | — | 15.4 | L | 36 | 0.591 | L | 20 |
| WNU78 | 76662.2 | — | — | — | 13.9 | L | 23 | 0.534 | 0.14 | 9 |
| WNU78 | 76665.5 | — | — | — | — | — | — | 0.538 | 0.12 | 9 |
| WNU78 | 76665.6 | — | — | — | 13.1 | 0.04 | 16 | 0.532 | 0.21 | 8 |
| WNU74 | 77576.1 | — | — | — | 12.6 | 0.12 | 11 | 0.549 | 0.06 | 11 |
| WNU74 | 77576.6 | — | — | — | 13.2 | 0.02 | 17 | 0.559 | 0.02 | 14 |
| WNU74 | 77576.8 | — | — | — | — | — | — | 0.536 | 0.16 | 9 |
| WNU74 | 77578.4 | — | — | — | 12.4 | 0.22 | 9 | — | — | — |
| WNU74 | 77579.5 | — | — | — | 13.0 | 0.05 | 16 | 0.529 | 0.23 | 7 |
| WNU71 | 77656.1 | — | — | — | 13.0 | 0.05 | 15 | 0.550 | 0.05 | 12 |
| WNU67 | 79413.2 | — | — | — | 12.8 | 0.09 | 13 | 0.551 | 0.06 | 12 |
| WNU67 | 79413.5 | — | — | — | — | — | — | 0.529 | 0.21 | 7 |
| WNU67 | 79473.4 | — | — | — | 14.0 | L | 24 | 0.565 | 0.01 | 15 |
| WNU32 | 76576.2 | — | — | — | 12.5 | 0.15 | 11 | — | — | — |
| WNU32 | 76576.4 | 0.801 | 0.28 | 11 | 15.8 | L | 40 | 0.563 | 0.01 | 14 |
| WNU32 | 76576.5 | — | — | — | 12.5 | 0.15 | 11 | 0.526 | 0.25 | 7 |
| WNU32 | 76577.1 | 0.820 | 0.20 | 14 | — | — | — | — | — | — |
| WNU32 | 76578.1 | 0.812 | 0.23 | 13 | 14.6 | L | 30 | 0.559 | 0.02 | 14 |
| WNU32 | 76578.3 | — | — | — | 13.0 | 0.06 | 16 | 0.542 | 0.10 | 10 |
| WNU32 | 76578.5 | — | — | — | 13.0 | 0.05 | 15 | 0.534 | 0.15 | 8 |
| WNU32 | 76580.2 | — | — | — | 12.8 | 0.07 | 14 | 0.556 | 0.04 | 13 |
| WNU32 | 76580.6 | — | — | — | 13.6 | L | 20 | 0.545 | 0.07 | 11 |
| WNU25 | 78806.7 | — | — | — | 12.7 | 0.13 | 12 | — | — | — |

TABLE 98-continued

Genes showing improved rosette growth performance at limiting nitrogen growth conditions

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| WNU25 | 78806.8 | — | — | — | 12.5 | 0.17 | 11 | 0.543 | 0.10 | 10 |
| CONT. | — | 0.721 | — | — | 11.3 | — | — | 0.492 | — | — |
| WNU75 | 76658.3 | — | — | — | 14.2 | 0.21 | 15 | — | — | — |
| WNU54 | 76643.5 | 0.891 | 0.21 | 14 | — | — | — | — | — | — |
| WNU54 | 76645.5 | 0.886 | 0.23 | 13 | 14.3 | 0.18 | 16 | — | — | — |
| WNU18 | 76565.5 | — | — | — | 14.6 | 0.12 | 19 | — | — | — |
| CONT. | — | 0.781 | — | — | 12.3 | — | — | — | — | — |
| WNU87 | 76667.3 | — | — | — | 12.5 | 0.05 | 18 | — | — | — |
| WNU73 | 76651.5 | — | — | — | 11.7 | 0.24 | 11 | — | — | — |
| WNU39 | 77171.5 | — | — | — | 11.6 | 0.22 | 11 | — | — | — |
| WNU2 | 77867.3 | — | — | — | 12.1 | 0.10 | 15 | — | — | — |
| WNU2 | 77869.1 | — | — | — | 11.5 | 0.29 | 9 | — | — | — |
| WNU2 | 77869.3 | — | — | — | 11.5 | 0.27 | 9 | — | — | — |
| CONT. | — | — | — | — | 10.5 | — | — | — | — | — |
| WNU99 | 77099.2 | 0.631 | 0.14 | 16 | — | — | — | — | — | — |
| WNU98 | 77463.13 | — | — | — | — | — | — | 0.383 | 0.05 | 12 |
| WNU98 | 77465.1 | — | — | — | 5.93 | 0.20 | 14 | — | — | — |
| WNU98 | 77465.3 | — | — | — | — | — | — | 0.376 | 0.10 | 11 |
| WNU97 | 77181.6 | — | — | — | 6.20 | 0.08 | 20 | — | — | — |
| WNU94 | 78110.7 | 0.635 | 0.12 | 17 | — | — | — | — | — | — |
| WNU83 | 75821.7 | — | — | — | 6.65 | 0.01 | 28 | 0.382 | 0.05 | 12 |
| WNU83 | 75821.8 | — | — | — | — | — | — | 0.365 | 0.24 | 7 |
| WNU83 | 75823.9 | — | — | — | — | — | — | 0.370 | 0.17 | 9 |
| WNU61 | 78014.1 | — | — | — | 5.95 | 0.19 | 15 | 0.383 | 0.04 | 13 |
| WNU61 | 78014.2 | 0.625 | 0.17 | 15 | 5.94 | 0.19 | 15 | — | — | — |
| WNU6 | 76542.5 | — | — | — | 5.85 | 0.24 | 13 | 0.373 | 0.13 | 9 |
| WNU51 | 79018.4 | — | — | — | 5.84 | 0.27 | 13 | 0.366 | 0.25 | 7 |
| WNU51 | 79020.6 | 0.623 | 0.17 | 14 | — | — | — | — | — | — |
| WNU5 | 76045.6 | 0.604 | 0.29 | 11 | — | — | — | — | — | — |
| WNU43 | 77267.2 | — | — | — | — | — | — | 0.369 | 0.18 | 8 |
| WNU42 | 76598.1 | — | — | — | 5.78 | 0.30 | 12 | — | — | — |
| WNU42 | 76599.4 | — | — | — | 6.31 | 0.06 | 22 | — | — | — |
| WNU41 | 79012.4 | — | — | — | 6.13 | 0.10 | 18 | 0.375 | 0.11 | 10 |
| WNU41 | 79013.1 | 0.617 | 0.21 | 13 | — | — | — | — | — | — |
| WNU35 | 75794.1 | 0.610 | 0 26 | 12 | — | — | — | — | — | — |
| WNU35 | 75794.3 | — | — | — | 6.82 | 0.01 | 32 | 0.397 | 0.03 | 17 |
| WNU34 | 76588.3 | — | — | — | 5.79 | 0.28 | 12 | — | — | — |
| WNU34 | 76588.6 | — | — | — | — | — | — | 0.370 | 0.19 | 9 |
| WNU31 | 75786.3 | — | — | — | 5.96 | 0.17 | 15 | 0.383 | 0.05 | 13 |
| WNU31 | 75786.7 | — | — | — | 5.91 | 0.20 | 14 | — | — | — |
| WNU31 | 75789.5 | 0.614 | 0.26 | 13 | 7.42 | 1. | 43 | 0.409 | L | 20 |
| WNU31 | 75790.8 | — | — | — | 6.03 | 0.15 | 16 | 0.391 | 0.02 | 15 |
| WNU17 | 76556.4 | — | — | — | 5.95 | 0.18 | 15 | — | — | — |
| WNU14 | 77113.11 | 0.643 | 0.10 | 18 | — | — | — | — | — | — |
| WNU11 | 76398.1 | — | — | — | 6.73 | 0.01 | 30 | 0.389 | 0.03 | 14 |
| WNU11 | 76400.2 | — | — | — | 5.84 | 025 | 13 | 0.381 | 0.07 | 12 |
| WNU105 | 77261.2 | — | — | — | 6.22 | 0.07 | 20 | 0.373 | 0.13 | 9 |
| WNU105 | 77262.1 | 0.631 | 0.16 | 16 | — | — | — | — | — | — |
| WNU102 | 76550.4 | — | — | — | — | — | — | 0.369 | 0.18 | 8 |
| CONT. | — | 0344 | — | — | 5.18 | — | — | 0.341 | — | — |
| WNU28 | 76826.1 | — | — | — | 10.4 | 0.04 | 17 | — | — | — |
| WNU28 | 76827.3 | — | — | — | 9.62 | 0.30 | 8 | — | — | — |
| WNU28 | 76827.4 | — | — | — | 10.1 | 0.12 | 13 | — | — | — |
| WNU28 | 76829.3 | — | — | — | 10.7 | 0.01 | 21 | 0.450 | 0.08 | 14 |
| WNU28 | 76829.5 | 0.785 | 0.13 | 15 | — | — | — | — | — | — |
| WNU21 | 75781.10 | — | — | — | 10.1 | 0.11 | 14 | 0.428 | 0.30 | 8 |
| WNU21 | 75781.11 | 0.781 | 0.13 | 14 | — | — | — | — | — | — |
| WNU21 | 75781.6 | — | — | — | 10.5 | 0.02 | 18 | — | — | — |
| WNU21 | 75781.8 | — | — | — | 11.0 | L | 24 | 0.441 | 0.12 | 11 |
| WNU21 | 75781.9 | — | — | — | — | — | — | 0.439 | 0.16 | 11 |
| WNU21 | 75783.1 | — | — | — | 9.96 | 0.15 | 12 | — | — | — |
| WNU21 | 75784.1 | — | — | — | 11.2 | L | 27 | 0.468 | 0.04 | 18 |
| WNU21 | 75784.4 | — | — | — | 10.2 | 0.07 | 15 | 0.427 | 0.30 | 8 |
| WNU21 | 75784.7 | — | — | — | 10.0 | 0.10 | 13 | — | — | — |
| WNU13 | 78921.3 | 0.764 | 0.27 | 12 | 10.5 | 0.03 | 18 | — | — | — |
| WNU13 | 78921.4 | — | — | — | 10.9 | L | 22 | 0.433 | 0.20 | 9 |
| WNU13 | 78923.6 | — | — | — | 11.2 | L | 26 | 0.441 | 0.13 | 11 |
| WNU13 | 78923.8 | — | — | — | — | — | — | 0.439 | 0.18 | 11 |
| WNU13 | 78924.2 | — | — | — | 9.75 | 0.23 | 10 | — | — | — |
| WNU13 | 78924.3 | — | — | — | 11.5 | L | 29 | 0.447 | 0.15 | 13 |

TABLE 98-continued

Genes showing improved rosette growth performance at limiting nitrogen growth conditions

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| WNU13 | 78925.3 | 0.762 | 0.23 | 12 | 10.5 | 0.03 | 18 | 0.428 | 0.26 | 8 |
| WNU13 | 78925.8 | 0.771 | 0.20 | 13 | 10.5 | 0.03 | 18 | — | — | — |
| CONT. | — | 0.683 | — | — | 8.88 | — | — | 0.396 | — | — |
| WNU60 | 78878.4 | 0.820 | 0.11 | 17 | — | — | — | — | — | — |
| WNU47 | 77178.2 | — | — | — | — | — | — | 0.514 | 0.25 | 8 |
| WNU47 | 77180.4 | 0.837 | 0.07 | 19 | — | — | — | — | — | — |
| WNU33 | 76581.3 | 0.821 | 0.11 | 17 | — | — | — | — | — | — |
| WNU33 | 76581.6 | 0.813 | 0.15 | 16 | — | — | — | — | — | — |
| WNU27 | 77747.4 | 0.801 | 0.22 | 14 | — | — | — | — | — | — |
| WNU27 | 77748.1 | 0.784 | 0.28 | 12 | 11.8 | 0.07 | 15 | 0.513 | 0.24 | 8 |
| WNU27 | 77748.2 | — | — | — | 11.6 | 0.10 | 14 | — | — | — |
| WNU27 | 77750.1 | — | — | — | 11.6 | 0.13 | 13 | — | — | — |
| WNU26 | 76673.10 | 0.789 | 0.25 | 12 | — | — | — | — | — | — |
| WNU26 | 76673.5 | 0.886 | 0.02 | 26 | — | — | — | — | — | — |
| WNU26 | 76674.1 | 0.813 | 0.14 | 16 | — | — | — | — | — | — |
| CONT. | — | 0.702 | — | — | 10.2 | — | — | 0.477 | — | — |
| WNU92 | 77124.5 | — | — | — | 10.6 | 0.30 | 12 | — | — | — |
| WNU72 | 77086.3 | — | — | — | 10.8 | 0.23 | 14 | — | — | — |
| WNU72 | 77088.1 | — | — | — | 11.4 | 0.08 | 20 | 0.461 | 0.26 | 10 |
| WNU57 | 76647.1 | 0.826 | 0.10 | 14 | 11.2 | 0.11 | 19 | 0.484 | 0.09 | 16 |
| WNU57 | 76649.5 | — | — | — | 10.6 | 0.28 | 12 | — | — | — |
| WNU57 | 76649.7 | — | — | — | 11.0 | 0.15 | 17 | 0.470 | 0.16 | 12 |
| CONT. | — | 0.725 | — | — | 9.47 | — | — | 0.419 | — | — |

Table 98. "CONT."—Control; "Ave."—Average; "% Incr." = % increment; "p-val."—p-value; L means that p-value is less than 0.01, p < 0.1 was considered as significant.

The genes listed in Tables 99-100 improved plant NUE when grown at standard nitrogen concentration levels. These genes produced larger plants with a larger photosynthetic area and increased biomass (fresh weight, dry weight, leaf number, rosette diameter, rosette area and plot coverage) when grown under standard nitrogen conditions as compared to control plants grown under identical growth conditions.

TABLE 99

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| WNU75 | 76657.1 | — | — | — | 2170.8 | 0.18 | 10 | 9.67 | L | 8 |
| WNU75 | 76657.5 | — | — | — | — | — | — | 9.29 | 0.21 | 3 |
| WNU75 | 76658.3 | 183.8 | 0.15 | 10 | 2154.2 | 0.25 | 9 | 9.38 | 0.07 | 4 |
| WNU75 | 76659.6 | 178.3 | 0.21 | 6 | 2129.2 | 0.04 | 7 | 9.46 | 0.01 | 5 |
| WNU54 | 76641.5 | 187.1 | 0.02 | 12 | 2216.7 | L | 12 | 9.29 | 0.28 | 3 |
| WNU54 | 76643.2 | 175.0 | 0.11 | 4 | — | — | — | — | — | — |
| WNU54 | 76644.1 | — | — | — | — | — | — | 9.33 | 0.25 | 4 |
| WNU54 | 76645.3 | — | — | — | 2175.0 | 0.14 | 10 | — | — | — |
| WNU54 | 76645.5 | — | — | — | — | — | — | 9.46 | L | 5 |
| WNU54 | 76645.7 | 173.3 | 0.23 | 3 | 2125.0 | 0.07 | 7 | — | — | — |
| WNU44 | 76636.1 | — | — | — | — | — | — | 9.46 | 0.01 | 5 |
| WNU44 | 76636.3 | — | — | — | — | — | — | 9.58 | L | 7 |
| WNU44 | 76639.1 | 183.3 | 0.01 | 9 | 2141.7 | 0.05 | 8 | 9.54 | 0.16 | 6 |
| WNU44 | 76639.2 | — | — | — | — | — | — | 9.46 | 0.01 | 5 |
| WNU44 | 76639.3 | 175.5 | 0.24 | 5 | 2110.5 | 0.25 | 7 | — | — | — |
| WNU44 | 76640.3 | — | — | — | — | — | — | 9.38 | 0.06 | 4 |
| WNU44 | 76640.9 | 176.7 | 0.24 | 5 | — | — | — | — | — | — |
| WNU29 | 76628.1 | 183.8 | 0.09 | 10 | 2191.7 | 0.15 | 11 | 9.75 | L | 9 |
| WNU29 | 76628.4 | 173.3 | 0.18 | 3 | 2084.5 | 0.26 | 5 | 9.25 | 0.23 | 3 |
| WNU29 | 76628.7 | — | — | — | 2162.5 | 0.21 | 9 | 9.33 | 0.06 | 4 |
| WNU29 | 76628.9 | — | — | — | — | — | — | 9.33 | 0.17 | 4 |
| WNU29 | 76629.1 | — | — | — | — | — | — | 9.62 | 0.07 | 7 |
| WNU29 | 76630.2 | — | — | — | — | — | — | 9.38 | 0.27 | 4 |
| WNU18 | 76562.2 | 176.2 | 0.23 | 5 | 2150.0 | 0.10 | 9 | — | — | — |
| WNU18 | 76563.3 | 177.5 | 0.10 | 6 | 2083.3 | 0.12 | 5 | 9.54 | 0.22 | 6 |
| WNU18 | 76564.2 | 191.8 | L | 14 | 2286.3 | L | 15 | 9.17 | 0.24 | 2 |

TABLE 99-continued

Genes showing improved plant biomass production at standard nitrogen growth conditions

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| WNU18 | 76565.5 | 194.2 | L | 16 | 2345.8 | 0.02 | 18 | 9.50 | 0.20 | 6 |
| WNU104 | 76617.1 | 181.0 | 0.25 | 8 | 2211.9 | 0.04 | 12 | 9.54 | 0.11 | 6 |
| WNU104 | 76618.3 | 184.6 | 0.13 | 10 | 2212.5 | L | 12 | 9.17 | 0.29 | 2 |
| WNU104 | 76619.3 | — | — | — | — | — | — | 9.58 | L | 7 |
| WNU104 | 76619.6 | — | — | — | — | — | — | 9.33 | 0.14 | 4 |
| WNU104 | 76620.2 | — | — | — | — | — | — | 9.62 | 0.02 | 7 |
| WNU104 | 76620.4 | — | — | — | — | — | — | 9.40 | 0.05 | 5 |
| WNU104 | 76620.5 | — | — | — | — | — | — | 9.33 | 0.14 | 4 |
| WNU104 | 76620.7 | — | — | — | — | — | — | 9.46 | 0.16 | 5 |
| CONT. | — | 167.7 | — | — | 1980.9 | — | — | 8.98 | — | — |
| WNU28 | 76830.1 | — | — | — | — | — | — | 10.5 | 0.30 | 2 |
| WNU21 | 75784.6 | — | — | — | — | — | — | 10.9 | 0.05 | 6 |
| CONT. | — | — | — | — | — | — | — | 10.2 | — | — |
| WNU92 | 77124.5 | — | — | — | 1525.6 | 0.14 | 9 | 10.1 | 0.26 | 3 |
| WNU92 | 77124.7 | 129.9 | 0.23 | 9 | — | — | — | — | — | — |
| WNU92 | 77125.3 | — | — | — | 1505.9 | 0.30 | 8 | — | — | — |
| WNU72 | 77086.3 | 131.2 | 0.13 | 11 | 1558.3 | 0.02 | 11 | 10.2 | 0.08 | 4 |
| WNU72 | 77088.2 | 130.3 | 0.25 | 10 | 1581.0 | 0.19 | 13 | — | — | — |
| WNU72 | 77090.1 | 136.4 | 0.27 | 15 | 1478.6 | 0.14 | 6 | — | — | — |
| WNU57 | 76647.1 | 137.1 | 0.27 | 15 | — | — | — | — | — | — |
| WNU57 | 76650.2 | 132.4 | 0.08 | 12 | 1531.5 | 0.10 | 10 | — | — | — |
| WNU3 | 76633.13 | — | — | — | — | — | — | 10.0 | 0.28 | 2 |
| WNU15 | 76551.5 | 128.4 | 0.27 | 8 | — | — | — | — | — | — |
| WNU15 | 76552.7 | 128.5 | 0.11 | 8 | 1493.1 | 0.09 | 7 | — | — | — |
| CONT. | — | 118.7 | — | — | 1398.2 | — | — | 9.83 | — | — |
| WNU78 | 76662.2 | — | — | — | — | — | — | 11.5 | 0.02 | 8 |
| WNU78 | 76665.6 | 316.3 | 0.03 | 20 | 3141.7 | L | 24 | — | — | — |
| WNU74 | 77578.1 | — | — | — | 2687.5 | 0.12 | 6 | — | — | — |
| WNU32 | 76576.4 | — | — | — | — | — | — | 12.1 | L | 13 |
| WNU32 | 76576.5 | — | — | — | 2883.3 | 0.14 | 14 | — | — | — |
| WNU32 | 76578.1 | — | — | — | 2662.5 | 0.15 | 5 | — | — | — |
| WNU32 | 76578.3 | 290.0 | 0.30 | 10 | 2904.2 | 0.07 | 14 | — | — | — |
| WNU32 | 76580.2 | 285.0 | 0.01 | 8 | 2879.2 | L | 13 | — | — | — |
| WNU32 | 76580.6 | 279.2 | 0.11 | 6 | 2966.7 | 0.03 | 17 | — | — | — |
| WNU25 | 78808.4 | 277.6 | 0.13 | 5 | 2872.0 | 0.02 | 13 | — | — | — |
| CONT. | — | 263.3 | — | — | 2539.2 | — | — | 10.7 | — | — |
| WNU87 | 76667.3 | — | — | — | — | — | — | 10.2 | 0.25 | 7 |
| WNU73 | 76651.7 | — | — | — | — | — | — | 9.88 | 0.03 | 4 |
| WNU58 | 76761.5 | — | — | — | — | — | — | 9.92 | 0.22 | 4 |
| WNU58 | 76764.2 | 164.6 | 0.24 | 11 | — | — | — | — | — | — |
| CONT. | — | 148.7 | — | — | 1832.8 | — | — | 9.54 | — | — |
| WNU66 | 77753.1 | 317.4 | 0.07 | 13 | 3801.2 | 0.09 | 18 | — | — | — |
| WNU66 | 77753.4 | — | — | — | 3720.2 | 0.25 | 16 | — | — | — |
| WNU66 | 77754.4 | — | — | — | — | — | — | 10.6 | 0.04 | 7 |
| WNU60 | 78877.12 | — | — | — | — | — | — | 10.2 | 0.29 | 2 |
| WNU60 | 78877.6 | 314.2 | 0.11 | 12 | 3532.1 | 0.04 | 10 | — | — | — |
| WNU60 | 78877.9 | — | — | — | 3525.6 | 0.22 | 10 | — | — | — |
| WNU60 | 78878.10 | — | — | — | — | — | — | 10.7 | 0.20 | 7 |
| WNU60 | 78878.12 | — | — | — | 3739.9 | 0.15 | 16 | — | — | — |
| WNU47 | 77178.9 | — | — | — | — | — | — | 10.1 | 0.28 | 2 |
| WNU47 | 77180.5 | — | — | — | 3380.2 | 0.26 | 5 | — | — | — |
| WNU33 | 76581.3 | — | — | — | — | — | — | 10.4 | 0.24 | 4 |
| WNU33 | 76581.5 | 303.8 | 0.27 | 8 | — | — | — | 10.4 | 0.06 | 4 |
| WNU33 | 76581.6 | — | — | — | — | — | — | 10.4 | 0.08 | 4 |
| WNU33 | 76582.1 | 295.0 | 0.22 | 5 | 3525.0 | 0.04 | 10 | — | — | — |
| WNU33 | 76584.1 | — | — | — | — | — | — | 10.9 | 0.01 | 9 |
| WNU33 | 76584.2 | — | — | — | 3399.4 | 0.27 | 6 | — | — | — |
| WNU33 | 76584.3 | 326.6 | 0.14 | 17 | — | — | — | 10.2 | 0.17 | 3 |
| WNU27 | 77747.5 | — | — | — | — | — | — | 10.8 | 0.02 | 8 |
| WNU27 | 77748.1 | — | — | — | — | — | — | 10.7 | 0.28 | 7 |
| WNU27 | 77750.1 | — | — | — | — | — | — | 10.9 | 0.15 | 10 |
| WNU26 | 76672.1 | — | — | — | 3398.2 | 0.25 | 6 | — | — | — |
| WNU26 | 76673.2 | 297.4 | 0.12 | 6 | 3845.8 | 0.10 | 20 | — | — | — |
| WNU26 | 76673.4 | 343.6 | 0.03 | 23 | 3569.6 | 0.02 | 11 | — | — | — |
| WNU26 | 76673.9 | — | — | — | 3573.8 | 0.20 | 11 | — | — | — |
| CONT. | — | 280.3 | — | — | 3213.9 | — | — | 9.96 | — | — |

Table 99. "CONT."—Control; "Ave."—Average; "% Incr."= % increment; "p-val."—p-value; L means that p-value is less than 0.01, p < 0.1 was considered as significant.

TABLE 100

Genes showing improved plant biomass production at standard nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| WNU75 | 76657.1 | 41.8 | 0.05 | 31 | 5.22 | 0.06 | 30 | 3.99 | 0.12 | 14 |
| WNU75 | 76658.3 | 43.6 | 0.04 | 37 | 5.46 | 0.04 | 36 | 4.09 | 0.03 | 17 |
| WNU75 | 76659.6 | 41.6 | L | 31 | 5.19 | L | 30 | 4.10 | L | 17 |
| WNU54 | 76641.5 | 39.1 | 0.01 | 23 | 4.89 | 0.02 | 22 | 3.96 | L | 13 |
| WNU54 | 76643.2 | 39.8 | L | 25 | 4.97 | L | 24 | 3.99 | L | 14 |
| WNU54 | 76644.1 | 34.9 | 0.27 | 10 | — | — | — | — | — | — |
| WNU54 | 76644.4 | 42.1 | L | 32 | 5.26 | L | 31 | 4.08 | L | 16 |
| WNU54 | 76645.3 | 37.8 | L | 19 | 4.72 | L | 18 | 3.80 | 0.02 | 9 |
| WNU54 | 76645.7 | 36.1 | 0.21 | 14 | 4.52 | 0.24 | 13 | — | — | — |
| WNU44 | 76636.1 | 40.9 | 0.10 | 29 | 5.11 | 0.11 | 28 | 4.08 | 0.11 | 16 |
| WNU44 | 76636.3 | 38.7 | L | 22 | 4.84 | 0.01 | 21 | 3.96 | 0.05 | 13 |
| WNU44 | 76639.1 | 42.8 | L | 35 | 5.35 | L | 33 | 4.01 | L | 14 |
| WNU44 | 76639.2 | — | — | — | — | — | — | 3.68 | 0.22 | 5 |
| WNU44 | 76639.4 | 36.7 | 0.16 | 16 | 4.59 | 0.18 | 15 | 3.78 | 0.08 | 8 |
| WNU44 | 76640.9 | 36.0 | 0.25 | 13 | 4.50 | 0.27 | 12 | — | — | — |
| WNU29 | 76628.1 | 40.7 | L | 28 | 5.08 | L | 27 | 4.09 | L | 17 |
| WNU29 | 76628.4 | 34.1 | 0.30 | 7 | — | — | — | — | — | — |
| WNU29 | 76628.7 | 36.7 | 0.22 | 16 | 4.59 | 0.24 | 15 | — | — | — |
| WNU29 | 76628.9 | 39.0 | 0.01 | 23 | 4.87 | 0.01 | 22 | 3.97 | 0.09 | 13 |
| WNU29 | 76629.3 | 41.2 | L | 30 | 5.15 | 0.01 | 29 | 4.05 | 0.03 | 16 |
| WNU18 | 76561.2 | 36.1 | 0.05 | 14 | 4.51 | 0.07 | 13 | — | — | — |
| WNU18 | 76562.2 | 40.0 | L | 26 | 5.00 | L | 25 | 4.14 | L | 18 |
| WNU18 | 76564.2 | 40.3 | 0.02 | 27 | 5.04 | 0.02 | 26 | 4.01 | 0.12 | 14 |
| WNU18 | 76565.5 | 45.8 | L | 44 | 5.73 | L | 43 | 4.29 | L | 22 |
| WNU104 | 76617.1 | 41.4 | L | 30 | 5.18 | L | 29 | 4.05 | 0.02 | 16 |
| WNU104 | 76618.3 | 39.3 | L | 24 | 4.91 | L | 23 | 3.92 | 0.01 | 12 |
| WNU104 | 76619.6 | 33.9 | 0.29 | 7 | — | — | — | — | — | — |
| WNU104 | 76620.2 | 35.1 | 0.24 | 10 | 4.39 | 0.28 | 9 | — | — | — |
| WNU104 | 76620.4 | — | — | — | 4.25 | 0.28 | 6 | — | — | — |
| CONT. | — | 31.8 | — | — | 4.01 | — | — | 3.50 | — | — |
| WNU28 | 76826.1 | 67.4 | 0.15 | 13 | 8.42 | 0.15 | 13 | 4.90 | 0.18 | 7 |
| WNU21 | 75781.10 | 69.4 | 0.27 | 16 | 8.67 | 0.27 | 16 | — | — | — |
| WNU21 | 75781.8 | 67.6 | 0.03 | 13 | 8.45 | 0.03 | 13 | 4.86 | 0.09 | 6 |
| WNU21 | 75784.1 | 70.6 | 0.06 | 18 | 8.82 | 0.06 | 18 | 4.94 | 0.05 | 7 |
| WNU21 | 75784.4 | 68.1 | 0.30 | 14 | 8.52 | 0.30 | 14 | — | — | — |
| WNU13 | 78921.4 | 69.1 | 0.03 | 16 | 8.64 | 0.03 | 16 | 4.96 | 0.11 | 8 |
| WNU13 | 78923.6 | 69.0 | 0.29 | 16 | 8.63 | 0.29 | 16 | 5.01 | 0.18 | 9 |
| WNU13 | 78924.3 | 70.6 | 0.06 | 18 | 8.82 | 0.06 | 18 | 4.90 | 0.26 | 6 |
| WNU13 | 78925.3 | 68.7 | 0.07 | 15 | 8.58 | 0.07 | 15 | 4.92 | L | 7 |
| CONT. | — | 59.6 | — | — | 7.45 | — | — | 4.60 | — | — |
| WNU92 | 77124.5 | 78.2 | 0.25 | 23 | — | — | — | — | — | — |
| WNU72 | 77086.3 | 74.2 | L | 16 | 9.27 | 0.03 | 10 | 4.98 | 0.01 | 7 |
| WNU72 | 77088.2 | 78.2 | 0.12 | 23 | 9.78 | 0.21 | 16 | — | — | — |
| WNU72 | 77090.1 | 69.0 | 0.29 | 8 | — | — | — | — | — | — |
| WNU57 | 76647.1 | 77.2 | 0.12 | 21 | 9.65 | 0.22 | 14 | — | — | — |
| WNU57 | 76650.2 | 75.8 | 0.02 | 19 | 9.47 | 0.08 | 12 | — | — | — |
| WNU52 | 76605.3 | 72.0 | 0.30 | 13 | — | — | — | — | — | — |
| CONT. | — | 63.8 | — | — | 8.44 | — | — | 4.67 | — | — |
| WNU78 | 76661.4 | 86.1 | 0.05 | 19 | 10.8 | 0.05 | 19 | 5.64 | 0.02 | 8 |
| WNU78 | 76662.2 | 89.1 | 0.17 | 24 | 11.1 | 0.17 | 24 | 5.74 | 0.21 | 10 |
| WNU78 | 76665.6 | 84.5 | 0.07 | 17 | 10.6 | 0.07 | 17 | 5.68 | 0.09 | 8 |
| WNU71 | 77656.1 | 82.3 | 0.03 | 14 | 10.3 | 0.03 | 14 | 5.63 | 0.04 | 7 |
| WNU67 | 79472.2 | 82.7 | 0.11 | 15 | 10.3 | 0.11 | 15 | 5.62 | 0.10 | 7 |
| WNU67 | 79473.4 | — | — | — | 10.6 | 0.20 | 17 | 5.76 | 0.04 | 10 |
| WNU32 | 76576.4 | 97.3 | 0.05 | 35 | 12.2 | 0.05 | 35 | 5.89 | 0.01 | 12 |
| WNU32 | 76578.1 | 93.3 | 0.13 | 29 | 11.7 | 0.13 | 29 | 5.96 | 0.07 | 14 |
| WNU32 | 76578.3 | — | — | — | — | — | — | 5.65 | 0.28 | 8 |
| WNU32 | 76580.6 | 88.5 | L | 23 | 11.1 | L | 23 | 5.81 | L | 11 |
| CONT. | — | 72.0 | — | — | 9.00 | — | — | 5.24 | — | — |
| WNU87 | 76667.3 | 62.3 | 0.15 | 13 | 7.79 | 0.20 | 11 | — | — | — |
| WNU73 | 76651.7 | 64.3 | L | 17 | 8.03 | L | 14 | 4.92 | L | 9 |
| WNU73 | 76653.1 | 59.9 | 0.27 | 9 | — | — | — | — | — | — |
| CONT. | — | 54.9 | — | — | 7.02 | — | — | 4.52 | — | — |
| WNU33 | 76581.3 | 67.9 | 0.17 | 6 | 8.49 | 0.17 | 6 | — | — | — |
| WNU33 | 76584.2 | 69.5 | 0.04 | 9 | 8.69 | 0.04 | 9 | 5.18 | 0.20 | 3 |
| WNU33 | 76584.3 | 69.0 | 0.12 | 8 | 8.62 | 0.12 | 8 | 5.17 | 0.20 | 3 |
| WNU27 | 77747.5 | 71.8 | 0.22 | 12 | 8.97 | 0.22 | 12 | 5.30 | 0.29 | 5 |
| WNU27 | 77748.1 | 75.4 | 0.15 | 18 | 9.43 | 0.15 | 18 | 5.40 | L | 7 |
| WNU27 | 77748.2 | 77.9 | 0.03 | 22 | 9.73 | 0.03 | 22 | 5.55 | L | 10 |
| WNU27 | 77750.1 | 76.9 | 0.01 | 20 | 9.61 | 0.01 | 20 | 5.48 | 0.01 | 9 |

TABLE 100-continued

Genes showing improved plant biomass production at standard nitrogen growth conditions

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| WNU26 | 76673.5 | — | — | — | — | — | — | 5.31 | 0.17 | 6 |
| CONT. | — | 63.9 | — | — | 7.98 | — | — | 5.03 | — | — |

Table 100: "CONT."—Control; "Ave."—Average; "% Incr." = % increment; "p-val."—p-value; L means that p-value is less than 0.01, p < 0.1 was considered as significant.

The genes listed in Table 101 improved plant NUE when grown at standard nitrogen concentration levels. These genes produced faster developing plants when grown under normal (standard) nitrogen growth conditions, compared to control plants, grown under identical growth conditions, as measured by growth rate of leaf number, rosette diameter and plot coverage.

TABLE 101

Genes showing improved rosette growth performance at standard nitrogen growth conditions

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| WNU75 | 76657.1 | — | — | — | 13.9 | 0.07 | 23 | — | — | — |
| WNU75 | 76658.3 | — | — | — | 14.7 | 0.02 | 30 | — | — | — |
| WNU75 | 76659.6 | 0.836 | 0.26 | 14 | 14.5 | 0.03 | 28 | 0.566 | 0.21 | 12 |
| WNU54 | 76641.5 | — | — | — | 13.5 | 0.13 | 19 | 0.558 | 0.29 | 10 |
| WNU54 | 76643.2 | — | — | — | 13.3 | 0.17 | 17 | — | — | — |
| WNU54 | 76644.1 | 0.838 | 0.24 | 14 | — | — | — | — | — | — |
| WNU54 | 76644.4 | 0.841 | 0.23 | 15 | 13.6 | 0.11 | 20 | — | — | — |
| WNU54 | 76645.3 | — | — | — | 12.9 | 0.27 | 14 | — | — | — |
| WNU44 | 76636.1 | — | — | — | 13.4 | 0.14 | 19 | — | — | — |
| WNU44 | 76636.3 | — | — | — | 13.4 | 0.14 | 18 | 0.558 | 0.28 | 10 |
| WNU44 | 76639.1 | — | — | — | 14.3 | 0.04 | 26 | — | — | — |
| WNU44 | 76640.9 | — | — | — | 13.1 | 0.23 | 15 | — | — | — |
| WNU29 | 76628.1 | — | — | — | 13.4 | 0.15 | 18 | 0.568 | 0.20 | 12 |
| WNU29 | 76628.9 | 0.837 | 0.24 | 14 | 13.0 | 0.23 | 15 | — | — | — |
| WNU29 | 76629.3 | — | — | — | 13.7 | 0.09 | 21 | — | — | — |
| WNU18 | 76562.2 | — | — | — | 15.1 | 0.01 | 33 | 0.579 | 0.13 | 14 |
| WNU18 | 76564.2 | — | — | — | 13.9 | 0.08 | 22 | — | — | — |
| WNU18 | 76565.5 | — | — | — | 14.3 | 0.04 | 26 | 0.565 | 0.24 | 11 |
| WNU104 | 76617.1 | — | — | — | 13.5 | 0.13 | 19 | — | — | — |
| WNU104 | 76618.3 | — | — | — | 13.7 | 0.10 | 21 | — | — | — |
| WNU104 | 76619.3 | 0.863 | 0.15 | 18 | — | — | — | — | — | — |
| CONT. | — | 0.732 | — | — | 11.3 | — | — | 0.507 | — | — |
| WNU45 | 79666.1 | 0.782 | 0.10 | 19 | — | — | — | — | — | — |
| WNU45 | 79667.7 | 0.737 | 0.27 | 12 | — | — | — | — | — | — |
| WNU28 | 76826.1 | — | — | — | 11.8 | 0.14 | 15 | 0.522 | 0.04 | 18 |
| WNU21 | 75781.10 | — | — | — | 12.2 | 0.08 | 19 | 0.519 | 0.07 | 17 |
| WNU21 | 75781.8 | — | — | — | 11.8 | 0.14 | 15 | — | — | — |
| WNU21 | 75781.9 | — | — | — | 11.6 | 0.22 | 13 | — | — | — |
| WNU21 | 75784.1 | — | — | — | 12.0 | 0.10 | 17 | — | — | — |
| WNU21 | 75784.4 | — | — | — | 11.7 | 0.18 | 14 | — | — | — |
| WNU21 | 75784.6 | — | — | — | 11.4 | 0.29 | 11 | — | — | — |
| WNU13 | 78921.4 | — | — | — | 12.3 | 0.05 | 20 | 0.524 | 0.04 | 18 |
| WNU13 | 78923.6 | — | — | — | 12.1 | 0.11 | 18 | — | — | — |
| WNU13 | 78924.3 | — | — | — | 11.7 | 0.17 | 14 | — | — | — |
| WNU13 | 78925.3 | 0.769 | 0.15 | 17 | 12.2 | 0.06 | 19 | 0.511 | 0.07 | 15 |
| CONT. | — | 0.656 | — | — | 10.3 | — | — | 0.444 | — | — |
| WNU92 | 77124.5 | — | — | — | 12.2 | 0.08 | 19 | 0.511 | 0.25 | 9 |
| WNU72 | 77086.3 | — | — | — | 11.5 | 0.26 | 11 | — | — | — |
| WNU72 | 77088.2 | — | — | — | 12.2 | 0.07 | 19 | 0.520 | 0.15 | 11 |
| WNU57 | 76647.1 | — | — | — | 12.2 | 0.08 | 18 | — | — | — |
| WNU57 | 76650.2 | 0.846 | 0.12 | 12 | 11.8 | 0.15 | 14 | — | — | — |

TABLE 101-continued

Genes showing improved rosette growth performance at standard nitrogen growth conditions

| Gene Name | Event # | RGR Of Leaf Number | | | RGR Of Plot Coverage [cm²/day] | | | RGR Of Rosette Diameter [cm/day] | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 0.752 | — | — | 10.3 | — | — | 0.470 | — | — |
| WNU78 | 76661.4 | — | — | — | 14.4 | 0.18 | 13 | — | — | — |
| WNU78 | 76662.2 | — | — | — | 14.8 | 0.11 | 16 | — | — | — |
| WNU78 | 76665.6 | — | — | — | 15.1 | 0.06 | 19 | 0.607 | 0.28 | 9 |
| WNU74 | 77576.2 | 0.812 | 0.26 | 14 | — | — | — | — | — | — |
| WNU74 | 77578.4 | — | — | — | 15.4 | 0.05 | 21 | 0.609 | 0.30 | 9 |
| WNU71 | 77656.1 | — | — | — | 14.2 | 0.22 | 12 | — | — | — |
| WNU67 | 79413.2 | — | — | — | 14.2 | 0.27 | 11 | 0.640 | 0.09 | 15 |
| WNU67 | 79413.5 | — | — | — | 14.2 | 0.29 | 11 | — | — | — |
| WNU67 | 79472.2 | — | — | — | 14.7 | 0.12 | 15 | 0.609 | 0.25 | 9 |
| WNU67 | 79473.4 | — | — | — | 14.2 | 0.27 | 11 | 0.611 | 0.24 | 9 |
| WNU32 | 76576.4 | — | — | — | 16.2 | L | 27 | — | — | — |
| WNU32 | 76578.1 | — | — | — | 16.2 | L | 27 | 0.629 | 0.13 | 13 |
| WNU32 | 76578.3 | — | — | — | 14.5 | 0.18 | 14 | — | — | — |
| WNU32 | 76580.6 | — | — | — | 15.7 | 0.02 | 23 | 0.611 | 0.24 | 9 |
| CONT. | — | 0.714 | — | — | 12.8 | — | — | 0.559 | — | — |
| WNU87 | 76667.1 | 0.787 | 0.08 | 21 | — | — | — | — | — | — |
| WNU87 | 76667.3 | — | — | — | 11.6 | 0.05 | 14 | — | — | — |
| WNU87 | 76670.4 | 0.789 | 0.07 | 21 | — | — | — | — | — | — |
| WNU73 | 76651.7 | 0.822 | 0.03 | 26 | 12.1 | L | 19 | 0.506 | 0.08 | 11 |
| WNU73 | 76653.1 | — | — | — | 11.1 | 0.21 | 9 | — | — | — |
| WNU58 | 76761.1 | 0.795 | 0.05 | 22 | — | — | — | — | — | — |
| WNU58 | 76761.5 | 0.760 | 0.16 | 16 | — | — | — | — | — | — |
| WNU58 | 76764.3 | 0.743 | 0.25 | 14 | — | — | — | — | — | — |
| WNU58 | 76765.4 | 0.764 | 0.15 | 17 | 11.1 | 0.20 | 10 | — | — | — |
| WNU39 | 77171.2 | 0.757 | 0.21 | 16 | 11.4 | 0.11 | 12 | — | — | — |
| WNU39 | 77171.4 | 0.748 | 0.21 | 15 | — | — | — | 0.491 | 0.22 | 8 |
| WNU39 | 77173.2 | 0.757 | 0.18 | 16 | — | — | — | — | — | — |
| WNU2 | 77867.5 | 0.730 | 0.30 | 12 | — | — | — | — | — | — |
| WNU2 | 77868.4 | 0.734 | 0.26 | 12 | — | — | — | — | — | — |
| WNU2 | 77869.3 | 0.764 | 0.18 | 17 | — | — | — | — | — | — |
| CONT. | — | 0.653 | — | — | 10.2 | — | — | 0.454 | — | — |
| WNU66 | 77754.3 | 0.917 | 0.22 | 14 | — | — | — | — | — | — |
| WNU66 | 77754.4 | 0.925 | 0.19 | 15 | — | — | — | — | — | — |
| WNU60 | 78878.10 | 1.00 | 0.04 | 25 | — | — | — | — | — | — |
| WNU33 | 76584.1 | 0.924 | 0.19 | 15 | — | — | — | — | — | — |
| WNU33 | 76584.2 | — | — | — | 13.1 | 0.27 | 9 | — | — | — |
| WNU27 | 77747.5 | — | — | — | 13.1 | 0.26 | 9 | — | — | — |
| WNU27 | 77748.1 | — | — | — | 13.8 | 0.06 | 15 | 0.580 | 0.21 | 8 |
| WNU27 | 77748.2 | — | — | — | 14.2 | 0.03 | 18 | 0.590 | 0.13 | 10 |
| WNU27 | 77750.1 | — | — | — | 14.0 | 0.04 | 17 | 0.573 | 0.29 | 7 |
| WNU26 | 76675.3 | 0.911 | 0.23 | 13 | — | — | — | — | — | — |
| WNU26 | 76675.4 | 0.909 | 0.27 | 13 | — | — | — | — | — | — |
| CONT. | — | 0.803 | — | — | 12.0 | — | — | 0.534 | — | — |

Table 101. "CONT."—Control; "Ave."—Average; "% Incr." = % increment; "p-val."—p-value; L means that p-value is less than 0.01, p < 0.1 was considered as significant.

Example 21

Evaluation of Transgenic *Brachypodium* Nue and Yield Under Low or Normal Nitrogen Fertilization in Greenhouse Assay Assay 1: Nitrogen Use Efficiency Measured Plant Biomass and Yield at Limited and Optimal Nitrogen Concentration Under Greenhouse Conditions Until Heading—

This assay follows the plant biomass formation and growth (measured by height) of plants which are grown in the greenhouse at limiting and non-limiting (e.g., normal) nitrogen growth conditions. Transgenic *Brachypodium* seeds were sown in peat plugs. The $T_1$ transgenic seedlings were then transplanted to 27.8×11.8×8.5 cm trays filled with peat and perlite in a 1:1 ratio. The trays were irrigated with a solution containing nitrogen limiting conditions, which were achieved by irrigating the plants with a solution containing 3 mM inorganic nitrogen in the form of $NH_4NO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $NH_4NO_3$ with 1 mM $KH_2PO_4$, 1 mM $MgSO_4$, 2 mM $CaCl_2$, 3.6 mM KCl and microelements. All plants were grown in the greenhouse until heading. Plant biomass (the above ground tissue) was weighted right after harvesting the shoots (plant fresh weight [FW]). Following, plants were dried in an oven at 70° C. for 48 hours and weighed (plant dry weight [DW]).

Figure 9B:
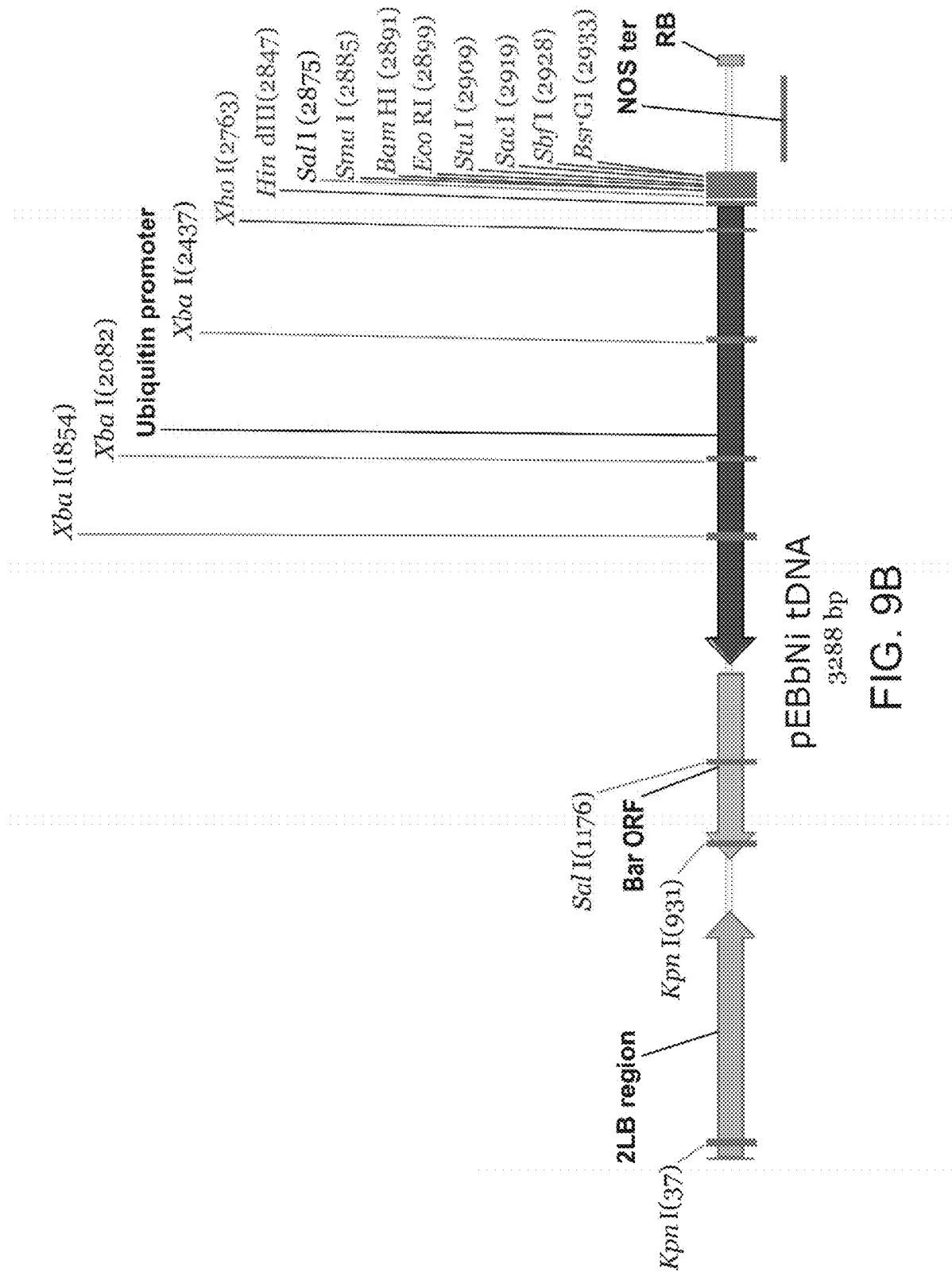

Each construct was validated at its $T_1$ generation. Transgenic plants transformed with a construct conformed by an empty vector carrying the BASTA selectable marker were used as control (FIG. 9B).

The plants were analyzed for their overall size, fresh weight and dry matter. Transgenic plants performance was compared to control plants grown in parallel under the same conditions. Mock-transgenic plants with no gene and no promoter at all, were used as control (FIG. 9B).

The experiment was planned in blocks and nested randomized plot distribution within them. For each gene of the invention five independent transformation events were analyzed from each construct.

Phenotyping

Plant Fresh and Dry shoot weight—In Heading assays when heading stage has completed (about day 30 from sowing), the plants were harvested and directly weighed for the determination of the plant fresh weight on semi-analytical scales (0.01 gr) (FW) and left to dry at 70° C. in a drying chamber for about 48 hours before weighting to determine plant dry weight (DW).

Time to Heading—In both Seed Maturation and Heading assays heading was defined as the full appearance of the first spikelet in the plant. The time to heading occurrence is defined by the date the heading is completely visible. The time to heading occurrence date was documented for all plants and then the time from planting to heading was calculated.

Leaf thickness—In Heading assays when minimum 5 plants per plot in at least 90% of the plots in an experiment have been documented at heading, measurement of leaf thickness was performed using a micro-meter on the second leaf below the flag leaf.

Plant Height—In both Seed Maturation and Heading assays once heading was completely visible, the height of the first spikelet was measured from soil level to the bottom of the spikelet.

Tillers number—In Heading assays manual count of tillers was preformed per plant after harvest, before weighing.

The genes listed in Table 102-105 improved plant biomass, growth rate and NUE when grown at low nitrogen concentration levels (nitrogen-limiting growth conditions; Tables 102-103) and at standard (normal) nitrogen growth conditions (Tables 104-105). These genes produced faster developing plants as compared to control plants which are grown under identical growth conditions, as measured by the increase in biomass (e.g., dry and fresh weight, leaf thickness) and in number of tillers.

TABLE 102

Genes showing improved plant performance at low Nitrogen growth conditions under regulation of At6669 promoter

| Gene Name | Event # | Dry Weight [mg] | | | Fresh Weight [mg] | | | Leaf Thickness | | |
|---|---|---|---|---|---|---|---|---|---|---|
| | | Ave. | P-Val. | % Incr. | Ave | P-Val. | % Incr. | Ave. | P-Val. | % Incr. |
| CONT. | — | 0.233 | — | — | 0.88 | — | — | 0.2056 | — | — |
| WNU78 | 1073 | 0.258 | 0.30 | 10.90 | — | — | — | — | — | — |
| WNU44 | 1175 | 0.306 | 0.05 | 31.54 | 1.19 | 0.02 | 34.58 | 0.2254 | 0.0181 | 9.6251 |
| WNU78 | 1184 | 0.287 | 0.09 | 23.48 | 1.13 | 0.05 | 28.48 | 0.2175 | 0.2384 | 5.7751 |
| W NU78 | 1185 | 0.271 | 0.18 | 16.67 | — | — | — | 0.2258 | 0.0073 | 9.8278 |
| WNU78 | 1186 | 0.264 | 0.21 | 13.44 | — | — | — | — | — | — |
| WNU44 | 1194 | 0.278 | 0.11 | 19.68 | — | — | — | — | — | — |
| WNU87 | 1200 | 0.279 | 0.09 | 20.07 | 1.01 | 0.16 | 14.82 | — | — | — |
| WNU87 | 1204 | 0.265 | 0.22 | 13.80 | — | — | — | 0.2197 | 0.0600 | 6.8288 |
| WNU92 | 1240 | 0.32 | 0.01 | 35.81 | 1.13 | 0.01 | 28.01 | 0.2251 | 0.0176 | 9.4630 |

Table 102. "CONT."—Control; "Ave."—Average; "% Incr." = % increment; "p-val."—p-value, L—p < 0.01.

TABLE 103

Genes showing improved plant performance at low Nitrogen growth conditions under regulation of At6669 promoter

| Gene Name | Event # | Tiller Number | | | Time to Heading [day] | | |
|---|---|---|---|---|---|---|---|
| | | Ave. | P-Val. | % Incr. | Ave. | P-Val. | % Incr. |
| CONT. | — | 3.92 | — | — | 28.84 | — | — |
| WNU78 | 1073 | — | — | — | 27.54 | 0.24 | −4.49 |
| WNU44 | 1175 | 4.67 | 0.15 | 19.15 | — | — | — |
| WNU78 | 1184 | — | — | — | 27.00 | 0.19 | −6.37 |
| WNU78 | 1186 | — | — | — | 27.25 | 0.18 | −5.50 |
| WNU44 | 1194 | — | — | — | 21.37 | 0.00 | −25.91 |
| WNU87 | 1200 | — | — | — | 26.46 | 0.04 | −8.25 |
| WNU87 | 1204 | — | — | — | 26.18 | 0.07 | −9.20 |
| WNU87 | 1206 | 4.55 | 0.25 | 16.17 | 26.90 | 0.09 | −6.72 |
| WNU92 | 1240 | — | — | — | 27.14 | 0.16 | −5.88 |

Table 103. "CONT."—Control; "Ave."—Average; "% Incr." = % increment; "p-val."—p-value, L—p < 0.01.

It should be noted that a negative increment (in percentages) when found in time to heading indicates potential for drought avoidance.

TABLE 104

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. | Leaf Thickness Ave. | P-Val. | % Incr. |
|---|---|---|---|---|---|---|---|---|---|---|
| CONT | — | 0.448 | — | — | 2.19 | — | — | 0.2223 | — | — |
| WNU78 | 1074 | 0.533 | 0.08 | 18.99 | — | — | — | — | — | — |
| WNU44 | 1175 | 0.520 | 0.19 | 16.20 | — | — | — | 0.2375 | 0.0844 | 6.841612 |
| WNU78 | 1184 | 0.576 | 0.04 | 28.77 | 2.68 | 0.04 | 22.48 | — | — | — |
| WNU78 | 1185 | 0.593 | 0.03 | 32.40 | 2.62 | 0.14 | 19.62 | 0.2354 | 0.1512 | 5.9044 |
| WNU78 | 1186 | 0.497 | 0.26 | 11.08 | — | — | — | — | — | — |
| WNU44 | 1194 | 0.546 | 0.04 | 22.07 | — | — | — | — | — | — |
| WNU87 | 1200 | 0.548 | 0.06 | 22.44 | 2.45 | 0.22 | 12.15 | — | — | — |
| WNU87 | 1201 | — | — | — | 2.49 | 0.22 | 13.89 | 0.2333 | 0.2509 | 4.9672 |
| WNU87 | 1203 | 0.576 | 0.04 | 28.77 | 2.80 | 0.03 | 28.12 | — | — | — |
| WNU87 | 1204 | 0.580 | 0.01 | 29.52 | 2.48 | 0.17 | 13.37 | — | — | — |
| WNU87 | 1211 | 0.498 | 0.30 | 11.36 | — | — | — | 0.2367 | 0.1632 | 6.4667 |
| WNU92 | 1240 | 0.636 | 0.00 | 42.12 | 2.75 | 0.02 | 25.52 | 0.2345 | 0.2044 | 5.4920 |

Table 104. "CONT."—Control; "Ave"—Average; "% Incr." = % increment; "p-val."—p-value, L—p < 0.01.

TABLE 105

Genes showing improved plant performance at Normal growth conditions under regulation of At6669 promoter

| Gene Name | Event # | Tiller Number Ave. | P-Val. | % Incr. | Time to Heading [day] Ave. | P-Val. | % Incr. |
|---|---|---|---|---|---|---|---|
| CONT. | — | 5.81 | — | — | 29.44 | — | — |
| WNU78 | 1074 | — | — | — | 26.25 | 0.06 | -10.83 |
| WNU78 | 1186 | — | — | — | 27.40 | 0.17 | -6.92 |
| WNU44 | 1194 | — | — | — | 23.00 | L | -21.87 |
| WNU87 | 1200 | 7.79 | 0.15 | 34.05 | — | — | — |
| WNU87 | 1203 | 7.79 | 0.15 | 34.05 | 28.94 | 0.75 | -1.68 |
| WNU87 | 1204 | — | — | — | 25.13 | 0.01 | -14.65 |
| WNU92 | 1240 | — | — | — | 27.52 | 0.19 | -6.51 |

Table 105. "CONT."—Control; "Ave."—Average; "% Incr." = % increment; "p-val."—p-value, L—p < 0.01.

It should be noted that a negative increment (in percentages) when found in time to heading indicates potential for drought avoidance.

Example 22

Evaluation of Transgenic *Brachypodium* Nue and Yield Under Low or Normal Nitrogen Fertilization in Greenhouse Assay Assay 2: Nitrogen Use Efficiency Measured Plant Biomass and Yield at Limited and Optimal Nitrogen Concentration Under Greenhouse Conditions Until Seed Maturation—

This assay follows the plant biomass and yield production of plants that were grown in the greenhouse at limiting and non-limiting nitrogen growth conditions. Transgenic *Brachypodium* seeds were sown in peat plugs. The $T_1$ transgenic seedlings were then transplanted to 27.8×11.8×8.5 cm trays filled with peat and perlite in a 1:1 ratio. The trays were irrigated with a solution containing nitrogen limiting conditions, which were achieved by irrigating the plants with a solution containing 3 mM inorganic nitrogen in the form of $NH_4NO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $NH_4NO_3$ with 1 mM $KH_2PO_4$, 1 mM $MgSO_4$, 2 mM $CaCl_2$, 3.6 mM KCl and microelements. All plants were grown in the greenhouse until seed maturation. Each construct was validated at its $T_1$ generation. Transgenic plants transformed with a construct conformed by an empty vector carrying the BASTA selectable marker were used as control (FIG. 9B).

The plants were analyzed for their overall biomass, fresh weight and dry matter, as well as a large number of yield and yield components related parameters. Transgenic plants performance was compared to control plants grown in parallel under the same conditions. Mock-transgenic plants with no gene and no promoter at all (FIG. 9B). The experiment was planned in blocks and nested randomized plot distribution within them. For each gene of the invention five independent transformation events were analyzed from each construct.

Phenotyping

Plant Fresh and Dry vegetative weight—In Seed Maturation assays when maturity stage has completed (about day 80 from sowing), the plants were harvested and directly weighed for the determination of the plant fresh weight (FW) and left to dry at 70° C. in a drying chamber for about 48 hours before weighting to determine plant dry weight (DW).

Spikelets Dry weight (SDW)—In Seed Maturation assays when maturity stage has completed (about day 80 from sowing), the spikelets were separated from the biomass, left to dry at 70° C. in a drying chamber for about 48 hours before weighting to determine spikelets dry weight (SDW).

Grain Yield per Plant—In Seed Maturation assays after drying of spikelets for SDW, spikelets were run through production machine, then through cleaning machine, until seeds were produced per plot, then weighed and Grain Yield per Plant was calculated.

Grain Number—In Seed Maturation assays after seeds per plot were produced and cleaned, the seeds were run through a counting machine and counted.

1000 Seed Weight—In Seed Maturation assays after seed production, a fraction was taken from each sample (seeds per plot; ~0.5 gr), counted and photographed. 1000 seed weight was calculated.

Harvest Index—In Seed Maturation assays after seed production, harvest index was calculated by dividing grain yield and vegetative dry weight.

Time to Heading—In both Seed Maturation and Heading assays heading was defined as the full appearance of the first spikelet in the plant. The time to heading occurrence is defined by the date the heading is completely visible. The time to heading occurrence date was documented for all plants and then the time from planting to heading was calculated.

Leaf thickness—In Heading assays when minimum 5 plants per plot in at least 90% of the plots in an experiment have been documented at heading, measurement of leaf thickness was performed using a micro-meter on the second leaf below the flag leaf.

Grain filling period—In Seed Maturation assays maturation was defined by the first color-break of spikelet+stem on the plant, from green to yellow/brown.

Plant Height—In both Seed Maturation and Heading assays once heading was completely visible, the height of the first spikelet was measured from soil level to the bottom of the spikelet.

Tillers number—In Heading assays manual count of tillers was preformed per plant after harvest, before weighing.

Number of reproductive heads per plant—In Heading assays manual count of heads per plant was performed.

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (7121 sequences)

SEQ ID NO: 1 - DNA, 3445 bp, Setaria italica
cccccttctccccaatggaggcctccgcttctgccccagcggtgctcctcccgctgctggccgccccgccgcgcttcctccacctccctctgcgccgcccctccacccgccgccacggctgcggaagtgggttcctgctccagccgccgccgctaggccccggctcccgcgcccgctgtaggacaacctgttgcgcgtcgggcccggaccatgcggacgtgctgctgggcggggcctcgctggtcagcgtcgcggcggtcaccctcctcgctgccctgcagctggtgtggttacggtggcgcagcgcgatgcacggggattccccggaggttttacatgaacatggcaaaagcattgtaaataaagtccttggtgcatcaaaaacaatgtatgacagcaactgtgcagcacagacaactcatgatagtgggcttccagagcttggcgtttctggaagaatgactgttgatacacaggcttgttctgtaattagtcctttggcacctccggttacatcagcagatatttctggaccagaagttatttgctcaactgcaactgcaaattgttccatcgaaaaggttacaagtgttcctgtgatgccagattctgtatcagaaggacaagataaaaccaagtatttgtctaacagtacgggccgggtagctgggctaccttatcaatttttatccctttcaggacatcaggaagtgatgcaaaatagccaaggtcatactggtaagcaaatggatgcctcggatgctaatttagttggatgcaatcagagtgatcaagaggaacatcttgattttacatctctttcgtccttcaaaagaatagcagaatgtcatctcggttttgttcccctggccagcaaccgcaatttgttcaaaccaaggaaatggattgaattcaccaactcaaatgcagggagctcttattccccagcaggtcagttttctccagttgcatgcttaagggaagaccctgtgagtaaacaagagaaagctgtgaaggaccatgatgattcaccagtcacaggctttagcatttccaatatactaaacaaggagaatccagataatttcactcaagcaaagagagggggactgaagggcacgaaggatacattagattactcaaggatatacaatagtttcttaattgatggaaggttgaaggactgtgtggacttgttagaaagcatggagcaaaatggattgcttgatatgaagaagattcaccatgccagctttttcagtatgtgtaagaagcaaaaggctgtcttggaagctgttcgcttctgcactttgattgacaacccgaaaataagtaccttcaatatgcttttgtccgtgtgtgctaattcacaagattttgatggagcactccaagttatggagctcctaaaggaagctgggctaaaacctgattgtaaactttacacaacactgatatcaacttgtgcgaagtgtggaaaagttgatgccatgtttgaggtcttccatgagatggtcagtgctggtatagagccaaatgtcaacacatacagtgcattaattgatggctgtgctagagctgggcaagtggcaaaagcatttggtgcttatgggattatgagttcaaagaaggtgaagccagatcgagttgtcttcaatgctttgatcagtgcatgcggtgaatctggtgctgtggctcgggcgtttgatgttttatcagaaatgatggcagaatcttcggaatcaaaaggatccggaccaatacttcctgatcatgttactgttggagcgctgatgaaaacatgtattcaggcaggccaggctgatcaagctcgtgaggtgtacaaaatgcttcaggagtacaatataaagggtaccccagaagtttacacaatcgcattgagaagctgtagcttgactggtgatttagggtttgcactgaagatatatgaagatatgaacaagattggagtaaaacctgatgagatgttcttgagtgctctagttgatgtagctggccatgctaggagggcggatgccgcgtttgaaataatgaaagatgcaagagcaaaaggattacacgtgggaacaattgcctacagttcattaatgggtgcttgctgcaatgcaaaggactggaagaaggcactgcagctatacgaggagattaagtctatcaaattaaccccaactgtttcaatgatgaatgctttgatcacctctctgtgtgatggtgatcaggtcctaaaggctgttgatgtccttaatgagatgaaaggaataggaatctgtccaaatgagataacctattctgtcttatttgttgcttgcgaaagaaacggtgaagcacaactaggtttggatttgtttgaacaattaaaaatagatggcattggcatcaatcctaccattattggttctctgactggtttatgtctacaaatgtttgacagtgatctctcgcttgggaatattattgtcaacttcagcttagggaaaccacaaattgacaacaaatggacttcctcagcaattatggtgtatcgtgaggcagtttcaactgggctagtaccttcaagtgatgttttatctcaagtgttgggatgtttgaggcttcctcatgacaattcgctgaagagtagtttcattgaaaacatgggaataagttgtgatattccacataatccaaatattaattcactctttgaaggattcggtgaatatgacatccgtgctttttcgatgctggaggaggctgcttcattaggtgcagtttcaagtatttccatgaaagataccaggattgttattgatgcaagaaagttaaagatctacagtgccgaggtttctcttcttacaacattgagatctttgaagcatcgactcgctgcaggtgcaagattaccaaacgtgacaatcttgttacccacagaaaagaaacaggttgacattgatgaaagagaaaaaacactaaagctatctggaagaattggtcaagcaatcggttctctcctgaggcgattaggaatttcataccagggggaggagtcgcacgggaggatgaggatcaatggcctcaccttaaggagatggttcaatccaaagttgaatagcaaatcctccagtgccgcgccagctgatttgcttcccctatcgtcgcgtttagcaaaagggattgctgatcagcaacgcgacatcagaagcctttcgctcgagtagtgcaggacaatccagcagcaaccgatctcggtaacctttgtgagaacatgtccaggatagtaaaatgtcttaagagtttgttcagggaaagaaataaaaaatactacatttatatagtaatctgtgaaaagattattcaaaagaaagaaatcacagtacatcaaattttgtaaacaggatgcataaaacaatttaatttatagtgtgtgaagcatttttgtctcgtt

SEQ ID NO: 2 - DNA, 703 bp, Sorghum bicolor
ccattacaatctcgagaagcaacccgtcacgccgcactcttctcgcctccgattctccggagattcgtcatcagaatggcggtggcggcggcggctcgtgccgggttccggcggctattctccgtgtcggcgttcgctgcaccacctccacccgctgcgcgccccgcggcggagccctgcaacaacctcttcgtctcagggttaaataaacgcacaacatccaatggacttaaggaagcattttcgaaatttggtcaggttattgaagcaagagtaatcactgatagaatatctggatactccagaggatttggctttgtcaaatatgcgactgtacaagaagctggtgaggccataaaaggcatggatggaaagttccttgatggttgggttattttcgccgagtatgcaaagcaaagagaagccacacagccgtcacaacaaggagcaccatatgaatactctagctaatgattgaagttgccatgcacagtcgattacatacactgtattcctttttttctgccgagagtgtaatattggatgttgcttgccatccaaaaatttacagagagaatgtagcttgctgtgctccacttgaactgcctttgttgtggttaacattgtacttggctgctgcagcttcatgtgtgtggcataactttcctcattaatttacatgtcactgcattttttgaccact

SEQ ID NO: 3 - DNA, 2092 bp, Sorghum bicolor
aatccccccgtcacctacctccgtccccagatccgcctcctcctccttccctgcctgcctcccccccttccagatctcccgcccactccagagtcgagatccaccgcctccccgccccctcaccggagcagagcagcgcgagggagcgcgggacagaggccagccatgggcaaggaaggggccagcgccggcggcggcggcggcgacggcggcatgtcggagtcggtgatccgcaaggtcctgatctcgtacatgtacgtggcggtgtggatcttcctctccttctccgtgatcgtctacaacaagtacatcctcgaccccaagatgtacaactggcccttccccatctccctcaccatggtgcacatggccttctgctcctccctcgccgtcgcgctcgtccgcgtcctccgcgtcgtcgacctcccgtcctcccccgccatgacgtcgcagctctacgtctcatccgtcgtccccatcggcgcgctctactcgctctcgctctggttctccaactccgcctacatctacctctccgtctccttcatccagatgctcaaggcgctcatgcccgtcgccgtctactccatcggggtgctcttcaagaaggagaccttcaagtcctccgccatgctcaacatgctctccatctccttcggcgtcgccattgccgcctacggcgaggcccgcttcgacgcccgtggcgttgccctgcagctcgccgccgtcgccttcgaggccacgcgcctcgtcctcatccagatcctcctcacctccaagggcatctccctcaaccccatcacctcgctctactacgtcgcgccctgctgcctcgccttcctcgtcgtgccctgggtcttcgtcgagttgcccaaactgcgcgaagtcggcagcttccagccggacctcttcgtcttcggcaccaactcgctctgcgccttcgcgctcaacctcgccgtcttcctgctcgtcggcaagacgtccgctctcacaatgaacgtcgccggcgtcgtcaaggactggctgctcatcgccttctcctggtccgtcatccgcgacaccgtcacccccatcaacctcttcggctacgggatcgccttcctcggggtgggctactacaaccacgtcaagctgcaggcgctcaaggccaaggaggcacagaagaaggcggcgcaggccgacgaggaggccggctcgctgctgcaggagcgcgactcgcacggcgaccgcaagactgacacccaggcctagcgagtgtgatggatctcatgatccaaccgccctcgccctcattcggtcggttctgaacccagcccccctgcctagtgtactccaaatgtgtgatccatccaacccttacaagtttgatgcgaaatttgttcatttcttgtctttgacttgatctggtggtagcaaggcaaataagcacgggaaagatgcaagctttgtgtcgaacatgtggaaaaaaaaaatatatgagcaatttttgtcttttttgtccagttgtagctgtactaccacttaaacagtgagcaaaattgtttgcattatctatattgctatgattggtctgttttgttatctcgtaatacatcaaaaattggatccattggtgcgaaaggagtgcaatttctgagtaccgattaaaaagcatccaatgttaagttttatatattgtcaatccctctgttgttttttatattgctctaattatcttgggacattggacaggagacctggtgcaaacaccatctgaagattggtggcctgatacatggttgatttccacggagctgacatcggtttggtgctttgacgcctaaccccattggttgttcttgtggggattcttgaggaatttgttgtgtagggaacatcaggacgtagaactgcctgctggaccagaagaaacttggatctcacaatgccacttttcttttgtggagccaatactattgttttgctattctttttccatttttttttggtcccttccgagcgcctgtactgtattcaatcagtgaagggaactctacatcatcagtacttaaaatgacaatcatatggtactatctacaacaacctctgtccc

SEQ ID NO: 4 - DNA, 1503 bp, Arabidopsis thaliana
gtggatagacaagaatttaaatagaatgaagaggcgaccatgcaagtgttgtactaggccaaattttggagacgctctttctctttcatagagagagagtgagaaagttctgatacggcggcttctcactgtcatctagctgtaccactgacgataaatctctctcttcctctaaatcgttaacttatacttgcagattctcgcgttgatagtaaaaagatggtgaagcttttggagctgttcataacttcatcaaaaccagtcgttgagattctgttgataacatcagtcggattttatatggctctcgatggagtcaatcttcttggtcatgatgctcgtaaatatctgaacaacattgtcttctatgtgtttagtccttcgcttattggaagccgtttagctgatagtgttacatacgaaagcttggtcaaaatgtggttcatgccggtgaatgttctgcttacattcatcattggttcattacttggctggattgttattgtcatcactaagcctccttcacaccttcgtggtctcattcttggttgttgtgctgctgggaatttggggaatatgccactgattataatcccagctgtttgtaaagaaaaaggaggtccctttggagatcctgagagttgccagaaatatggaatgggttatgttgctctctccatggctatgggatctatttacatatggacttatgtatacaatcttatgcgtgtgctatcgaactctcccgttgaaacccctccctctgttgaatccaactacgacagctacaaagttccccttatttcttccaaggaagaagaaaacaaccaaaaggctgggaggtgggaaaaagtcaagcggagattggtttcactgtcacaaaaagtcaaccttaagacaatttttgctccatcaactattgctgcgatgattgcacttgtgatcgggctcattactcctttaaggaagctaataatcggcacggaagctcctctccgggtgcttcaagactcagtaactctagtgggagatggggcagttcctgcaatgaccatgattataggaggaaacctactcaaaggtttgaggagttcaggaatgaaaatgtccagtattatcggcgtcttggttgcgcgttacgttttactgcctatgagcggtgttttaatcgtaagaggagcatataagttggatttagttacatcagagcccttataccaattcgttcttcttcttcaatatgctgtcccaccagccatgaatctaggtacaattactcagttatttggaactggggagagtgaatgctcagtgattatgctctggacttactctttggcttcgattgcactcactgtttggccaacattcttcatgtggcttgtagcttagaatagacccccatactcatcatgttacatgtattgttttgttccattgattcaagaattgttcttggacttccagatgattggatcaagtataatagagaacatatactta

SEQ ID NO: 5 - DNA, 1858 bp, Arabidopsis thaliana
attttatccattatcaaagtcttttttttttttaaatttctttctctcgttgtctccttggaaattactttcatcatttaaaaaacttgcttactccgtaaaccaaagctagatccaattagtcttatttcctttttattcgtctctctctcactatccgagatttgggttgaaaaatacaaacccccttttatttctcctcttctctcctacaagctcattcagaactctcaacatttccggtagagaaaaaaaaaccgttttttttttaatctctttctaaagaaggatatcaaaacaaaacacaaagttgaaaactttgcatctgggtttgtctattttagattcagatcttagtttttttcgattgaatatctacaatggtaatggaaacagagtcaaagttccatgttttagctgttgatgatagtctttttgatcggaaaatgattgagagattgcttcaaaagtcttcatgtcaagtaactacagttgattcaggctctaaagctctggaatttctgggtttaagagtagatgacaacgacccaaatgcactctctacatcgccacaaattcatcaggaagttgaaataaatctaataattacagattactgtatgcctggcatgactggttatgatttgctcaagaaagttaaggaatcagcggcgtttagaagtatacctgtagttataatgtcatctgagaacgttcctgcaagaatctccagatgtttggaagaaggagctgaagagtttttcttgaaaccagtgaagttagctgatcttaccaagttgaaacctcatatgatgaaaacgaagttgaagaaagaaagtgagaaaccagttgccatagaagagattgtggtgtctaaaccggagatagaagaagaagaagaagagtcatcagtgattgaaatcttgcctctccaccaagaaattgaatccgaacaacttgaaccaatgttgagtagtaataagagaaaagcaatggaagaagtggtttctactgatcgatcacgtcctaaatacaatgatatcacaacctcggtctgaaggaggactaacgcaacccgagaagccactacaagacctatatggagaatgccaacagaatctctcagtagaagatctgctaactcttgcatctgaagcaaacaacaacggactgcaaggaggactaacgcaacccgagaagccactacaagacctatatggagaatgccaacagaatctctcagtagaagatctgctaactcttgaatatgaagcaaacaacaacggactgctaggagtaataccgcagcaacatcgttatcatcaggaaaaagagacaatgcagacacaaggagatccactaaatcgaatacctattcaatcagaagcttcaaaccattcagatagtggtgatagcacactaacaatggctcaaaaccaggatggtctcggacacagtagttgttttattctctgtcaatttacttctctcccctagattagctttcttcgtttttttcttttatttttcatgctgttaaacccacaagatttttgggaagtttcttgctactagcttaagaatccaaaactattgcaaagattgaagctttcgagaattagtaatgaatcttatcaaaactaacagctacatttactagcttaagaaccattaaacgaattgtaaaattctctcatcttgtgggtgtaacagcatcaaagatctaaatccaatcttatcaaaaattggaagtggtcgaaagttttggccttttgatacgaacaagcttcaaagatataattcctgagattgaagatgaaatttttatgatttgttccctttggaaacgaaaactgta

SEQ ID NO: 6 - DNA, 2575 bp, Arabidopsis thaliana
aacacacaacacaaacacgctcataataaaaaccataaaaatatctcctcttctcttttttctctctttttttgtagccccgctaatatttcgacacctgtttcagtctctttttttgtttcattcttcttcttcttcgtattcctcgatgttttagacgaagcagggactctcagtttacgagttacggaatctctctctgtctcagatccatcagaatagtttcttgcgcaaacccattcttgaagatggacagggcagatacatggggatttgtcagcggtgggagatgtttatatctcaagttgcttttatgtttatagctctacaaggtggtgttctaagtatttattgttttggtcattctatctcctccgctgcattgttctgtctcttctcttcatatggatttgaacgagagtgttgttcacttttctcgtggcaatggtattgcaaagcttgacaatttcggcgatactgctcttagcttgaaatgtcttggaagcagtgcagggagattgattgggagctctcaccataaccataagctttgttctgatgtttctaattgtcctgatggtggttgccggttggttctcggtttgggtccaacaccgccttcgtattattacaatgtcagggtcaatgataataacaacaaaggctctgcttcttctgggagtgttcaggaactctcatcaggaggtaactcaatcctgcaacttggtcctcctgctgtgaccatggatactttcagcggacttgagggttctctgttgacatatgcggatactaatgtgtcccaagctgctgttgatgagggttctacctcagcaaggcgatcaggtggctatatgccatcgcttcttttcgctccaaggacggagaatgttagaaaaccttcaaggatgcaagagtgtagtactaattgtggaactgatgcttataattcacagctgagccatgagtcagagttctctgtaagcgctttctctgacaggtcggcctctgccacgtcttctcagcaaaggatgagcaacccgaagaagtgcaagtttatgggatgtgttaaaggagctagaggagcttcggggctctgcattggccatggaggtggccagagatgccaaaagctaggttgcaacaaaggtgctgagagcaaaactactttctgcaaagcccatggcggaggaaagagatgccaacacttgggatgcacaaagagtgctgaaggcaaaaccgatctctgcatatcacatggtggtggaagacggtgtggattccctgagggatgtgctaaggctgcacgtggcaaatctgggctctgcatcaagcacggtggtggtaaaaggtgtaggattgaaagctgtacacgaagtgctgagggacaagctggactctgtatttcccacggtggtggacggcgttgtcagtcttcaggctgtacaaaaggtgctcaaggaagtacaaactactgcaaagctcatggtggtgggaaacgctgcatatttgcgggatgtacaaaaggagcggaaggtagtactccgctttgtaaagcacatggtggaggaaaacgctgtatgtttgatggtggtggtatttgtcctaagagtgtgcatggtgggacgagtttctgtgtagctcacggtggtgggaagagatgtgttgtggccgggtgcactaagagcgctcgtgggaggactgattgttgcgtgaagcacggtggtgggaaacggtgtaagtctgatggttgtgagaagagtgcgcaaggtagcactgatttctgtaaggcacatggtggtgggaaacgttgctcatggggaggagactggaaatgcgagaaattcgctagaggaaagagcggtttatgcgctgcgcataacagtatgtcacaagataaagctggaagcaaggttggtttgattggaccgggacttttccgtggccttgtctctacttctttacaaaccacaacaactgcaactactactactactaccactgatcattctcaatctggagtcagtgcggtctctgattgcatggactccattgatcgcccgctgccaccgttgcatcatcaacccgagaaaagacagaagctgatgataccaatgcaggttcttgtgcctccatcaatgaaatccttaagcttctcaaacaccgagagacccgatatcgaaacaaacaacaatagtagtggcagcaatgggaggaacatatttgactttatgattcctgaggaaagagttcatggtggcgggcttatgtctctgcttaatggtaacatgaaacaaacactccgttgatggaatctgaaagcttcctctctatgtggtaacaacaaggctagagtctgtgtaaagcttcatgtaatatgtatagttttttggttttctttttgtttctctttcactcttgggtcctttgtacatttcatgggtctctgtttttgtatggtctctggtcttgacttgaccatctagtcgatggcttgaacccaagtctttgtttatttgatcattgttatgaatgttgcaatgtacaagtaaaatgtgttcttatgttttgtacc

SEQ ID NO: 7 - DNA, 1622 bp, Hordeum vulgare
gcggccgcctgcaggaaactccccagtcccctcccgccgccgcctcccctccgttcgttcttcttcttcgagtttgttatcagccatgggtaaggagaagactcacatcaacatcgtggtcattggccacgtcgactctggcaagtcgacgaccactggccacctgatctacaagcttggaggcattgacaagcgtgtgatcgagaggttcgagaaggaagccgctgagatgaacaagaggtcattcaagtacgcgtgggtgcttgacaagctcaaggccgagcgtgagagaggtatcaccattgatattgccctgtggaagttcgagaccaccaagtactactgcaccgtcattgatgcccctggtcaccgtgacttcatcaagaacatgatcacgggtacctcccaggctgactgtgctgtgctcatcattgactccaccactggtggttttgaggctggtatctccaaggatggccagacacgcgagcacgctctccttgctttcactcttggagtgaagcagatgatctgctgctgcaacaagatggacgccaccactcccaagtactcgaaggcacgttatgaagaaattgttaaggaggtctcttcctacctgaagaaggtcggctacaaccctgacaaggttcccttcgtccccatctctgggtttgagggtgacaacatgattgagaggtccaccaaccttgactggtacaagggcccaaccctgcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtgacctttggtcccactggtctgacaactgaggtcaagtccgttgagatgcaccatgagtctctcctggaggcgcttcccggtgacaacgtcggcttcaacgtcaagaacgttgctgtgaaggatctgaagcgtgggtttgttgcatccaactccaaggatgaccctgccaaggaggcagccaacttcacctcccaggtcatcatcatgaaccaccctggtcagattggcaacggctacgctccagtgctggactgccacacctcacacattgctgtcaagtttgctgagctggtgaccaagatcgacaggcgatcaggtaaggagctggaggccctgcccaagttcctcaagaatggtgatgctggtatagtgaagatgattcccaccaagcccatggttgtggagacctttgccacttaccctcctcttggtcgttttgctgtccgtgacatgaggcaaactgtggctgttggtgtcatcaagggcgtggagaagaaggaccccaccggagccaaggtgaccaaggctgccatcaagaagaaatagaggcgtttacctgaatccatctatgtcttgcttttgagatctctctagtagtttagtaagttttgctactgttagcgccgtgtgatatgcgccctgttgatgtgtcatttgagtactgtcgtgttatttcggctttcgggaaaacatggatgcttctgaagactaatcattttatcatctgtctgctttcgaa

SEQ ID NO: 8 - DNA, 1075 bp, Hordeum vulgare
ccctcctaccccgcgccgcctacttggtttcctcctcttcccctccaccgccagcccctgccgccgccgcgcaacccaacaacccccggggcaagcgaagcagcagctatccaagcctacaagggctcggcgagcgatgtcggcggcggcggcgccggcgccgatcggcctgtcgtgggcgccccagctgccttccctggcggcggccggcggcagcaagaagggctcggcgccgaccccgagcattgacgcgcaggattccctctggaagccccgcaacgagctcgtggacgggctctacgtgcccccgagggaccccaggaaggtcaacaagatggcgaggaagaacgtcaaggacaccgccggcaagggctggttcgacatgccggcgccgagcatcactcccgagttgaagaaagaccttgagattttgcagctgaggcatgtaatggaccctaaaaggcatttcaagaggtctggtaaatccaaggctcttccgaagtatttccaagttggaacagttattgagcctgcatctgagtactactcaagtaggctgacaaagcacgaacggaagcagaccttggttgatgagctgttatctgaccaaaaactcaagaactacaggatgcgtaaggtaagggaaattcaggaggcccggacgcccggaggtaaccagaagtggaagaacaagggcaagcaaacgttcaaaagggccaaggacaggcggaaataggatcattgtaaaacaaggaagaatagaagaacggagccaaagagaaatgggcgagcacggctataggttgtgcactctagtgtaatgtggtgaattcatgtaactgaacgtatgaaacttttctccccgcacttcgggcgttgagatcagagtttgaggggatgatggtcaaagcattgtagtatctgaacttgagtctggcaggatgttttctcacacaaaaaaactgatcttgtggatgttcatctactgatctgcaacaaaagagcacggaagtatgtaacatttccacacattctgaatcctggtatagttcctttaaggaggaacgttatgtgc

SEQ ID NO: 9 - DNA, 2661 bp, Hordeum vulgare
gacatgagcgctcccccctcctcctcctcccaccccgctccgataccccagcccgccgcaaccctagcccccgccggcatgcgcgatgcggcggcggcggcggactcctccggctcgccgccgtcgcggatgtcggaggacgacgacggcgacggcggcggcggcgcggcgggagggggcgacaggtgggcgccggatctgaggggcggctgcggcagcaacggcaacggcgggaggtgggcgccgccggaccaggtgctggagaacgtgctggagagcgtgctcgagttcctcacggcggcgcgcgaccgcaacgccgcctcgctcgtctgccgctcctggtaccgcgccgaggcgcagacgcgacgcgagctcttcatcggcaactgctacgccgtctcgccgcgccgcgccgttgagcgcttcgggggcgtgcgggccgtcgtgctcaagggcaagccgcgcttcgccgacttcagcctcgtgccccacggctggggcgccaaggtctccccctgggtcgccgcgctcggccccgcctacccgcgcctcgagcgcatctgcctcaagcggatgaccgtctccgacgacgagctcgcgctcatccccaagtcattcccgctcttcaaggacctctcgctcgtctgctgcgacggcttcaccacccgcggcctcgccgtcatcgccgagggctgcaggcatcttcgagtgctggatctgactgaagattatttccatgaggaggagagcgaggtggtggattggatctccaagtttccagagtgcaacacgtccatcgagtcgcttgtatttgactgtgttagcgtcccattcaacttcgaggctctggaggcacttgttgcacgctcaccagctctgcggcgtctgcgtgttaatgatcatgtgtcgatagagcagttgcgtcgtctcatggcaagggcaccccatctaactcaccttggcaccggatcattccgatctgagccaggccctggtggtgccttgtctgtgtctgagctcgctgcctcttttgcagcgtccagatcacttgtttgtttgtcaggtttcttggacgtcaatggagcgtacctcccagcaatctaccaagtttgtcccaatctcacttccctcaattttagctttgcggctctaactgccgaagagttcataccagttattcgccactgcatcaatcttcgcactttatgggttcttgatactgtgggtgatgaaggccttcgggctgtggctgaaacatgctcaaatctccgtgagctacgggtttttcctctggatgccactgaggattccgaggggtcagtctcagatattggtctccaggcaatctcagaaggctgccggaagctcgagtcaattctctacttctgccagcgcatgacaaatgcagcagtggttgccatgtccgagaactgccctgaccttttggtgttccgcctctgcattatgggccgccaccgccctgatcggattactggggagcccatggatgagggttttggggcgattgtgatgaactgcaagaagctcaccagactttcagtctctggcctgctcaccgataaggcgtttgcgcacattggaaaacatggaaaactcataaagactctgtctgttgcctttgctgggaatagtgacatgtctcttcaacatgtgtttgagggatgcactaggttgcagaagcttgaggtcagagacagcccttttggcgacaaaggactgctctctggtctgaactatttttacaacatgaggttcttttggatgaactcatgcaggctaactgttaggggttgtggggatgtagctcagcaaatgcctaatctggtggttgaagtaatgaaggaaaatgaaggggaaatggataccgttgataagctgtacctgtatcgatcattggcaggaccaagggaagatgctccatcatttgtcaacatcttgtagtactgccattgaagaagtttgttgtatggtcatgtttgttctactattcctgaccattgctgttgtattcctgttcaagtattgccagagccagagaggaagctccccgcggatgattttgaattgcgggaaatatgaatgcatcattaattaagcagatcatcaattattcttttctgggctgattgagtcgaggcttgaacctgtacgaggtttctttgatgtatgtatcttagtgaggcatctcaccttgttcccaacggaatctgagctattttcctagccagcaccagactgatgactttgttgtaccatagttgagttgtcggaactgattagtgattgcacagagactggctgaaggtcgactccaattcggcagcagattttacatggttccttttgccctcgagtctgcagccgttgatgttttgccatgtactgttcaatctatctgctcggacgaaggaacggcattatctacgctggaatgctccgtaaactttttgccttgtattttagattatcccagctacgataaatttcctcttcccatttttttttatagtttccacaagttatttttgtagatcaatgtagaccactaccacttttcttggtcacaaccttctgctgttattaatcaagaagatattggatgatgaaattcagtcagcatcaatttgttatcacgttctc

SEQ ID NO: 10 - DNA, 954 bp, Hordeum vulgare
agagagagagagagagagagagagagagagagagagaggaagaagtctccgttctccaagtctcaacccctctccgaggttggtggcggccggcgggcgaagcagatcagatccgcggcttttcggcgcaggggcgaggccctccccggagcttcggccatccgattccgcagcccgcctctgcgatggtctctggctgctgctgctgctgactgcggtgatgaattcgaggccgatcgtgctcgtcttcctcctgctcgtgctcatcatatcatcgcagttcgagtggaagcagcagatcggcgaggccgaggcgagcccggatgctacgcggcgcaggcagccagcgctggtcgtaagggaagacgccgttaaagagaaaataatactggcgcaggagaagaacatccaacaactcaccgagctcatccagagcctccaggtgcagctactgcattgccgtggcagcaacaacactgctcagggcgcctcctcgactcagtcttcatccagttacaccgaagcggacagacatcagataatcgatgactgatcgcccatcagcatgcccaggtcgtttgcatcagcagacggcgatcaaggacatgctcctgaatggatatggaagacaccgggaccactatgtagttagggtcctggtctcctggagtctagggagctgtcttagtgtactgatgtgccttgctattgacagcactatgaccaccgccttcaccctcggctgtatagggttatattgtaactgtatcatgtaaatttagcccaccttcctcattgagattgagattgtactcatacagattcctgccgcgatcatcatcgattctttccttccatcttctacgaacatctgcagcagcctgtatgtgtagagcaatttctctgcgatgtggtggtctgcaggaaagaggtaaagcaggcactctacaacct

SEQ ID NO: 11 - DNA, 2356 bp, Hordeum vulgare
ctatcgtttgtggcatccggcaccacacgctggctagcgggtcccgaccgtcggcctctcgccgcccgcgtcgcatctgcaaccccgcactgcccatctatccatgctcctccgcctcctctcgtcctcctctcgcgccatcgcaacaaaacctcacccaccgcaaaccttagccgctgctgcagctggcgccaccacctcaaccacccggaagctggcagccatggcaggtaaccgggaggcgttccgcgtggtggtggcgaacacgctcgagcggcgcctcttctacgtgccgtccttcaagatctacggaggcgtcgcggggctctatgactacgggccgccagggtgcgccgtcaaggccaacgtactcgcctcctggcgccagcatttcgtgttggaggaagggatgcttgaggtggactgtccatgtgtgacaccagaaattgtcttgaaggcctctggccatgttgagaagtttacggacttgatggttaaagatgaaaagacgggcaactgttatcgtgctgatcacttactcaaggacttctgtaaggagaagctcgagcaagacactacattgtcaccagagaaggtagaagaattaaaccatattcttgctgtcttggatgatctgtcagcagaacaattaggtgctaagattaaggagtatgggattgttgctcccgacacaaagaatcctttgtcagatccatacccctttaatctcatgtttcagacttccattggaccatcaggtttgagcgcagggtatatgaggccagagacagcacagggtatctttgtggacttcaaagacttgtattactacaatggcaacaagttacccttcgctgcagcacaaattggccaggctttccgcaacgagatatctccccgtcaaggccttctaagagtccgtgaatttacattggcggagatagagcactttgtggacccagaggacaagtctcatccaaagtttagtgatgtttctgatctagagttcctgatgtttccgagagaagatcaactgacaggaggatccgccacaagacttcagctcggtgaagctgtttctgagggaactgtgaacaatgagacccttggctacttcattggaagggtctatctcttcttgacacagcttgggattgacaaagaccgtctacgattccggcagcatctgccaaatgaaatggctcactatgctgctgattgttgggatgcagagatcgaatgctcttatgggtggatcgagtgtgttggaattgctgataggtcagcgtatgacttgcgtgcccactcggataaaagtggtgttccactcgaagctcatgagaaattcgcagaacccagagaagtggagaagttagttataaccccatcaaagaaggagcttggtcttactttcaaagggaaccagaaggcggtgctcgaagcattggaagccatgggtgaaactgaagctctgggtatgaaagcagctttagagtctaaaggggaggttgagtttaaggtctgtacccttgggagggatgttaccgtaaagaggaatatggtttcaattaacatggagaagaaaaaggaacatcaaaggaagttcactccatctgtcatagagccatcatttggcatagggagaattatttactgcttgttcgaacattgcttctatcaaaggactggcaggacagatgatgagcagttgaatgtttttcgtttcccccctcttgttgctccaatcaagtgtaccgtgtttccactggtcaaggttgagaaatttgatattgtcgccaagaaaatttcaaaagctttgacaacagcagggatttctcacattatcgacatcacaggcactacaatcggtaagaggtatgcaaggacagacgaaatcggcgtccccttggcgatcacagtcgactcaactacaagcgtgactatccgtgacagggacagcaaggatcaaattcgtattgaggtcgacgaggtggcttcggttgtgaaggaagtgaccgatgggcagagcacctgggcagacatcatgtggagatacccagcacacaccaccttggccaccgatgaggaagaagcttcagaaacctgaagggtacagtcgaagagtcttccatgggttaaatgatatttggcttttgcagtttcggatgcgtgtcatgttaacagaaatgctaatggagcgttgccctgtaatcctagtcccgttttcccttcacgtatggttttcatccgttccttgtcgatatgtactgtatctacatgttcatctcgtgtgattaaaaggaagagacgtgtgcatattttctttcgggtctgattgatattgttaagatttgta

SEQ ID NO: 12 - DNA, 1819 bp, Hordeum vulgare
gggcagggcagggcagggcagggcacctcccctttctcactccaccaccatcaccacccccagatcccctcttcctcgctgccgacacccacccaccaacgaaccagccacagcccttccgcgcgtccccggcggcggtcacaccacaagccgccgccatgccgccggcctccacctcgccgtccaccgccccggcggccaccaagccgcccccgcgccaccccctggggctggacaccctcgcctccaccagccggtccctcttcgccgcgggccggcggtccccggtcaccacgctcgtctgcgccatcgccctcctcgcgctcatcatgtacggcgaggacgcgcgcaccatcgccgagctctccatcgacgactacctctacccggacgccgacatctacaacgtctccggccttgcccccatcgcgctgcccccgcccacctgcgacctagcccacggccgctgggtcttcgacaacgaatccctccccctctaccgggagaaagagtgcaccttcctcaccaagcaggtcacctgcctcgccaacggccgcaacgacgatacatggcagtactggcaatggcagcccaacaactgttccctccccacgttcgacgccaggaggttcatggagaggatgagggggaagcggctcatgttcgtgggggactcgctgaacaggaaccagtgggagtcgctggtgtgcatggtgcagtccatcctgagcaaagggaggaagaagatagtcaaacggggatcgctcaccatcttccacgccaaggagtaccgcgccactctcgaattctactgggcgccattccttgtcgagtccaactccgacaaccccaagatccacagcatcgagcaccggatcatacggcctgagaggatcgaggggcacgcccagtattggagggatgtggactacctcatcttcaacacctacatctggtggatgaacaccgccgacatgaaagttcggagaccagatacaaggtattggtcggagcacgacgaggtgccgaggatcgaggcctatggccgggtgctcaaaacatggtccgactggctgaacgagaatatcgatccggcgcggacatccgtgttcttcatgacaatttctcctcttcacatcagcccagataaatgggggaacccccacgggatcaagtgcgcgaaggagacgctcccggtactcaattacacggagcccctggacctcaaccacgacatgcggatgtacgatctggtggcgagcacggccaggtccatgaagaaagtgccggtcacgctcatcgacatcaccaggatgtcggactaccggaaggacgcccacacgtccgtctactccgtccggcagggctacctgctgaccgcgaagcagaagaacgacccggagaagtttgccgactgcatccactggtgccttcccggcgtgcccgacgtctggaacacggtgctctacaccaggatcttctcgaaatcagccccttcttcgccgccggccatcgccctcccgcctccccagtgagagagacgcggagctcctccataggaaatgttattcttgttcaatctttttttttctttctttggtggtagtctgggtaaaggctagtagaggagaagaatggggtgggctgtttactgatggcgtgtcgattgaactgtaaattagttttgacctaaccaattgagcaggcttcgttataccagtagacagctgcacttgtgttgaatccattataggcgtcaaacatcaaactgtgtcggtatacaaaggggacatcacttattttacaaaagaagattgtg

SEQ ID NO: 13 - DNA, 2838 bp, Hordeum vulgare
cctccatccatccatcccgagaaagctccttttcccccacccacctccacctccaccgctccatcgccactgctggggagcacaggacaagagacgacacgccgctcgctctccactagtagtattaacccctaatccacctagtaataatccccggccggccatggcgtcctccctcacgccgcgcagccaattccagaagaaggagaacctggggaacgcgcggagggggatgggctacaacgcgccgccgcgccgcaacgtgctctcggccatcaacaacggcggcggcgccaacgccgacccggcgccctccgaggccggctccgaggcgcccgccttcgagttcagcgggagggacgacgtggaccgcctgctcaacgagaagatgaagggcaagtccaagaacgactacaaggggaggacggagcagatgagcgagtacatcaagaggctcagggcctgcatccgctggctggtggagctggaagacggctacttggccgagcaggagaagctccgggggcagattgattcagacaatgctcgtcacgcggagtttgaggctcagctcagtggcgcgcttgaagagttgaaagctgcaaacttggagatgacaacacggtgcgactcactggaggagagcctgaacaaggagaaggccgccaggctgcttgctgtggaatcctatgagaaggaaagagaagaaagggaatcagccgaggcttcacgggatgtactgacggtcgatcttgaaagggtcactcatgaggcaaagcggtttagtgagcagctaaaaatggtccaagacaccaacaaaagacttcaggaatacaactccagcttgcagcaatacaacagtaatcttcaagctgatacatctaagaatggagaaatcatctcgaagctgcaaagggagaagagtgcaatgatggaagccatgactaatctgaaagatctcaacaactcaatgaagaaccagttggattcatccatgtcctcccagaaagaagcaattagagtgaaagaagaacttagaaaagaagtagagtgcctcagagctgatttacaacaagttagagaagatcgtgatcagtctgttgctcaactgaataccttgaccgctgaactggccacttacagcgaacaggctaaaaagtcttcaaaagactctgaacttttgcaaataaaagcggcagcctttgaggaaacatgcagttcacagcaagagcaaattgaaacattgcagaagcagcttgcagttgcaaccgagaagttgaagcatgctgatgtgactgcaattgaggcgatgacaggatatgaaacgcagaaagagacaattaaagatctggaagagcgtttggcacatgcagagtttcaaatcattgaagctgacaagctacgaaagaagctgcataacaccatcttggaactaaaaggcaatatcagagtattttgtagggttcgaccctttttatcggacactgattctaatggtcaggaagaagccattatttcttatccatcatctgtggaaaatgctgggcgtggtatagatttaataaatcaaggccagagatgttctttttcatatgacaaggttttcgatcacagcgcttcgcaagatgatgtgtttgtggaaatgtcacagctagttcaaagtgcgcttgacggatacaaggtatgcatatttgcatatggtcagacagggtcaggtaaaacttatacaatgatgggtaagccaggccgtgatcagaaaggtatcatacctcgatctttggagcaaattttcaagaccagtcagtctctagaaacccagggatggaagtattgtatgcaggcatcaatgttggaaatatacaatgagacaattcgtgacttgttagcgccaggccgctccagcagtgagatgcctggcggtaaacaatacacaataaagcatgattcccagggaaacacaacggtctccgatcttactactacaaatgtgttcagcactgctgatgtgacgtctcttctagagaaagcatcccatagcaggtctgtaggtaagacccaaatgaacgagcaatcttcccggagtcattttgtctttacactaaagatatttggatcaaatgagagcacaggccaacaagtacaaggtgtactgaacttgattgatttggccgggagtgagcgtcttactaaaagtggtgcaacaggcgatcgcttgaaggaaactcaggccatcaacaaaagcctgtcagctctcagcgatgttatctttgcgattgcgaagaacgacgaccacgtacccttcaggaactcgaagctcacgtacctcttgcagccttgccttggcggggactccaagacgctcatgtttgtcaacgtctcgcccgaggcgacctcggccggggagacgctctgttccctgaggttcgcgtcgagggtgaacgcatgcgagatcggggtggcgagacggcagacgcagtccaagtcctcatcatcggataacagtaacaggctgagctacgggtgaactctgccctgtctgtcaatggccatcgtggcctgatgctgatgtgatactgctacataacgagctaagctagctagcggctctgtgggccgacttggccacgagtgtgctgtgctggcgacgcggagcggctggcctctggcattagtaacaatgtacagtcagtagggagagtggcagagcatgcgctgtggcattgagagcaggagagaactggcgctacttgctgctacgatgattgatcttctgtttgtttgtagtagctgattgatttgagatttgaaaagtaatgttaactggcgctatattctttc

SEQ ID NO: 14 - DNA, 1870 bp, Hordeum vulgare
aaacaccgaaaccaaaacccagagccagcccgcggcggcgagcagcagcagcagcagatggatgccgcggcggagatggacgccggcgagctggaagccgtgttccgtgcggcggccgacttcgcctcctacccaggagtgcatggcgaggacgcagtgaggcagttcctggagcagttccctcttcatgacctgctaggtgcgttgcagagtcagggagccgagcctgagacggttgaaactgttgcagcttgcttggacaaagtattttcgtccagatatggagcttcacttctgcccagctatgctgcatttattgaagctgggttgctcacaaacctaaacaatatcagacaactggcctgcaaagcggtggtacatcttcttgacaaggctgaagatagtgatgttgccgtggacacatttgtacagcacaatctgtaccctcttctgatcaactgcttgattgagggagacgaagagatctcagcaattgttttggatgccataaagcgtctagcagaaattcctaaagggaccgatatcatatttccaccagatgggcaaggattgcaactcaacaaagtggcagcccagtcatcctcaatggcacgaattcgcattctatctttgatagctaagctctttgccgcatcaagttgtactgctactgcaattcgtgactcaaaccttctcagcttatttgaggacgagataaaagatagaaaagacatgcttaaaaccctgagtgcactagaggtcctctatgagcttgcggagcaccctcacagcaacatgttcttgttaaagaccagtttgcttcaacacataactgatgtgattaacgatccctcagctgattctattgtacggtcaagggcatcattgatcagtgggaggcttcttgcttcagctgacgcttttatgaccatagaacaatcttgtgttacgaacctgctcttggccatagacaaaatattgaggacggaggaaagtcaaaatactgatgaaattgagagcgcattggagaccttaggtctaattggtacaacaagtcaaggagcatgcttgttgttctctgatccaccaaatgttgctaaacatgtggtagaaatgtcctttgataggcagggcagagggaaacagctggccgctttacatgcatttggaagcatatgtggtgttgatcgagaagaagaccagatgaaactggatgattatcaagcagaagagtgcctgaagcgtttagtctacagtgcagcatcaaacagtccaaaattaactccttcagctcttcttctctcaattctacaacaagatccagacgttcggattgctggttacagagtactatcaggactggttgtccgagaatggtgcctaagggaagtttgctcaaagccagagataatcggagttgttacggatccaaaaatggagacaacaaaacttggcatggaggcacggtatgcttgctgtgttgcaatcaacaaggccttggcatcgtcgcaccttcttcatgagccgagcctttctgaactcattggaaagctgaacgaggcagttagaaggggtccctatctttcccagaagaagccgcgcgtggaggcacagccggtggttggtaccatggagaggttttaaggtggcctttcgagctattcggccgagaaacggagcaccctctgtgcttgatgcatgtacattagatgcaactgtgtttcttaactgaacttgtgtgacgaggacgaggatgacgatgatatcagaggttcagttctgttgggttttgcgatacaaataggtggatgctggttcaagccattccatcttacaattacagttacagcaagggattaagctaaaaaaa

SEQ ID NO: 15 - DNA, 1028 bp, Hordeum vulgare
cagtggtgcaccacacagctcgccacttgctccctcgcccacgtttccccggccggcacaggctacgttgagccaggaccaggacccacccagctctggtcacggggagcgcgcgtctgcgggcgggcgggcggccggagcgagcggggatggggaactgccaggcggcggaggtggcggcggcggtggtgcagcacccgggcgggcgggtggagcggctctactggtccgcccccgcggcggaggtgatgcgcgcgaacccgggccactacgtcgcgctcgtcacgctccgggtcgccgaggagcgccaggacgccggcgcccgccgcaccgtgcgcctcacccgcgtcaagctcctcaagcccaaggagacgctcctcctcggccacgtctaccgcctcatcaccgccaacgaggtgaccaaggccgtgcaggcgaggaaggaggagaaactgaggaaggcgcggcagcagctccagcagctggagtcttcgacgcggcagagcaaactgcggccggcggccgacggtgacgacgatgacgacgacgacgaggccagcttggatgagagtctcgatcagttggcgcggcaggacggaggagacggccaccggagctccggcgcccggcaccggcaatggcggccctcgctgcacagcatcgacgaggccgcgagctgatgcccggccatacgtgcacagccctcggtggatcttctgtattttcggcgtccaccggggcttcgacagattaatctagctcgtgttcatgggttgctgccgcccacgtctgcgttggatcgacaccccgaggcgagcgggccgcttctgaagcgactccgtcgatcggagcgtgtcctgtgtcgtctgtacatcttcagcgtttctcgtcaggatctgttagtgagagtgagactgcctttttttttattttcttctctttctcttgatacgtctgcacctgattaagatgcatgaaacaagttcagaacacgagtagctaatacatccatacaagagatgacgcca

SEQ ID NO: 16 - DNA, 1078 bp, Hordeum vulgare
cgactcctttgacctctcgcgctgtcctccccgcccccgcccccgcccccgcctgcgtcgccgcgccaagctcgagccgccccctcccccggttggtcggattccatggccaacagcaacctcccgcgccggatcatcaaggagacgcagcggctgctcagcgagccagcgccggggatcagcgcctcgccgtccgaggagaacatgcgctacttcaatgtcatggtccttggccccgcgcagtcgccctacgaaggtggagtcttcaagcttgaacttttcttacccgaggaatatccgatggctgctcctaaagttaggtttctgacaaaaatataccaccccaacattgacaagcttggtagaatatgcctcgacatcctgaaggacaagtggagtccagctcttcagatacgcactgttcttttgagcattcaggcactgctgagcgctccaaacccagatgatcctctctcagagaatgtcgcaaaacactggaaatccaatgaagctgaagctgttgagacagcgaaggaatggactcgtatgtacgccagtggtgcatgacaagctaacgctgttatggatgtaataacactgtctcatagttgggcctaatcgaaaccatttgcttgataaaaacaaacttggaatgatttgcgatggacgaatgtgtccagagcgacatcatttctagttggtggttgtatttgtggtgcgtgttccggcatgcttcataacttgctgcttatagaacgcactctgttgctggttcatcctcaattgtttctccaattaaaaatatccgctgtgatccggttatgtaagttctccaaatgataatagctggttctctgtttgtgtttctctcctgatgatttatattttgttttggatcctttttaggaatgttcagttttttctactccagttgcttcgtcttttttagaatttttaggttgttgaactgcacattctttttaatttccatatcaaatggtattgtataaatcttgatgagtaaggattggttcccagggtggtaaagtgggagttgagacatgagcggccgctcgag

SEQ ID NO: 17 - DNA, 878 bp, Hordeum vulgare
ctccgcgccgccgcccaaaaccccgacccgcgccgccgcgccgccgagcacacagcaaccaagcacaccgccgcgctcacagcaaccaagcagacggccgcaaccaccatggcagccgttctcactcgcccgacgcctggcaccgtccagtgcttcggccggaagaagaccgctgtcgccgtggcctactgcaagcccggtcgcggcctcatcaaggtcaacggcgcgcccatcgagctcatccgccccgagatgctccgcctcaaggccttcgagcctatcctgctcgccgggaggtcgcgcttcaaggacatcgacatgcgcatccgcgtccgcggcggcgggaagacgagccagatctactccatccgtcaggccatcgccaagtcgctcgtcgcctactaccagaagtacgtcgatgaggccgccaagaaggaggtgaaggagatcttcggccgctacgaccggacgcttctcgtcgccgacccccgccgctgcgagcccaagaagttcggcggtcgtggcgcccgtgctcgtttccagaagtcttaccgttgatctactgccagatcacctcttgggtatggcggtggtggcgtactgcctgtctacttatctatctaccttttgcggctagtagtttcccatcttttggtcaatgaaatggattgtcaggtgcccgtgcagtatcattttgctttatgcctagttaatgggattatgttatgtttatcttgtgttaatgatgagactggatgtttggatgaagttttctgaattacttcgttctgtttgcgcgtgatttttggtagtataacagatggtacaagctttgtgctagataatagaagttatgatatgccagtcatttctttgtt

SEQ ID NO: 18 - DNA, 2895 bp, Hordeum vulgare
cacgggatcgggagcgccgccgcttccccacctctcatctctcgcctcgggagacggaggccagaccccaaggaactatattcccagcttgacattcaaaatcagccaagatggtgaagtttaccgcggaggagctccgcggaattatggacaagaaaaataatattcgtaacatgtctgttattgctcatgtcgaccacggcaagtctacgcttacggattcccttgtggcagctgctgggattatcgcccaggaagttgctggggatgttcgcatgactgatacccgtgcagatgaggcagagcgtggtattacaatcaaatccacgggtatctctcttttctatcagatgactcctgaatcacttgagatgtacaagggtgacagggatggggatgaatacctgatcaaccttattgattcacctggccacgttgacttttcttcggaagtcacagctgctcttcgtatcactgatggtgccttggttgttgttgactgtattgagggtgtctgtgtccagaccgaaactgtgctgcgccaagctcttggtgagaggattaggcctgttcttactgtgaacaagatggacagatgctttctcgagcttcagtttgaaggtgaggaagcataccagactttctcccgtgtcattgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggagttgatgaggtgaagatgatggagaggctgtggggtgagaacttctttgacccagccacaaagaaatggacctccaagaacactgggacagctacctgcaagagaggattcgttcagttctgctacgagccaatcaagcaaatcatagccacctgcatgaatgatcagaaggataagttgtggcctatgttgaagaagcttggtgtgaccatgaagaatgatgagaaggacttgatgggaaaggctctcatgaagcgtgtgatgcaaacttggctgcctgccagccgtgctctgcttgagatgatgatctttcacctcccctctccttcaaaggcacagaggtaccgtgtggagaacttatacgagggtccccttgatgacatatatgcaaatgctatcagaaactgtgaccctgatggtcctcttatgctgtatgtctccaagatgattccagcatctgacaagggtagattctttgcctttggacgtgtctttgccgggagggtcgcaactggcatgaaggtccgtatcatgggtcccaactttgttcctggccagaagaaggatctatatgtgaagagtgtccagcggactgttatctggatgggaaagaagcaagagtctgttgaggatgttccctgtggtaacactgttgctttggttggtttggatcagttcatcacgaagaatgcaaccctgacaaacgagaaggaagttgatgcctgcccaatcagggcaatgaagttctccgtgtcccctgttgtgcgtgttgctgtccagtgcaagacggcttctgatcttcctaagcttgtggagggtttgaagcgtctggcaaagtctgatcctatggttctctgtaccattgaagagtctggtgagcatatcattgctggagctggagagcttcaccttgaaatttgcttgaaggatctgcaggatgacttcatgggtggtgctgaaattattgtttcccctcctgtcgtctccttccgtgagactgttcttgagaagtcctgccgtacagttatgagcaagtcccccaacaagcacaaccgtctttacatggaagctcgcccattggaggagggattggctgaggctatcgatgatggccgcattggcccacgtgatgatcccaaggtccgctccaagatcctatctgaggagtttggttgggacaaggatctcgccaagaagatttggtgctttggacctgagacgactggcccgaacatggttgttgacatgtgtaagggagtgcagtacctgaatgaaatcaaggactctgttgtggctgggttccagtgggcgtcaaaggaaggagcactatgtgaggagaacatgcgtggcatttgctacgaggtctgcgatgtggttctccacactgatgctattcacaggggtggtggtcaggtcatcccaacggcgaggagggtcatttacgcttctcagctcactgccaagccaaggctgctggagcctgtgtacctggttgagatccaggcgccggagaatgcgcttggtggtatctatggtgtgctgaatcagaagagaggacacgtgtttgaggagatgcagaggcaaggtaccccactctacaacatcaaggcctacctgcctgtcatcgagtccttcgggttctcgagcaccctcagggctgcgacgtccggccaggccttcccccagtgtgtgtttgatcactgggacatcatggcttctgatcctttggaccccggcacccagtctgcgactcttgtgacggagatccgcaagaggaagggtctcaaggagcagatgactcccctatccgatttcgaggacaagctctaaattttgggtaatgttttgctacttgcccttgctgtgaagggagccgcattattttctcccgatgtgtatcttgctgtttgtatgtggtgctacctgagactatgttttgatgatgattgtggtgatgtaacagatgttaaactttagatcatatatatctgtcgtcagctggtggatcttttttactgtcccgtgctttgcttttgtgctacatcttgctttcgtttactgtatttgactgtatatttgattg

SEQ ID NO: 19 - DNA, 1808 bp, Hordeum vulgare
gaactctctcacgtcacacacgcctcctcctcctcctcctgcgagccagcccagccactgggagcgcccgcggaagcacagagcgggaggagggatcgcgagatggactgcaaggatgtcgggatcctcgccatggacatgtacttccctcccacctgcgtccagcaggaagcgctggaggttcatgacggggccagcaaggggaagtacacaattggtcttgggcaagactgcatggccttctgcagcgaggtagaagatgtcatctcgatgagtttgacagttgtcaaatccctgctggaaaagtaccacatagatccaaagctaattggccgcctggaggtcggtagcgagacagtgatagacaaaagtaaatccatcaaaacgtggctgatgcaaatttttgaggaaagtggtaatactgacattgagggagttgactcgagtaacgcatgttatggtgggacagctgccctgttgaactgtgtgaattgggtcgaaagtcgatgctgggatggacgctacggccttgtggtctgcacagatagcgcggtttatgcagagggaccagctcggcctacgggtggagctgctgcaattgctatgcttattggtccaaatgcacctatttcttttgaaagtaaatatagagcttctcacatggctcatgtttacgatttctataagcctgatcttgcaagtgaatacccggttgttgatgggaaactatctcaaacgtgctaccttatggctctggattcgtgctatagacagtattgtgccaagtatgagaagctagtgggagaacaattctcgatttctgacgcagattattgtgtgtttcattctccatataataagcttgtacagaagagttttgctcgactttactttaacgatttcatgcgcaattgcagttcggttgataatgatgctaaagaaaagcttcagccttttgcaaacctgactagtgaagaaagctaccaaagtcgtgacttggaaaagggctctcaacaactggcaaagcatttgtatgacatcaaagttcaaccgtcaacgttgcttccaaaacaaattggtaacatgtatactgcatctctgtatgctgcattggcatctgtaatctacaacaagcatgctagtctgaatggccaaagaattgtcatgttttcttacggcagtggcttgacatccactatgttttcattcaaactaaatgagggtcagcatccctttagtttaacaaatattgcttctgtgcttgatgtggcggcaaagcttgagtcaagacatgtgacttcacctgagaagttcatcgacacactgaagctgatggagcaccgatatggagcaaaagattttgaaacaagcaaagacataagcttgttgccaccaggaacgttctaccttacaaaagttgattcaatgtacaggaggttctatgaaaagaaaaccgatggcattgttgacggcaaaatcaagtgcagcaatggcattgcaaatggccactagtggcatatcatcagatactattagtccgcattgcattttattagccatcatccttacactttgttgtatttatctctagaattcccagtctagctaagtttcaaataacccattattctctaaagttgttttccccacactcttcagcttattttttcattgttgagctgaactgaaaccttcgtgtagtacctcattcttgttttcctctagctcgctacctttgatttaattattttgttgcttgtgaccacttactgttctgtgatattatcagtgaattgtggcagtaggca

SEQ ID NO: 20 - DNA, 831 bp, Hordeum vulgare
aaaacaagccaatcaaacaagctgctgggtcgtttcctccatccattccgcctcaacatggctcttcaggtgtggatggtcggggagaacggcgaggacctcaacaaccacagggagctcctgcctctctccaagctccaagagattggcgtgttatattggcatttggacccaaagaagtccgaaagtgaacaagagctagcgaaaatccgcaaagacaagggatacagctacatggattatctggatatatgccctggaaagttggcaaactttgaggagaagctcaagaatttcttcacagagcacatgcatgccgacgaagagatccgctactgcttggaaggcggcgggtattttgatgtgcgcgacaaggatgacaagtgggttcggatctggataaaagaaggggatatgatcgtgctgccggctggaatttatcatcggttcaccctcgacgccgccaaccatgtgaagctcatgaggctcttcctcggagaaccagtgtggaccgcccacaaccggcctcaggaggaccatccggtgcggcaagagtatgtcaagaggctcacggacgacaatgctggtcatgctttggcagcacattgaagttggtttgtgatccctcggctatgtattataaacgcccatggacatatacatacacttgaacgaaaccatgttgtaatcttgaaaccaaatagatacgctacctacttgttattattcacttgtaattgcccgtgtgttgctacgagggcataagtattctagtggttcaacattaatcgtgtcaaacatatacttttagaattcatgtggacatttttt

SEQ ID NO: 21 - DNA, 1733 bp, Hordeum vulgare
tcctccggtccgccggccgccagtccatatcccctaccgcctaccgcacgtcatccggcctccgcttgatcagccagccgccccactccaccctccactgcggcacgagctccctcccggcgatgtcgtggctcgcgcgctccattgcggccaccctctcctccgcccccgacgacgacggccactccgaggcggcctccggcgacagaaccccggatcacgccgccaacgccgaggaggacgagcagccggacacccccggccgcggggtcaagggcgacatctccgagctgaccgagtccctcacccggcgcttctggggcgtcgcctccttcctcgcgccgccgccggcggccggggccgaggcgtcgacggcggcggctgagacggaggcggacgcggagggagagtatgggccccagtccccgcgggtcgccgggatccggaacgacctggctgagatcgggggcagggtgaggagcggcatctcgatgctgtccaacgccaacgccgtggcggagatctccaagatcgcctcctccttcctgcctttcgcgccggaggaagaggaggaggatgaggtggatgcggtgggtgtgacggaggaggtggtggtcttcgtcaggcacatctcgacctctcccgagacttggctcgatttccccctcttcgtcaacgaccggcacgccgatgattttgaactgtcagatacacaatatgaacatgcattggctatagagcgtatagtaccaagcttatcatatctcagaaccgaactttgttcgaccaatatgagtgaagcatgcttttggaagatctattttgtgcttcttcactcaaagctcaataaggaagatgccgagcttctttcaacgacacaaatctcggaagcaagagaagagttattgcaaagctccccaaggatgaaaaatgtatcgtctgagggtcctgggtgctcatcagaaagcagcaatgttccatctacccaagctgaagatatagagttctcaccctcgagcatccaagacaagattggaacggctgaagcaacatctttccaagaaccaacccctgatcctctgccagcggctgaggctgacaagcatcccatttcaaccagcgagccggaaatagttgacaagtctgtaatcgaagaagagctggtggccataactgaaatcaagaatccgggtgacaaacccaacctgtacactccggatgatgacgacgacaaagaagtggaggattggctagaggatatggaccatgatgacaacaaaaccggcaatatcacttcggttgggcaggacgaagatgtgtcattcagcgatctggaggatgacgatgatgattaagggttggctgatggtatataccaaaacccagtgcctgatacaaacgctgttaaaagaaggatcgtgtctccctagctattacaaagcgaacagcatggaagcagaatcacgacaagtttataagtatgtccctgtggttttgctttctcgattctagttgcacgtttacttgtgtgccatcatggtctgtacatagaaacactagccgcccgtgtgcaactaccacttcttcgctgtgtcgatgcaggattctgattgtagataccacaaccagcgtacgcacaatacggtctacctatcagatatcttgtaactggttaagttcaagcaaactatttttgttttcctttttcaccataggtaaattgcaaaaaacca

SEQ ID NO: 22 - DNA, 1638 bp, Hordeum vulgare
caccaccccctcctcgtgccctccgccgccgccgcagcagcctccgcctcggcctcgaggcctccgccgctcccccccgcgcggccagggccccagaagcttctggaacaccccgccccccgccgcaatgcagagcgcggcggccatcgggctcatccggccatgcgccgcgcggcccatcctcaagagccccagccccggggccgcccgcctcccggcctcccgcgtggccctccggctctccgccgcggcgccccgcgcgcgcctcgtggccgcggcggggctcggccgcatcgggctcgtgccggcgtcgcccgagcaggagaagaggagcggcggcctcgtggccgccgcggccgccgggaaggcggcgccgggcgaggaggccggggaggaaagcggagcggcgctcgccaagacgctccagctcggcgtcttcttcgggctctggtacctcttcaacatctacttcaacatctacaacaaacaggtcctcaaggtttttccttatcccattaacatcacaactgttcagtttgctgtgggaactacgatttccttgtttatgtgggccacgggtatccttaaaagaccaaagatttccggtgcacagcttcttgctatcctccctctggctattgtgcataccatgggcaatcttttcaccaacatgagccttgggaaggttgcagtgtcattcacacatacaatcaaggccatggagcctttcttctcagttctactttctgcaatgttccttggcgagctgcctactccttgggttgttttgtctcttcttcctattgttggtggtgtggcattggcatctatttctgaagcttcttttaactgggctggatttttgagtgcaatggcttcaaatgtgaccttccagtcaaggaatgtcctcagcaagaagcttatgctgaagaaagaggcatctctggacaacatcaatctcttctcgattattacagtcatgtcattcttcctcttagcccctgtaaccttgttgacagaaggtgtcaaggtcactcctacttttctgcagtctgctggtctgaacctacagcaagtgtacacaaggtctttgattgcggcattctgtttccatgcataccaacaggtgtcatacatgatcctcgcaagggtgtcaccagttacccactcggtaggtaactgtgtcaagcgtgtggtggtcattgttacatccgttctgttcttcaagacccccgtgtctccaatcaactctatcggaaccgcgatcgctcttgcgggagttttcctgtactcacaactgaagagacttcagcccaagcccaaggctgcttgattgcattccgtttgtcaggatcaatagagcgttgccacactcatggaatcggtgctttagtttagccggacatattgggaagccttgttgagtaactagtaccgcgaaggatcatttgtaattcagtaatgagcattttgaccaggaaagttttggaatctatttcatggttctctacttggacgttctagttgctactttaataaaacctctgcagtttgatcgtgccgtgattaggtcaccgatatctgtaagggttcatttctgtcaggtcaccgatatccgtaagggttcatttctgtccc

SEQ ID NO: 23 - DNA, 726 bp, Hordeum vulgare
ggccttctcccccctcagcccacctcccctccccggcgccgccgccgcagcaagatggtgaagggacgcaccggccagcgcgtgaggctctacgtccgcggcaccatcctcggatacaagaggtccaagtcgaaccagtacgagacggcgtcgctggtgcagatcgagggggtgaacaccagggaggacgtggcctggtacggcggcaagaggatggcctacgtctacaaggccaagaccaagagcaacggcacccactaccgctgcatctggggcaaagtctcccgcccccacggcaacaccggcgtcgtccgcgccaagttcacctccaacctgcccgccgaggccatggggaaaaaggtcagggtcttcatgtacccgagcagcatctaaaaggttattttcaagtgtggaggatttcactcgtcccttaggttttcatttcgagtcttgtaagatggattcaggccgggatagcgagttgaactgctctttccgtgtgaagaactttagttttcatgttatcttgaacgtgtggatctcacattatatgatgttatatgtagttcgaacctgaagctgtgttttgcccacttctttttgcgttctccttgcaattttagctatcaaatctgattcagaaatgtttttactcttcttttattaatgtttgtatgcccttttgatgattggtggcaaggggttaatttattttggctaggcacc

SEQ ID NO: 24 - DNA, 771 bp, Hordeum vulgare
ctctctcagccccctactgctcgaaatccagcagcgacggccggcgcatctcaccctgggccgacgccgacgaattccgaagggaaccggagatgcagcagggcgatggcacggaggcgcaggtgacgtgggatgaccagcagaacatcaaccggttcggccgcctcaacaaccgcctccacgagctcgccgacgagatcaggctcgccaaggaagcaaatgaaaaccttgaggatgcggggaatgaactcatcttgtctgatgaagatgtggtgcgtttccaaattggggaagtgtttgcccacatgccagtggacgatgtggaaactaggctagagcagatgaaagaggatgcggctaagaagttagagaagctggaggaagagaaggaatccatccttgcccagatggccgaactgaagaagatcctctacgggaaatttggagaggccatcaacctggaggaagattgatgtcgagaaccggagctgcctttttaggtgtcgggtcgtatgacacctgttcttgttcaggtgctttgttcttctcgctacattgtttctcgtgatgattgttccccattatgcattggcatggttgatctcggttggactatagattggggctggttgtccagcagaagcctggggagagtagacgtaaatgggcacttgagaaaccaatgaggggatgtttacaatgttttaagctagtgagtatggtttgaacctgcatgattgtattacatgaagtcattaggctttacatgta

SEQ ID NO: 25 - DNA, 2075 bp, Hordeum vulgare
ggtggagagagacagactggtagctggctgcagcagcagggcaatggcgatctgaaggccgtcacccgccgcccgcccgccggaaagctcgacgggaatggagcggatcctcaagtccgccagggagtccggctccctcaacctctccaaccgcgccctcagcgatgtgcctggggaggtgtacaacaacttggacactggcagcttggacgacaaatggtgggagggagtggaccttcagaagctcatactggcccataacaatctcgaagtcttgagagaagacttgagaaatctgtcttctctcgtcgtgttaaacataagccacaaccagatatcttccctccccgcagccattggagaccttcctttgttgaaatcgctggatgcctcgttcaatcaaataaaacttatacctgaagaagttggcttggctagtgctttagtcaaggctgacttctcaaataattgcctcactgagctgccagctagccttggcagatgcttgaacttgtcagaactcaaggcatcgaacaacaacatatccagattgccagatgagcttgctggctgttgcaagctaagtaaatttgatatggagggaaacaagcttgtgctacttccagaaaatatgttcacatcatggacactgctcacagagctgaatgccgcaaaaaatcaacttacgaccattccggctagtatcggagcactttcaaagttagttcgaatggatctgcaccagaacaagataacttcgattccttcttccataaagggctgctcttctctagctgagttctacatgggaaataattcattgtcgacaataccagctgatattggcatgctatcaaaattaggaacacttgatcttcactccaatcagctgaaggagtatcctgtgggagcttgcaaactcaagctcagttttcttgatctgtcaaacaacgcattatccggcctgccacccgaactaggtacaatgacaaccctaagaaagcttctgcttagcggaaatcctatgagagcacttcgtagttctttggtttctggaccaacgtcaacattgatgaagtatctgcgaagccgcctttcgtctgatgaagaagcatcagggtctagaaccaccccaacaaaagatgaccagatttctgcagcaagacgattatctgcatcttcaaaggagttgaatttgagtggtcttggtgtgcccaatgtaccccctgcagcttgggagacaagtgatgtggtgaaacttgatctttctaagaacttgatagaagatctgccaaatgagttgtccctgtgctcatcacttcaagctttgattctgtctaataacaagataaaaaagtggcctggcatggttgtttcctcccttcccagtctcacttccttgaagctggacaataatcctctagcagcgatatcgtccactgatgtcgagtctctatcaaaacttgaagttcttgatttaagtggcaatgcatcctcattgactgaaccttctgtgatttcttcattaccacaactgcatgaactctatcttaggcgaatgaaactccagggatttcctattgggctcttccagttaaaacatctacggattcttagcctcagtcagaatcatctcacaaccatacctgagggtatcaaagattttagtgctctcgtcgagcttgatctttcagacaacaatataacagcgctcccagccgagctgggtctgcttgagcctagcctgcaagtgctcaaacttgacggaaatccccttaggagcataaggcggactgttctggagcgaggaacgaaagctgttctcagctatctcaaagaaaagcttccatccaactgaataatatcatcatatattctggctggagttattcccttggtttcccccctgccgtgttgaataagtttcctgtggttgaagtgtactgaattgtcttgtgtgtgcgcacgcaagagaaagatgggttgccatatgcatattacaatatttattaggttgacacaagattatgtgatttgtattttataattcgatggtgttggttggctgaaatatc

SEQ ID NO: 26 - DNA, 706 bp, Hordeum vulgare
ccacagcctacggagcaaaacacacagcacaactagacaccttttttttcttccccgtccctgctcaaatcctccacaaatccattaaccatgggctccctgacaagcagcagcaccggccggaaaagcaccgtggagagtgtggacccggaggcggcgtgcgcgctgctggcctcggagcagtatgggtacgtggacgtgcgcatgtgggaggacttcgacaaggggcacgtcgccggcgcacgcaacgtaccatactacctctccgtcaaccctaacggcaaggagcgcaaccctcactttgtcgaccaggttgccgcgctctactcaaagcaggatcggttactcgtcggctgccgctccggggtccggtcaaggctcgccactgcagacctcgttgccgccgggttcactaatgtgaagaacctggagggcggctacctctccttgctcaagagcgcaagctacccgcagccgacaaccagccacccctgatccatcaattctatatctagaataaatactacggtgtattatccatcgtattatgaagaagacgacgaagaagcgtcttcagagccgaggaggaattattacttttcatgggaaataaggcagtgtggatgtatatcagtatatgcatttgcatcctatgttctggacttgcatccgactataatagtgattttccattttatgaatgtac

SEQ ID NO: 27 - DNA, 1185 bp, Hordeum vulgare
gaaagggattgattgatccagcgggcgacggcaggcagagtcgcagagaaggcaagcgtccgtcgggctcgagcgagcgagcgagagagagagggcagcatgagcgagcagggggcggggcagggcagcaaggaggagtcgctgatggacaagatcacggagaagttccacgggtcgtcctcctcctcctcgtcgtcggacgacgaggcggggagggccgccgggtcgtcgtcgtcgtccgtcaaggccaagatctaccgcctcttcggccgcgagaagcccgtccactccgtcctcggcggcggcaagcccgccgacctcttgctgtggaggaacaagaagatctctggcggggtgctcgcgggcgccaccgccatctggctgctgtttgaggtcctggagtaccatctcctcaccctcctctgccacggcttcatcctcaccctgggcatcctcttcctctggtccaacgcctctgccttcgtcaacaagtgccctcccaacattccagaggtgaagatccctgaggacctggcggtcaatgttgcccgctcgctgcgctatgagatcaacaggggctttgctagcctgagggccattggccaaggccgcgacctgaagaaattcctgattgtggttgcaggcctgtggatcctctctgctcttggcagctcctgcaatttcctcaccttgttctacatagtcttcatggtactctacaccgtgcctgtcctgtacgagaagtatgaggacaagattgatgcttttggagagaaggccatggtcgaactgaagaagtactacgccatcttcgatgagaagtgcctgtccaagattcccaagggtccgtccaaggacaagaagcagcattagaacagtagagattaccctgcgcagatttatcttcaaagttgatcactactcgtcggttttcaaggatggttgtgaacttgtgattccatgtccgtaggtgatagtagataccactatctggtcaaaatcctggcacggtcattagtgtgacgtgcaacttctacgaacttagtaatcatgccagcttttgctcaatatcctcacttgcaagttgtgttggtgtaatatggcagtgatgtttgtgacttcaggagacttggtacaatgaagtggctctttgggtgtgtcatcattcctggggtttatgtcgtt

SEQ ID NO: 28 - DNA, 1570 bp, Hordeum vulgare
gttgttcctggccagacacgtatatcggccgctacgtccaggtcaacaggcagcgggggagactccgactcggcgagagatcgatggagggttgtcgtggccggccatggaccaggctaccggcgctgctgctggtggcgctggcctgcgccgccgccgccgccgtgggagagtgtagggtggtgcacgtgggagaggcgcaccggcggagcatgttggctaatggcctcggcgcgacgccccccatggggtggaacagctggaatcacttcgcctgcgacggcaacggcgaggttgtcatcagggagaccgccgatgcgcttgtctccaccgggctcgcagctgccggctacaaatacgtcaatcttgatgattgctgggcagaacctgaacgtgatgcaaagggcaatcttgcggcgaacaagaatacgttcccccacgggatagaggcactcgcggactacgtccacagcaaggggctcaagctcggcatctactccgatgctggatacaagacctgcgccaaggctcaacccggatccctcggctacgaggagcaggacgccaaaacctttgcttcctggggagtggactacctcaagtacgacaactgcaacaacggcgacacgaagccgctggagaggtaccctgagatgagcaaggctctgatgcaggccggccgccccatcttcttcaacctctgcgaatggggcgacatgcacccggcgcggtggggcgcggcgtacggcaacagctggagaaccaccaacgacatcgaggacacctgggacagcatggtgtccagggcggaccagaacgaggtgtgggccgagtacgcgcgccccggcggctggaacgaccccgacatgctggaggtgggcaacggagggatgaccaacgacgagtacatcgtgcacttcagcatctgggcgatctcaaaggcgcctctgatcatcgggtgcgacgtgaggcacatgtcgcaggacacgtacgacatccttgccaacaaggaggtgatcgccgtcaaccaagatcctctcggcgtccaggggaagaaagtgaggatggaggggagcagcgagatctgggctgcgcctctgacggggtacaggacggcggtgctgctgctgaaccggcacgccaaggacgaggcccagatcacggcgcactgggacgacatcggcctccccgccggcaccgccgtcgaggccagggacctctggctgcacaagacgctcgagccaaagttcacagacaagatgagcttcaacgtgacgccgcacgcggccaggatgttcgtgctcacgcctctcaagtctcagctggattaaggaaaaacgacatgggttgatgcccgttccgtaattgattatgagaaatacatattttctctatttttccgtaatagtagtaatttggaagtgttttttaacgtgtaatattttgttgagaacctttggtgtatataataagtaccgtgcagccggtgagcaatctccaaatcattaggatttttttagtgtgtaataagctcgagcgtttatctcttacttgctcaacataatcaacg

SEQ ID NO: 29 - DNA, 1382 bp, Hordeum vulgare
caagcgggcagttggagccttggaggggatggaacgcttccggttcaggtcacctcccctctcgctcaagctggccttcgccgccgtctccttcgccgccgtctcctgctcctcctcctcccccctcccttcctcggccgcctcctcctctccgcgtccgtctccccgggccgtagccgccgacctcctcgccgtcctcgccggcccgcgcgccgcggcgcgggtgccggccggcgaggcctctcgcctgaactcctgcctccggttcctctccccggtaaatcctgccgccacatctgcggcatacccatggaggggctctcgaaaggtcctactggaaggctgcgatgctgccgaggcggatgcgatggtgatgtggccgccggcgccggtcttggagctggcgcgcatcgccgtcgactccggaggcgaccccggggccatccaccgcttgctcgaccccaccatgctgccggtgcctgatgtcgagggaacgaagaagagcaaatgccacctcacaagaacaccgtatggaagacgctttgctgacgaggacatcaattcatactttgcatttttgtttgaattgattgctgcgcgaggaccatcagttggattaaatgtatcgctgaatcggtatgatttgttccatgggcatcttttcctggcatctggtacaggaagacttgggattctattccatgcgaaagaatatccagcattcgacaagaaatcattcccttacaatttgggatattgccaggctgaatctgatgtaccgtatgatgattccatgaatttacgtaatatcctttggttagctccattgccgtccagcgagacgaaagcttgggcagcaccaggagtgttagtcgtcttggatgcacatccagatggaattatttatcaagatctgatacgcgactatgttcagattgtgcgaacaatatacgaagatgattttggaaagcatgccgttgatgtcaactatctgaatgttgccaacgcagcagctccagcggatagaattttcatttgctgacatgttttctccaccgtgtggtcaaacaccagtaccaattcttacaggatgtaatcaaggtctgcagtgatttgcgagcaagtctcctgtatagttccaagtgtttatttctgagacggtttcagatgtttatttgattgagggcgtgtttgggaccgctctgctccatcaaaatcagctccgcttcgccaaatccattttagagcagttttatataaaagttgcaaccatttcaagagaatgtttggctctcatttagctccagcttcaccaatgaaaaatttggtggaaaggacctatttgattgcatgagaggtaagaaacgaaggggtatccactt

SEQ ID NO: 30 - DNA, 848 bp, Hordeum vulgare
tccgaaacgataacggaacttgcagggaggacggacatggcggcgaggaacgacaacgagtcggacggcgacgtggggaccaaccccgccgaggggggctcctccctatccctcccgcctcttgccgccggtccagccgtatgcgtcctcaggtccgccggggacttcgccggcggcgccttcgtcggatctatctttggatatggacaaggtttgctaactaagaagggcttcaagggctcactcggcaatgcagggtcttctgccaaaagttttgcggttctatctggtgtccagagtttggttttgtgcttgttgaggaagctgcgtgggaaagatgatattatcaattccggcattgctggttgttgcacaggtcttgctttgagttttccaggtacaccacaagcgctgcttcagaattgcgccaccttcgcagcattctcgtgcatcatggaggggttgaacaagcagcagaccgcgatggcgcacaccctcgctgggaatgccttgacaacctttgcgcacgacaagggcggcgtcctccctcctttcactctccccccgatcctcgacgtgtcagatgctttctcttcgtgctgccaggccttggtcgttaatcctaagaagcactagacagcatcattaggagggagagggcgagatatgctcaggaaacctagctagctcctagcgtaatgtaaattttgcttttggataatgtcgaaaacctagattgtttgctttttggccgggttttttttgggcgccgcgttttcgtggcgtgggctttctttgttgatgacatgtcaaggatagattttgctgacctggaagataagatgtcg

SEQ ID NO: 31 - DNA, 564 bp, Hordeum vulgare
gccgtaacaacccgctatctcttcttcgccctcgcttcggtcggtaagctggtgccacgatcctcctcctccgccgccgccgcctcctcgctccggcgaccgcttctctgactctgactcctgacagcttgcggccagcagcgccgtatgaagttcgcggggtggtacatgaagatcgccgtcggcggcgcggccataggcgccgccatggagcttttcatgatccacaccggcttctatgagaaggtaacggtactggagtcagagaaacgagcttgggaaagcagtccagaagcacaagctatgagagaagccttgaatccatggcacaagcgtgatgaggaagagaaaaaatagggaatgataggctcatcggtcctcctttcaagtaattgcattcccacccttccaatgtatcgtaatcccttgaacgaggtaatgcggatgtggcgtttttatagctgttgaaacatttacgttgctggttgatagcttccagcaatgttctaaaggagttatgcccatgtcagatccatatgtctacttgctaacaaggattctttt

SEQ ID NO: 32 - DNA, 1884 bp, Hordeum vulgare
ggtagaaagaaacccatagagacgcccaaaccctaccgcgcgcctcgcagctccccgacgccgacacccagcagcagccgccgacgaggacttctccgcctccgccgccccctcttcgcgtctgtctcgtggaagccttattgctgatttgttctcagcatgggcaagtccaaagacaagaaggcttcgcgggaagccaaggtcgataagaagctggcgcttgggcttggagtgaagaggaagctgctgaagaagaagaaggacagagttttagatgctgcggttgagagcgagggcgctgccggacatgctatcgtggaagacaaaggaagcaagaaaactgtattgatgaagcaaaagaagaaaactaagcatgccaaagtaataagcagtcgttccaaggcggataatttggtgactctcaatgaggatgaggcaacgcctaagctgaagaagaagaacaaaaagcagttaaaggaaagcaaaagtcctatcgaggtacaaagtccgttggatagtaatgatgctggaacaatgaagctgaagaagaagaaaaagaaggcgaaggaagggaagagctctgttgagcccaatgatgcagatgctatccttcatgaaaacctagataaagaaactctaaacactgacgtcaaccaacttgcggcagggagtgaagttagggatattgggaaaccagaaaaggcaaagaaacgaaagaaaaataagacaactgatgtccaccaagttgcggcagagagtgaagttatggatattggggaaccagaaaaggcaaagaaacgaaagaaaaataagacaaagaaagtaaagcaatctggggaagtcaacaagatagatacgcaggtatcagttagagaggacaatttggagatgcatgaagttgacaccgcaaatgttgatgagattgcatcagttgatgaagactgttccagaggaatgcaaaaatggatcttggagtacagacagaagcggccaggcttgaaagtcttgcagcaaaatatagatgtgtttataactgcacatgaggaacaacaagagcaggagaagaaggaaagagaggcagcagctgcagaagatgggtggacagtggtgatgcatcataaaggtaggaagaagactacagatgctgaaactggaacagcggttggctctgtatctctggctgcaatgcaagagaaaatggctcagaagaaacccaaggaagttggtcggaacttctacagacatcagaaacgagaagctcaaatgagtgagctggcgatgctgcagagcaagttcgagcaggacaagaagaggatacagcagctgcgggcgcaaaggaaattcaagccttacggattctgaaggggttcctccacagaaacgcagcgttcgttcgacattactcgagagcggccagcagctggcgccgaaaggctttgcttggttgcactgtattccttttttgacaggaaatgttgcattgttggacaaatgtactatgcttcttgactgggaatggtgccagtcgtgtacaatggcgtgaacatttgcagcatttcctgtcaaatttttgtgtaccaattcatgtgcggttctttgccgccttgtagaggcgccgaggaagtgaaggtggtcggtgagacagacgcttaggttcctggggatcatgatacctcggcagtcggcgcccgtgccgtgtctcttgtgctttaggagcaactctagcagatctcttgtgctttagaagcaactctagccgatgtgctaatttccctacctacaaaatcgttttatggttggctctaaaatgattttgctggcagttcatctccggcatagttaaaaacttgggtttttatcatttatctcactactcagttttgc

SEQ ID NO: 33 - DNA, 3609 bp, Hordeum vulgare
gtgacgggagacgtcggggccttctcccggccaattcggtagaacagccattagtgctggtgtctcctatataaaccgactaataaaatcgtggatttgccccgtttccaacgttcatccttcccgtcgccttgtctcctcgcagatttctccccccaaattcgcccccttcccagccccattcgccagccggtgttccttccttcctagcgatttgttctgccggcggcggcgacgacagtgcgggacacggccggccagcctcactggatactggcactggaccggcgattgatttcttccttcctcggtaaggagccctaagcctggccggacggattgctcaagagctctgttcgcttccttttgccgtggcagctagcaatccaaatccgaaccattctttctccccattcagttcagttagttgccgatttgtttgctgactggtacccctatcggtctcatccatccgcccacgcctcgatttgtaccgcgcgatgtcgatctgagcggcccctacgggatttacccaggagctgcgcagcttatttttccaaatgattgggtctttgctgaatttccaaacgattccttgttgtacccgagccgtactgcaagtgtatcattgaattgggacaagtgaccgtggggtgttcggttttgtacagccactttgttgttttccctactatattcaagttctttgctttgttttttaaaaccaggtccccagtttcggacagtaggactgatatgttaaatctgatgttaagcctattgtcagcaataagtatttggcatgctcttcttcttccaacattcttagacggccaatctcacaaaatcctgttcaatttctgacaataagatcgcactttcatatctggttggtacaccagagttaagaagttaaattcagtgatgtctttcagcgtatgaaatggcacttcttggggatgctactgcttcctgttccatgccattaagtaatatcaaacctatttttttaacgacaattgatattattagtaatttagaacctatgaagtggagccttggcgcaacagtaaagctgttgccttgtgacctcgagtcctggaaacaacttcaaggctagtacaatagatccaaagtgtttggaccctgcgcaagccggagctacatacaccgggctgcccttttagcaatttaaaacctacattacacatttccttattcttacaaaagaaaacacgcaatatttcggtagatgcttatgcaaattcattttttatgaaacctgcaaatagttcttatttaagcaccatcaattctctacctttccccgattgatgttatcatcaatttgatggaagtgccagtatcgtttcatcttatgaacgccacaatgccatacttgcagtacaatagcagtactactcgtttccttataccttaaaaggaccctcatactttgttctctctatcatgtcactgcacttttttcttcctttttgcatcatttgaccaaaagtttgaagctcatgagcttgctagtctagaatgaaataaattggaaagctgatatggcagtttccagcaaggccattttaaggtgcactgcaatggtttgatgcttattttcgagttcctattcttggtaaaagtgacaacattttgcaatgcattatagcataaccattgatacaattttcctatcaggataagcattgatcctggatttagctatttcttatgtgataagcagataagctgcaatgaaggattctcaggtgaatttgcttgctagtattatcagttgtcactgaaaatcctattcgtaactatctttaacttccagcgtaaaattatgtctggttggttgaaccagatggtgaaagtgcatagaatttttattcaccagattagagagtgagatgattatacattctgaattgcacatgaaccagagttttgctacagcttttgttggtaactggtaacaaattacttctatagtaatgtggcgaatataggattaaacattaacacataatatttgtgagagaattgttcctcaatgccaaggcatctttttcttcttcttcttcttgataacacttataattgactgttactgttttcagtatttttcttttagcaggtgattgatttatgttacttatggacatttcctacaggatattcagagcacgacagagttgcagatgtcaccccaaggtactaatgaagtgcaaagtaaccaaccaaacacaatgggcagtgatgctcctgcaggagattctggttctttggtagtcgctaacagtgataacagaaaagtctcccgcgaagacattgaacttgtccaaaatttgatagagcgctgtctgcagctgtacatgaccaaaggagaggttgttaggacactttctactcgtgcgagaatagaacctggctttacaactttagtatggcagaaactcgaagaagagaactctgaattctttcgggcttactatataagattgaaattgaaaagacagattgtgttgttcaaccatttattgcagcaccagtataatttgatgaaatatccagcacctccgaatgttccgctggctcccatgcaaaatggaatgcatcctatgccagttaacaatctaccgatggggtatccagtacttcagcaacctctgatgcctgctcccggccagcctcacattgatccgatggtttgtggtctatccagtggtcatgtagtgaatggaatccctgcaccaggtggttatcatccaatgcgcatgaactctggaaatgacatggttgtggacaacggtgcacctgaagctgcacatgctggtgctatgtcatctgatatggctgtgagtccctcatcagcagcatcaaccaaccatgctcctttcactccatctgagataccagggatggacatggatacatcagccctggattcaccatttggatctgacatggggaacacaggacctctgcaattaggggcagatgggtcgtcaagggattccatccgatccttagggcagctctggaatttcagcctctctgatcttacagcagatttgacaagtttaggagacttggaggctcttgagaattacgcgggtacccctttcctgccttcggactcggatctcttacttgattccccagaccatgatgacataggcaaccatgatgacatagttgagtactttgccgacgccatcaacgggtctcagtcggatgaagagaagccatagagagcagactcaagtagtcccattgagacttgcacctggttagagcgtctatctcatgtagtgtgatcttggagccgcggcataccgcggtgatatcagactgggtattcgcacagaggtgtggtagttcggtgcgtcactaaagaattttgtagtggtggtcaatgctaattctttggaataatcagttgaggcagccttgagaggataaagttgctgtctacaaggctgaaaagtagagagagagaaaatcgtgtggaacctcaggaacaaaacaagcctttgtaattgccgaacaaagtggacggtttatctggtgttgcagcatttccgtgtcttccaggtc

SEQ ID NO: 34 - DNA, 4447 bp, Hordeum vulgare
tttattttacccaaacagcccctcgcctccacaagccaatcgtccccgtctcgccctccgcctcgcgccgcctctcctctccccctcccctcccttcccctggtggtgccgaggcttccgcggcgcctccgcgggcggcaggaatatggcgggcaagtccaagggtgcgaggaacaaggccaaggcacaggccgccagccaggatgccgtctcggtggagccggcggtgccggtcactgatgtggtggaggaggccaagcccgagaacggggaagtgaccgatgcccctgctgccgaggtcgcctctgctggcgaggcagtcgctgcggcggacgtggagaaggaggaggggggtgcggccgaggccgcacaagctgcagagaagccagctgaaggagagcttcatctataccctgtctctgttaagacgcaatcaggtgaaaagctggagctgcagctaagccctggagattctgtcattgatgtcaaacaattcctcttggacgctcctgaaacttgcttctacacatgctatgatttgatattgcatactaaagatggctcaacacaccagttagaggactacaatgaaatttctgagattgcagatataactgctggtggctgttcgttggagatggttgctgcaacatatgatgagaggtctattaggtcgcatctccgccgtgtccgggaattgctctctctttctagtcttcatgtctcactatcgacatccctagctttgcagcaggagtccgcacaggcaaaaaattcagatgcaggaaaaacaaaaaccgctcaccaggagcttgatggtttgaatttcatggaggatactactgtagctcttactaatttgctggcatctgcaccagcagaaatcaaatgtgtggacagcattgttttttcatcattcaatcctccaccaagttataggaggttacatggggatctcatctatattgatgttgttacattagaaggaagcaaacactgcatcacagggaactccaaatctttctatgtgaatgctagcaatggaagtgttttggattcaagacctttgaaacaatctcacgaagccagcactttagttggcctgctacaaaaaattagtgccaagtttaagaaaggctttcgcgaaatattggaccgcaaagcatcggcccatccttttgagaatgttcaggccttgctcccagtgacttcttggttgggagctcaccccgtgccagaacatagaagggactcagccagggctgaggattctgttgtgctgtcatatggtaccgagttgattgggatgcagagagactggaatgaagaattgcagtcatgccgagagtttcctcatgccaatcctcaagaaaggatattgcgaggcagagcactctataaagtgacatgcgattttgttgatgctgctgtaaaaggagcagtcggtgtcatcaatagatgtatacctccaatcaatccaactgatccagagtgttttcatatgtatgtccacaacaacattttcttcagttttgctgttgactctgactatgagcaaatctcaaaggaccaaaagccagattgccaaaatggttctagcagaagtacgccagtcccctcacctgatttgggtgccaaggcagtttctggcgtagcacctggttcaaaaactgaagagcctaacagtgttttggaaggacctacagaggcacaaatagcagacagtgagcaggcgacctatgcttctgctaataatgacttgaaaggaacgaaatcttaccaagaagctgatatttctgggctttacaatcttgccatggcaataattgattacagaggtcacagggttgtagctcagagtatcatacctggtattcttcaaggagacaagtctgactcccttctgtatggttctgttgataatggcaagaagatatcttggaacgagtcattccatgcaaaggtagttgaggctgcaaagcgactccatgtgaaggagcatgtggttttggatggttctggcaatcctgtaaaattagctgctacagttgaatgcaagggaattgttggtagcgatgacaggcattatattttggatctgatgagagtgactcctcgagatgctaactacattggactgcagcaccgtttctgtgtgttgagacctgagcttgtagcctcatttgttgaggctgaatccataaagaaatcccctacgcagaaagttccggatgttcccacagaattgaatgggcaagaatctgatgaccaacatgtcagggcttctgatactacggctgcttctgtggaggaaaatgacaagtctgatgaaggccctgcttctgcacctgccgaaagtaacgactcaactgatgaaattcttttcaatccaaatgtatttacggagtacaagcttgctggcagtcctgaggagattgaagcagatgaagctttggttaaaaaggttggttcgtatctgctagatacggtgatcccaaagtttgttcaggatctttgctctcttgatgtctctcctatggatggtcaaactttaactgatgtgctgcatagcaatggaataaacgttaggtatctgggcaaagttgcaggcatgatcaaggatctgccacatttgtgggacttattttcggctgagataattgttaggtctgcaaagcatgttgtcaaggacatactgaggcaaagcccggaccataatattgcacctgctgttgctcatttcttgaattgtttttttggcaaagttttggctgttgcaacaaaaggtactggcagtccgcagtcgaaaacccagaagggccagaaatcaagtcaatcagcttcttcaaaaaagggtcaatctgcatattcccagctaacatctgacggagtttggtctgacattaaggagttcgcgaaacataaataccagtttgaagcgccagatgatgcgagggctggggctaaaagagttgctgttctccgcaatctttgccagaaggtgggaataacaattgccgctcgcaaatacgatctgcattctactgctccattccaatcttcagatatcttgaatctccaaccagttgttaagcactcagttcctacctgtactgatgcaaggaagcttatggaagctgggaaaatccggatggctgagggaactctaaatgaggcgtatggactattttctgaagctttttctctacttcaacagatcaatggtcccatgcacaaggatgctgcaaactgttgccggtaccttgctatggttttgtaccatgctggcgacacagcaggagcaattgtgcagcaacatagagagcttatcataaatgagcgatgccttggtctagaccatcctgatacagcccacagctacggtaacatggctttgttctatcatgggctcaatcaaaccgaacttgcactgcgacacatgtcccgtacactgttgttgctgagtttagcatctggtcctgatcatccggatgttgcagcaactcttataaacgtggcgatgatgtaccaggatgcgagcaatatgagtactgctcttaggtatcttcaagaagcacttaagaagaacgagcgccttttaggcccaggtcatattcaaacagcagtttgctatcatgctctcgcaattgcattcagctgtatgggtgcatacaagctttcagttcagcatgaaaccaagacacatgatatactggtaaaacagttagggagtgatgattcacgaacaaaagattcagaaaattggttgaatacattcaaggagcgagaacagcaggttattgcgcagaagcaaaaaggccaggtaactgccccctctgctaacgctgttgaattcttgaaggctcatcctggattgttccaagcaatgaaggcagctgcaatccaatctggtggtgatggaccagcaaatgtcaacagaggaagaggaggggacgagcgtgctgctaaggcggccgcagaagcccgaaaaacagccgttgccaggggtgttaatctgcgcaacgggcctgctgcgagcgtttctgacatcaatcaaattctcaacctcatcaactctgctgcatctgcatctgctgcctctcctgccgccaatgctcagacacctgaatctgaagtgccgcagtccaatggtactaccctgaatggcgcaaaggaggctaaggatgcaagtcgactggccgctaaggctgacggtcaagccccagtaggattaggtgcgtcattggagctgaagaagcagaagtcgaagcagaaggcatagaaatgaatctgcaatggctgttttctccttgcaattttgaacctctagggtgattattttttggcccatagggattgtcacgtccacatagtggcagagtaattttatttgtggtggggtgggggttcgtagaatgagtgcaataaaaataatagcaacgagaat

SEQ ID NO: 35 - DNA, 2930 bp, Hordeum vulgare
gtgggtaatctccctttgcgcgaggaaattcttgttaggccatgacagtgactctctccgcttctccatcgtggatgccccgtctgtctatatagccgtcatctatctcccacagttccactaccttctgacaccttctcctcctcaaatcccgccctccctccctcgcccgctcactcgccagtgctgctcaccatggatctgtgctaaatgcagagcgagctcgcagactcgtagcgtttctcccggcccggtctgctgcaagatgtaatctgggtctcgtctcacaccctgtggccatctcagtacactctccgactccttcgtgtttccgaggggaagtgaagtgaagtgaatccctttttcggggtcccgaggaaatggaggagagcttcgtgcccctccgaggcatcaagaacgacctccgtgggcggctcacctgctacaagcaggactggaccggaggcttcagtgccggtataaggatcctagcgccaaccacctacatattcttcgcgtccgcgatacccgtgatatcgttcggggagcaattggagaggagcaccgatggagtgctcacagcagtgcagacactggcatccaccgccctgtgcggcataatccactccgttgtaggagggcagcccctgctgatcctcggcgttgccgagccgacggtgatcatgtacacattcatgttcagctttgccaaggacagggccgacctcggtcccaacctcttcctcgcctgggccggttgggtctgcgtctggactgccgtcttgctgttcttgctggcggtgctaggcgcgtgctccataataaaccggttcacccgcatcgccggcgagctgttcgggctcctcatcgcaatgctcttcatgcagcaagctatcaaggggcttgttgacgagttccgcattcctgagagggagaacataaaagcactacagtttgttccatcatggaggtttgccaacggaatgttcgctatcgtgttgtcatttggccttttgctcaccgcgctgcggagcaggaaagcgcgatcctggcgctatggggcaggttggctgcgtggcttcatcgctgactacggcgttccactgatggtgctggtgtggactggagtttcctacataccacatgacagtgtgccgaaaggaatcccgcggcgcctcttcagtcctaatccatggtcccctggtgcatatgacaattggacagtcatccaggatatgcccaatgtgccactcatgtacatcattggtgccttcatgcctgcaacaatgattgctgtcctgtactactttgatcacagcgtagcgtcccagcttgcccagcaggcagagttcaacttgaggaaacctccatctttccactatgatttgcttctcctaggcttcctgacattgctatgtggcctaattggtatccctccatccaatggcgtcattccacagtcgccgatgcatacaaagagcttggctactctaaagcatcagatactccgtaaccgactagtggccacggcacggcaaagcatgcgccagaacgctagcttgagccaactgtacaacagcatgcaggacgcttatcatcagattcagacaccgctgatccaccagcaacagtccgtcaaaggcttaaacgagcttaaggactccactgtccagttagcatcaagcatgggtaacttcgatgcaccggttgacgagacaatctttgacatagagaaagagattgatgatctgctgcctatggaggtcaaggagcaaaggttgagcaactttctacaggctgtgatggttgggggctgtattgccgctatgccgctgcttaagaagatccccacggctgtcctctggggctattttgccttcatggcaattgagagcttgccaggtaaccagttctgggaacggatattgctgctcttcactgctcccagcagaagatacaaggtgctagaagagtaccacacaacatttgtcgagaccgtgccattcaagacgatagccatgttcacacttttccagacaacatatctgcttgtttgctttgggatcacatggatcccgatagctggggttcttttccccctcatgatcatgctcctggttccagtcaggcagtatatcctcccaaagctcttcaaaggtgcacatctcaatgacctggacgcagcggagtatgaggaatcaccggctataccattcaaccttgctgcgcaagatattgatgttgcattgggacacacccagagcgcagagatccttgatgacatggtcaccagaagtcgcggtgagatcaagcgcctgaatagtccgaagatcaccagctcaggtggcactcctgtcacagaactgaaaggcatccgcagtccttgtatttctgagaaggcctacagccctcgcatcaccgagctgaggcatgaacgcagccctctaggggggcgagacagtccacggacgggagaggcccgaccatccaagctcggtgaaggctcaacaccaaagtgaagcagtgatgctgcattgcacatataagctatggcgctgctggaaataaattatatcgataactcgagcatcagtctaatataagatgtctactgatgcggtatgatgccactatatgatggccagtgatgaagtatgaaaataggctgatgtgtatctatctgtagcctcctgatccaagggagtactgtatgtgtaatctctgaatgagtagaatattatagcgtctactttgaagctttttcgagtctcacttttctacgtaactacaaattgttcatattattctttgatttttacaccaaattggtgagtgatgagcatcatttctgtttgcatatttgttgaacttaagtatgagtgctgtggaggcctattactccctccatctcaaaataagtgtcttaagct

SEQ ID NO: 36 - DNA, 2773 bp, Hordeum vulgare
agatgatagtcgacagagtccccaccccacactccctcatatctctccccactctcgcccccgggcgaaatcgacgccacagcgggagggaaaagcttccggggttggcagggactccccctcttatacgcctgcccggcccgccagactcctcacagcttctccccgtgcccgagcggagatcccgagttccggacgccgacgtcgggtggtaggattcggcggccatgtcgtcgggcgccgtgctggtcgccatagcggcgtccatcgggaacctgctgcaggggtgggataatgcgaccattgcaggtgccgtcctgtacataaagaaggagttcagcctggagacccagcccttgatcgagggcctcatcgtggccatgtcgctcatcggggcgacggttatcacgacgttctccggggcggtggctgacgctgttggtaggcggcccctgctgatcgcctcgtctgtcctctactttgtcagtggcctggtgatgctctgggcgcccaacgtctatgtgttgctcttggccaggctcatcgacgggttcggtatcggtttggcagtcacccttgtccctctgtacatttcggagaccgccccgactgacattagagggctgctgaacacgctgccgcagttcagtgggtcaggagggatgttcctttcttactgcatggtgtttaccatgtccctcatgccgcagcctgactggagaatcatgcttggggttttgtcgatcccgtcgcttatgtattttgcattgactgtcttttatttgcccgagtcgcccagatggcttgtgagcaagggaagaatggctgaggccaagcgagtattgcaaagactgcggggaagggaagatgtctcaggagagatggcccttcttgttgaaggattgggtgttggaaaagacacacattttgaggaatacataattggacctgatgatgagctggctgatgacgggctggctccagatcaagagaagttgaaactctatggagctgaagaaggggtatcttggatcgcccgtcctgttaggggcggcggccaaagtgcacttggaagcgctttgggcctcatgtctcgtcatgggagtatggttagtcagggtaaatctcttgttgacccccttgtcactctcttcggaagtgtccatgagaagatgcctgaggtaatggggagcatgcggagcaccttgtttcctaactttggcagcatgtttagtgtggctgaacagcagcaggctaaagctgactgggatgctgagagtcatagggatgatgaagattatgcatcggatcatggtgctgatgacattgaggataacctcaatagcccgcttatttctcgtcaagcgacaagcgtggagggtaaggagattgctgcacctcatggaagcataatgggtggtgtggaaagaagtagtagcatgcagggaggggacgcagtaagcagcatgggcattggtggggggtggcagttagcttggaagtggactgagagagaaggtgcagatgggcaaaaagaaggtggcttccagcgtatttacttgcatgaggagggtgtgtcaggtgatcggagaggctctatattgtctatgccaggaggtgatattcctcctggtggtgagtatatccaggcagccgctctagtgagccaacctgctctttactcgaaggacctgatagagcagcagcttgctggtccagccatggtacatccatccgaggcagttgccaagggtacaaagtgggcagaactatttgaacctggagtgaagcatgcactgtttgttggcattggattacagatcctgcagcagtttgcgggtatcaacggagtcctgtattacacgcctcagatacttgagcaagcaggtgttgggattcttctatcaaacattggactaagctcttcctctgcatctattcttattagtgccttgacaaccttgctgatgcttcccagcattggcatcgccatgagactcatggatatgtcaggaagaaggtttcttctcctctcaacaatccctgtcttgatagtggcactagctatcttggttttggtgaatgttctggatgtgggaaccatggtgcacgccgctctctcaacgatcagtgtcatagtctacttctgcttcttcgtcatgggttttggacctatcccgaatattctctgcgcggagattttccccacctccgtccgtggcatctgcattgccatctgcgcactaaccttctggattggtgacatcatcgtgacatacactcttcccgtgatgctcaacgccatcggactcgctggagttttcggaatatatgctgtcgtttgcatgatagccttcgtattcgtctacatgaaggtccctgagacaaagggcatgcccctggaggtcatcaccgagttcttctcggtcggggcgaagcagggcaaggaagccacagactagttgctctgatccggtgatccgcgtcgctggtggtaattttgtgttgtcataactactactacactggttaacctgcgatgctttggttaagaaacttcaaagggagcagatacgaaagactttacatcgtgaggctgaatcgtgtcgtcgtaggccggcttttggaagtaggatatgtacttagatcatctgttcttttcgccttggaactttgtatttgtgttattcagaatttcttgcccatgtaactagtgctgttatcacaatttatgtcgtttatgtttttgccctgctcggtcggtccagtttat

SEQ ID NO: 37 - DNA, 2321 bp, Hordeum vulgare
cctcggtccatccagttcgacgctctctttctctaacaatggcatccgccgcgacggcgccgccggcggggaagcggccggcgacgggcggccgggagggcgaccagatggtggtcacgccgctcggcgccggcagcgaggtcggccgctcctgcgtccacatgaccttcaagggccgcaccgtcctcttcgactgcggcatccacccggcctactccggcatggcggcgctgccctatttcgacgagatcgacccctccgccatcgacgtcctcctcgtcacccacttccacctggaccacgccgcctcgctgccctacttcctggagaagacaacgtttaagggccgcgtgttcatgacccacgccaccaaggctatttacaggttgctgctgtcggattacgtcaaagtgagcaaggtttccgtcgaggacatgctgtttgacgagcaggacatcatccgttcaatggacaaaatcgaggtcatagacttccaccagacattggaagttaatggcatacgcttctggtgctatactgctggccatgtgcttggtgctgccatgttcatggtggatattgctggtgttcgcattctttacactggtgactactcccgtgaagaagaccgacaccttaaagctgctgagataccccagttctcccctgatatttgcatcatcgaatcaacttatggtgtgcagcaacaccaaccccgccatgtcagagagaagcgcttcactgatgccattcacaacactgtttctcaagggggtcgtgttcttatcccagcgtttgctcttggtagagcacaggagctgttgcttatcctggatgagtattggtctaaccacccagagcttcacaagattccaatctattatgcctcccctcttgccaagaagtgcatggctgtgtaccagacatacataaactccatgaatgaaagaatccgaaaccagtttgcgcagtccaatcccttccatttcaagcatattgaccctttgaatagcatagacaacttccatgatgtgggtccgtcagtggtgatggcaagtccaggtagcctccaaagtggcctctccagacagctctttgacaagtggtgcacagataagaagaacacatgtgttattccaggttatgctgtcgaaggctcgcttgcaaagacaatcatcaatgagccaagagaagtgacactagcaaacgggctcactgctcctcttaacatgcagatcttctacatctccttctcagctcacgctgatttcccacagacgagcggcttcttgggtgagctttgtccacccaacattattcttgtacacggggaagcaaatgagatgggtaggcttaagcagaaacttatcactcagtttgatgggacaaacacaaaaatcgtgtctccgaagaactgccaatcagtggagatgtattttagttctgagaaaatggccaagacaattggcagactggccgagaaggtaccggaagtgggcgactcagtcagtggcttgctcgtgaagaagggcttcacttaccagatcatggcccctgaagatctccgggtgtacacacaactttctactgccaacataactcagcggattgctgtcccatattctggttcttttgaggtgatcaagtacaggctgaagcaaatatacgagagcgtggaatcatcaaccgaagaagatgttccaacactcactgttcacgagagagtggccatccgcctggattcagagagctacgtgacactgcagtggtcctctgatcccataagcgacatggtgtccgactcggtggtggccatgatcttgaacattgggcgtgagggtccaaaggttgttccaatcgaagaagcggtgaagacggaagaagaaacggagagggtggggcggaaggtcgtgtatgccctcatggtgtcgctcttcggcgacgttaaagttgcagaggaagggaagctcatcataactgtggatggagacgccgcacacttggatgggaggagcggtgatgtcgagtgcgcgaacgccgggctgaaagaaaggatcaagaccgcgtttcgtcgcatacagggtgcggtgagaccgatcctgctctcggcctcctgagctgaagccatgagagtgcctttaactttccctagggctcgcgattaagcaaagtaggagtttgtgttaggcgcgttatgcggacattttgttgttgagcgaaatgtaattctactgcctgttgtgctttactggatgatgagtagtagaccctggaagttatctgaacaatcctctcacatgtgttgatcatcagtttgagtt

SEQ ID NO: 38 - DNA, 2298 bp, Hordeum vulgare
gctagtcagccatgtgacactttctttccatacgtgcatgattgcggtgtcctagtcgtaggcggctcagatgatgagcaccgcagcggcagtgccagagggctgaagcgcagacacgcggacggcatggctcggcatgccgtcctgctcgtggtcaccgtcgccgtgctcctcgcgcgccgagccgccgccgagtacccgtggccagtctgcggcagcaccggcagcttcgccgccaacgacagcacgtacctggcgagcatcggcgccatcgccgccaccctcccgagcaacgcctcggcgtccccgggcggcctctacgccacggcgcgggccggccaggtccgcgccctcgggctctgccgcggcgacgccaacgccaccgcctgctccggctgcctcgcccagggattccaggacctgcccagcgcctgcgcctacagcaaggaggccaccatgtactacgacccctgcttcctccactactccagcctcgactcgcgcgcctccgacgacaccgcgtcgggctcggccttcagcaccgcctacagcgacaacgccacggcggagccggcccggttcgaccgcgtcgtggcggcgctcctcaacgccaccgcggactacgccgcgcacaactcctcggcgacgcggctgtatgcgtccggtgtggtcgccttcgaccgggagatccccgaggtgtacagctgggcgcagtgcacgccggacctcacgccggcgcggtgccgggattgcctcgccaacatgatccagcagttggggacgccgttgtacagcgtcggggcgagggttcttgggatcaggtgcagcgtccggtacgagaacaggcccttccttgatggcccggtaatgctgcgcctaccagcaactggagatcccgcgccgtcgcctaccacagcaccggcgccggcgccggatgtggtgcccaatgttgtgacgccggtggcggcggtcggaagagggagaaagtacagtgttcctggtatggtccttatggttgtgctgccaagtctagcagccgcaaactttatcgccggcttatttatctggaggaggaggcggcggtcaccagcacaagcaaatcaaccatatcccagttactccacggaaggtaaggacactgagagtgtagactcgatgctgatggacatttcaactctgcgagctgccactggggacttcgcggaaagcaacaagcttggccaaggaggctttggtgcggtgtacaagggtactctaccagatggcgaagagatagcggtgaagagattatccaagagctcgacgcagggggtggaggagctcaagaacgagctcgccctcgtcgcaaagctcaagcacaagaatctcgtcaggcttgtcggtgtgtgcctggagcagcaggagcgactgctcgtctacgagttcgtccccaaccggagcctcgaccagatcctattcgacactgagaaaggggagcagcttgactggggaatgaggcacaggatcatacgcgggatcgctcgaggcctgcagtacctccacgaagactcccagctcaaggtcgtccatcgtgatctcaaagccagcaacgtccttcttgacgcggacatgaacccgaagatctcggactttggcctcgcgaggctcttcgggagaggccagacgcagggcgtcaccaaccgtgtcattggcacatacggatacatggcgccggagtacttgatgcgcgggaactactccgtgaaatcggatgtgttcagcttcggggtaatggttctggagatcgttacaggaaggaagaacagtgacactttgcaatctcaagatctcttgaccatggtctgggagcattggtcggaccgaacggtgttggagatgatggacccgtgtatgaacaatggcttcttagagagcgacgcgaggaggtgcgtccagatagggctgttgtgcgtccaggagaacccggtggataggccgatgatgtctgcggtgggcatgatgcttggaagcgacacggtgtctctcggtgccccgtcaaagccaacgtctacattttacactaggaacgctagtgccgactctggaaatgggttcaatgtctcgactatttcagtgaatgatggccccaaggatcattctactacgacttaactatagtattgtccatctttctttaggagtttcatcttttggattagttagttggttgtacatctaaaattcaacatatactatcttttgattgcgaaacacaaacacaaggtacctcgagttcaccggctaagggtgtctctaatc

SEQ ID NO: 39 - DNA, 1574 bp, Hordeum vulgare
gggttcccctcgatagcatcccccgaattccacggcctcccctcccctcccctcccccgaagtcaatcaagctccggatcgccgctggcctatccatggcgggggcggaggcggtggagcgggcgcacgagctctaccggggcggccgccaccgggaggcgctggagctctactcggcggcgctggcggccgcccggggccacgcgcagcgcatcgccctgcacagcaaccgcgccgcctgctacctcaagctccacgacttccacaaggccgcagaagagtgcacatctgtcctcgagttggacaccgagcatgctggagctctcatgctacgtgcccagactcttgtcactctaaaggattaccagtccgctctatttgatgtaaaccggctaattgagataaatccatcctctgaagtatatcggaaccttcatgcacgactgaagacacagctgtcactagccccgatcccagagtctgatgaggagtccctgtatactgaagaagacaaagaagatctgccaccaaaagacaatacgaagaatgagactgcccttgttaagtctgatcaaccttctgcaaaactgattcctgaaaataaacctgtaacaaaagctctgaaggttgaagtccttcccaatctacattcaaaacctgagggtaccatacaaaaaccaaagggccattcagagcttgattacaaggaacctttaacggaagctccgaaggttcaagtgtctcccagtctgtacaaggaacctttaacagaagctcggaaggttcaagtgtctcccagtttgccttcaaaacctgagtgttgggggaccatccaaaaaccaaagggccattcagggcttgattactcgaaatgggacaaagttgagaatgattcgagtgaagatgacgatgatgatgaagaagatgacttgcctcgatataaattcaaagtcagaaccatcggtgtgcgtaccgtgaagtgaatgggatcatcgataaataagtttactccatggtctgtgtatagctgtttgacagcatccctgctaactgtggtctcatctgttcggttgcatcttgagatacttggatgaagtgttgccgattggtgggtgaagacatgagtacccgctgctctcgtctcgtgcgctgcagctcaggttttttgaccttagccaaggaaacaagtctggaatgaaatcatgttttcagcgcaaccgcggcaaccgtgggttggagcacacagcacagcatgtgttaatcatgtagggagcccctttagattcgagctaacaatcttagaccattgttcatcttcgttgattctatagcctagcagtctctgtacatagattgcgcattcatcatatgtataaaaagcttatttgtgtcccgccccaagacatcgtctcaagatctcagtcagcaaattgttcaactgcgatgaatgtgctgattagtcgcgcactcacactgtaatcagagaagtttccgccatgcatgtgctccagggcgatgaatattactccgtatgattaagaaggtgtgctccagggcgatgaatgggctgatta

SEQ ID NO: 40 - DNA, 2978 bp, Hordeum vulgare
caccttcccttcgctgccacctcctgccctgcctcttcccctctcctctcctctcatctaccattcctctcccctccccagcataaacacagctcagcaggccccatctccaatctccattccattctctctctctccctccgggccggggcttaaatccagcacggcaattgcctcgcattgttcccgaggactccttggttctggctgcgtcgtaccagggacagggtagcggtgccgttcttggagcgctgttcccgggcagctgcttgaggccagccgtcccgtcagggtgctgttcgccggcggcgaggcaatggggagcggccgcgtctgctacgttgtcgcgtccgtcgtgttgctctggctgggcgtggccactgcgcagggtgactctccttggaagacgctcagcggcaatgctccggcgatcatagccaagggtggattttcaggcttattccccgactctagcgaattcgcttaccagttcgcgatgattgcgagctcgcccgatacagtcctgtactgtgatgtccggctcacaaaggatggccttggcgtctgcctaccagacattaagatggacaactgcaccaacattccagatttctatcctaagggtaagaagagctaccttgtcaatggcgtatcgacaacggggtggttctccgtggactacaacggcaccgagctatcgcaagtgtctttgaagcaagcaatcttctctcgcacgcctaggtttgatccaagcttctttccattgctcgctgtcgaagatgtggcgtccaagtttaagcctcctggaatgtggctcaatatccagcatgacgatttctacagccagttcaatatgagcatgaggaaatacatcctttctgtgtctagacgtgtcatcgttgactacatctcatcgcctgaagcaagcttcctcaccagcattagtggaaggattagcaacaacacaaagctcgtgttccgctttcttgacgaggccactcttgaaccatctaccaaagacacatatggttccatgttgaaaaatcttacatttatcaagacatttgcatctgggatacttgtcccgaagaagtacgtctggcctgtttcaccagataattatctgcaaatgtacacttcgatcgtcgatgatgctcataaagtggggctggaaatttatgctgctgattttgccaacgactttgcgctcagttacaaccatagctacgatccgttagctgaatctctatcgttcattgataatggtgcattttctgttgatggcatattgactgatttccctgtcacgccttcagaagccattggctgttttgcgaatttgaacaaaagcaacacagctcatgggaaacctctaattatttctcacaatggtgctagtggagattacccaggctgcactgatctagcttatcagaaagcagtcgatgatggtgcagatgtcattgattgccctgtgcaagtaaccaaagacggcataccagtatgcatgggatccattaacttgatggatggtactactgttgcaaaatcaccatttgcgtcccagacagcagtaatgaaagatattgagagtgtcctaggagtctttactttcaacctcacttgggatgacatcgtgaagaatctaaaacccaagatatctaccccacttagcaccttcagtttggacagaaatccaaggtacaggaatgcaggaaatttcatgaggttatcagactttctggacttctcaaaagataaggatttatcaggaatcatgattagcatagagcatgctgcttttctggcagcggaactcggatttgacatggtagatgcagttatcaaagcgcttgacgattcgggctacaacaaacaaactgctcagaaagttatgattcagtcaaccaacagctcggtactggtgaagttcaagcagcaaacgaagtacgaccttgtgtacatgatcaatgaagatgtcagcgatgccgcgccttcctccctcgcgggcattaaaaagtttgccgatgccgtttctgtcgaaaccagctctgttttccccgaaaaccgccatttcacttcgcaccagacagaccttgtcgagtccttgcagaccgccgggctctcggtctacgcctacaatctcatgaatgagtttgtttctcagccgtacgacttcttctcggatgcgaccgcgcagatcattgcctatgttcagggtgccggagtggatgggctgatcaccgacttcccggcgaccgcccggagatacaaatcgaacacttgcatgaacatggggaacaaaaccccaagcttcatggcccctcctcgtcctggtgatctgctgcagctcatcagtaagccggcacaaccaccggcgctagccccgatgccgcttctattggattctgacgtgtcggagccgcccctaccgcctgcaagatcgaacactgctactacagctccagcaccttcgtctgcacgcaggacgcagactggtatcccattcctcgtcaccttggcaatgctttgcgcctgggccgcgatctgaggtggcaatgccacatgtcagtatggcacgctagaggtctgccggtctactaatccaatgttgtcttctccttcggtgattcatttgttcttgtaacttttgcgttgcggggttatatccgggatgcccctataacactccctagtgattattatcagtacatatgtgttggaatatatcctcttttgttctggaccgagcgtttgcaatcaagctggtacagttctcatcaatctgagtttctacattaaaagtagaatctaattttctgaggcatgatttatcgtgtgcgagtgttagactatgtaagtgtattacgtatatcttatgtatacctaaccgcgtatggttaggagttatatttgtacctatgtgcttccaatatatatacaactcatgccacccctagagggttgtgcgattcacc

SEQ ID NO: 41 - DNA, 855 bp, Hordeum vulgare
gtaccaaggcaggcatgcaaaaagtaacggaaaaacaatctccaacggactgatggagtgggcgtgctgcggcagcggctactcgtcgtcgggaacgcagtccccggcggccggcgacggggaggagggctcgtacatgacggtgtcgtcggcgccgcccaagcggcgggccgggaggaccaaggtcagggagacgaggcacccggtgtacaagggggtgcgcagcaggaaccccgggcggtgggtctgcgaggtgcgcgagccgcaagggaagcagaggctatggctcggcaccttcgacaccgccgagatggcggcgcgcgcgcacgacgtcgccgccatggcgctccgcggccgcgccgcgtgcctcaacttcgcggactcgccgcggaggctccccgtgccaccgcagggggcgggccacgacgagatacgacgagccgctgtcgaagcggccgaactgttccgcccggcgcctgggcagcgcaatgcagctaccgtggcggcagcgactgctccgccggtggccttgggaaacgccgagctcgtcgcagactctccttactaccccatggacgggttagaatccgaaatgcagggctatcttgacatggcgcacggcatgctcatcgagccaccaccaatggcgtggccgtcgacgtggatcgaggaggactacgactgcgagatcagcctgtggaactactgatggcgcgcaccatagccggcccgaccctggcgttcacgactcactgtacatacatcttattatggtcatccaggacaaacctgtacttgtggtgtgatggtgtgtgatgttttcctgctattctgatgaaaatgtcattgatagtg

SEQ ID NO: 42 - DNA, 1701 bp, Hordeum vulgare
ccgcccctctcacgcgcctcgccgccatcgccgatcccgttcttcctcgtcgccaaatttcgtccctgctctctccgccccgtccgcaatcccgggccattgggttttgaggtctcgtggattggcgtttggaatgcaatggtggggatagcctgaccgtccagagcccgaaagaagagcacatttctcgtcccaatctcggttttcttggatttcgattcgtttgttgggccggccgagatggacgacgacggcagcttgagcattcggaattggggcttctacgagacgatgaaaggaaacctcggcctgcagctgatgccatctgtgaccggcggccaccgggacacgaagccgctgctccccaacggtaccttcttgcagcaccacacccccccgcaccacccgccacattcgcaccacccccgcgactatggtaacggcgaaccctctggtggcatgcccgccgagccgccggctattcacatggactttgtgcgcaatgaggcctggatgcacccctcgcagcatcaacatcagcatcagcatcagcaccagcatcaacatcagcaccagcatcaacttcagcaccagcatcaacatcaacattcccgtgagttgaaggtccttaatgctgttcctgttgggcctgctccacacattggacatcctggacatgctgtgcatcaccaccctacaggttttgggatgatgccagatgcgcgtggtgcgcacactctccagatgatgcagccacaggagcctcctgtgcctgatgaggaaaaaattaccccaccgctggttgaagatcattctgtggtcggaagcaagcctcctgtgaagaagaggcagcagggtcgtcagcctaaggttccgaagccgaagaagcccaagaaggatgctaccccaggggaagatggggcacccaaggcccgtgcaccccgaagcaggggtccccttaagcctgtggaaatggtaattaatggtattgattttgacatttcaaggataccaacacctgtgtgctcatgcactggagctccccagcaatgctaccggtggggtgcaggtggctggcagtctgcatgctgcacaacttctatttcgacatatccgctgccaatgaacacaaagcgccggggtgcacgtattgctgggaggaaaatgagccaaggtgcattcaagaaggttcttgagaagctagctggtgaagggtacaaccttaataatccaattgacttgaagaccttctgggcaaagcatggcacgaacaagtttgtaacaatcaggtaaaagccatgctatgttgatcgccttgtagggtccaacgctgcagttttgcctgagttattgcctgtacctgctcttgccaatctgcagatgtctttagaagtagcttgtagccatgttcggtttcctggacttaatttacatgcctatttcgagcttcagctgtgaagtaggaagtctgtctgtatctgtcaatttagaagttgtagcgtaatggcaacagtttttctaattagttagcatttaatgcttcaatgtctgttatgacctggatgtttatggctttatgtagagcttttctccattgaaagttgaaagataatcaccacctcttctagggctagttgtaatttggtatttcctgacatctgtcaagtttaaatatgaaatacccacatgactcgtgcagtt

SEQ ID NO: 43 - DNA, 1792 bp, Brachypodium distachyon
tctcccactccactagcgcgtttcacgcagtcggcagagtctccctctagagagcgagtccgcgcgccgaggccagagcaagcaagagagaatggcgagcaaggcggtgaccatcggcgatctgatccagcgggtcacctcctcctgcctctccaaccgcttccccggcaactacgccctcaacgactccggcgccgacaccgacctcgacgaggaggacgacgaccccttcgcggatttcggggacgccgccgacgaatgccggccttcgcccggcgaggtaacggcggcggccgcggcgggtggggagcaggaggaggaagagcggaagctgaagatctgggaggaggaggagaagcggaaggtggcggagacggcggcggagacgaaggggggcgagcgggcgcgggaggcggacgcgctgatggcggaggtgttcgacgcggtgtccggcgtgcggcgcgcgtacgcggcgctccagggcgcgcactgcccctgggacccggaccggatgcgcgcggccgacgcgggcgtcgtcgccgagctccgccacctcgcgcgcctccgcgaccgcttccgccgctcagcggcctcccccgacggccgcatcccgcaagccaacccttccccgccgccgctccgcgaggcgttagccccgtacgaggccgcgctcgaggacctccagcgccagctccagagcaagcaggccgaggtcgacggccttaaagagaagctcgcctcgaacaccagcagcagccgccgccgcctccacccctccaagaagcagcagcaccccaatggtgcagaagccgttgtcggcgcgccgacggcggagctgttcgcggcgtgcgcggagcaggcgcgggcggcgacgcgggcgttcgcggcgcacctgctgaaccttatccgcgcggcggggctggacccggcggcggccacccggtcgctcaccaagatcccggtggcgtcttcttccccgaaggtggccaagcacgcgatggaggcgcacgtgacacgggtgctgctgggcgggttcgagcacgagtccttctacctggacggctccctctcttccctcctcgacccggccgcgtcgcgccgggaccggcacgcgcagttccgcgacatgcgcggcatggaccccgccgagctcctgggcgtgctcccggactgcgccttcggccgctacgccgccgccaagttcgcgtcgctcctgccgccgcgcgtcgaggaggccgtcctcggcgccggccacaggggcggcggcgggggcaagcacccgaggacgccgttctacggggagttcctgcgggccgccaaggccgtgtggctgctgcacctgctggcgttcgcgctcgagccgccgcccagccacttcgaggccggccgcggcgccgagttccacccggagtacatggagagcgtggccggcccgccgccgccccgcgccggggccggcatggtcgtcgggttcgccgtcgcgcccgggttcaagctctgcaacgccgccgtcgtgcgcgcccgggtctacctcgtgccccgcggcaccacgggccaccaccctcctccctgctagtgctacctcgttgctcattggtgtggaggaacaaggactgcacctgagtagtaccatctcctggctgccttcattattagtaggtctctactccgtgctattattagttgcttttcctctctgaagagatctcatgtagtagtacaacaaagaggctttgaaatgtatgatcgatcatgtgttgaagtactcactaacagtgatgtttgatcacgt

SEQ ID NO: 44 - DNA, 1193 bp, Brachypodium distachyon
attccttggtccgtcgtcgcaccccacagaaagtgtgagaaggaggaagaagagagcgtcaagcagccgagatgagggagctggtggtctcctccttctcttccacggcggcggctaacgcggcgctggtgcggggatggtgggaggaagtcaacgagtcgccggagtggcaggacggcgccttcttctccctcgccgccgcctacgccctcgtctccgccgtcgcgctgattcagctcgtcaggatccagcacagggtgccggagttcggatggacgactcagaaggtcttccacctcatgaacttcgtcgtcaatggggttcgtgctgttgtattcggattccatgcctgcgtcttctctctccagattaaagtatataagttggtgttactagacctccccggattgctcttcttctcagcatacaccttacttgttcttttctgggcagaaatataccatcaggctaggagtctccccacagataagttgaggatcatatacctggcagtcaatagcatcgtatatgtaattcagatctgtatctgggtgtacctcggaataaacgataacaagttggtggagctggtgagcaaaatcttcatagtagctgtctctgctgtggctcttcttggttttgcagtatatggtggaaggctatttgtcttgctgagacgtttccccatcgaatcaaaggggcggaaaaagaagctttatgaggttgggactgtgacgacaatctgctgcacctgtttcctgataagatgcgttgtggtggcactatccgcattcgatgctgatgtttctctagaggttatggatcacccaatcctagacttcttttattacatgttgacagagatactgccttctgcactggtcctttacatcctccggaagcttccacctaagcgggtatcggctcaataccatcctattaactagaggttttgtgcttctgtatggtgttattgtgctaagaataatagtgggtaaactccagttgtttaaaactgtacatgtctggtgcgagttgaatgctggtgtttgagctgtgttcgaaagcatcagggtgttgttgatggatcatctgagtgaatttgctcctcttcattttgttctgttttggtgggaattggttaaaacctttgctcgaggcaacagaatagttacaaatccggcaatgcttat

SEQ ID NO: 45 - DNA, 1217 bp, Brachypodium distachyon
ggaaacggaaacacaattcgactccaatgccgcaatcttacgattctcaccccgacccaacctccggtttcccgtccccggtcttaactctgacgcctgcactacccctaaacccatcccgtgcccgccgccgccgcagcctaattcctccccctccaaacccccgtgcacctccgctgccatggacaccgccgcctccgacggcagcagcagcgagcagcggcgtctcctcaccatccccaaggaaggcgagcgcatcatcgcgccgacgcgccgcccggacggatcgctccgcaaggagatccgcatccgcgccggctacgtcccgcaggacgaggttgccatctaccagtccaagggcgccctcatgaggaagtcagggcccgacgtgacaccggggtacgatcctgcgctcgatgccaagcccaagacgaaggcagcaaagcgcaatgagcggcgtaaggagaaacggcaccagggtagttcaacaaatgataaaggaaagagcttggatatagaggaggctgatgcccgagaaactcacacggttctttcttcgactaataagcagagtgatatggtggacagtgtagcagagcagctaagtggggttgctatttctgaatctcctcttgtagcaaccccttccacaaatgctactgacaacttgcaatcagagtcatctgctcccgagatagataagaaaatccgagcactgaagaaaaagatacgcttagctgaggcacaagtgcaaggggagccagaaaaattgaaacctgatcaactggagaaaacgaaaaagatcgagggttggcgtgaagagctgaagcttttggagtccaggagggttcaatctgcttcctagacaaagttggccaaagctctgatgtaaactcgaaccatcagtcccgtgcgcctgctgtggcgttattgctgacccagaaaattcagtcgaccatgctattcttgtccagcacctatgggtctggaaaagcattcccgtagatgtggggtttgcacagaatggaagttttttcgccacaattgtctcatgtaagcccatcagttccaaatttgtaatgaagatccattcgtcatatcatagatacaatgagaaaaccaatttgccatggggtggctgttgcttcagtgtatcgtgccgactttggttattcttccacgctgaactaatttactcttttatccgctctgtggta

SEQ ID NO: 46 - DNA, 687 bp, Brachypodium distachyon
aacgaacaagttgggccgcagtttggtgggccgagctgggttccagcgcggtgcgggcgtgtaagcccgcatggtacagaagagaggagaccggcttctcccttcgtcacagaccacgcccctacacgcagccatcccgcgccgagggtttctctgctcgagcttcggaggcgaggaagagaagagaggagaagcggcgaggcgggagatggcggtgatggacacggcgttcaaggcgctgacggcggggttgggcgtggcgacgctctacctggccgccaccttctccgtcaacgtctaccgcggcctcgcatggcactccgaacaatcgaagttagaaaaggagaaatctgaaggctgaactggatcgacaagttagtgtagacgtcagacattatcggccaaaagaacctacaagacaatcctgccttttgatgaatcatgctgattatgctttccgagactgtttttgtaaaaacctggcaatatgatgtatgatttagggagatgatcatccttttttatgcccactgtcacaatatatttctacgtttgtgaaaataaggtgtaattgtcatcttttcattgtactaccattttctttgtttagcaactgtgaaggatgtttaacctctcagtgttattccctatcatcacagatcattttaatatctcaaatgtttttaa

SEQ ID NO: 47 - DNA, 1561 bp, Brachypodium distachyon
aagcttaattagcctgcaggccgtggatttgatagagagagtgctttacaatggagaagaagttcacggtgactaggactagcaagtccctggtgcccccatcttcgtcttccccaacaccggcggcgacagaggacgatgcaccagtgccggtgatcatgcgcctgtcgacgatcgaccgtgttcccgggctgcgccacctggtgctctccctccacgccttcgacggccatggcgtcgttgccggagaagacgacgaagagcgaattaggtggccggcgagggtggtgagggaggcgctggggaaggcgctcgtggactactacccgtttgccgggaggttcgtggtggacgaggaaggggaggtgggcgtgaagtgcagcggcgagggggcgtggttcgtggaggccaaggcggagtgctcgttggaggaggcgaggcaccttgatgggaaccccatggagatggtgatccccaaggaggaccttctcccggagcccattcccggggtcgaccccctcgacatccccctcatcatgcaggtgacagaattcacatgcggcggcttcgtggtgggcctgatctcggtgcacaccatcgccgacgggctaggcgccggccagttcatcaacgcggtggcggactacgcgcggggcctcccgaagcctcgtgtgtctccggtgtgggcccgggacctcgtcccggaccctccgaagatgccggcgccaccgccgaagctggagctcctggacctccgccacttcaccgtggacctgagcccggaccacatcgccaaggtcaagtcccagtacttcgcctccacgggccaccgctgctccgccttcgacgtcgtcgtcgccgtcacctggcagtcccgcacccgtgccctccgcctcgccggtgccggctacgacgacgtccacgtctgcttcttcgccaacacccgccacctcatgctccacggtggcgccggcgcggcggggttctacggcaactgcttctacccggtgagagccacgtgcgggagcgctgaggtggcgtcggctgacgtggcgggggtggtgaaggtggtgagggacgccaaggccaggctggcgggggacgtggcgaggtgggccgtgggcgggttcgagcaggacccctacgagctgaccttcacctacgactccctcttcgtgtcggactggaccaggctgggctttctagaggccgactacgggtgggggcccccggcccacgtggtgcccttctcgtatcaccccttcatggctgttgccgtcatcggcgcaccgcccaagcccaagctcggctcccgcgtcatgaccatgtgtgtggaggaagaccacctcccggagttccgtgaccagatgaacgccttcgccttcaccgccgggaagtgagtaagcaacgatccataatcgtccatgtatgaaacccaattgagcgtgcaagcgcttaattactacacctttttataatcagtagctcttctatgtctggtgtgtgtgcgtgcaatgtatgtaatttgcttgtttgatcgaactggcgcaattaggcgttg

SEQ ID NO: 48 - DNA, 2138 bp, Brachypodium distachyon
tgctaggctgctagctcctccgctacaacgatctccatcccacggaaccgaacccgcatgcctctcgcggcggccgccaccgtcgccgctgcgcgcccctccccgattggcctgccccgcccgttatgccgcgcttccgcccatccacgccgccggttccggctgcaggcgacctcgcccgcctccacgccggcacctgcgcccgcgccggcgacagcggacgagggacccggtgcggggccgtgccccgtggttaggttcgacatggctgacttcactgtcgccgaccgcgtcagcgtcgggctccacggacggtcggatgagatgatcttcgaggccacggtgcgcgatccgagcagtgagctatacgggtcaacggtggtgttgaggcagctgacgagctcgcaggccaagcgcaggggccggcgcgcgctagaggtgctgaagaagctggctcgccgccagatcatgtaccactcgtacgcgatgcaggtccatggctatgtcactccaagcaatgtcatggaggagggcgatggaccattcattttggtgcacgggtaccatgggagttactccttgcgtcactggttgcaactctcggattggcttccaaccttagaagcaacattggcattggatgaagaacaagtaaggagggtaggagatgattcgattggaggacctgctgttactcggcagctacgtctaatcaggatattgatgagagaccttctgattggtgtaaattatctacatagccatggaatggcacatactgagcttagactggagaatgttcatgtaagcccagtagacaagcatgtcaaagttggtattcttgggaatgctgttgattttcatgacagtgatcctaacaatagttcagtaccaagtaacaatgacagacgaaaaatgatgatagcatttgacatgagatgcgttggtttcattatggcaaagatggttctgaaagagctcatggattcttcaacattcctaaaattcaagtcattcttgaataagggaaatgatccatcatgtttgcgcgagttccttgtacctattcttagccaaaattctccaactgggaatattggtctgcagatgctcgatagacactggggtgctggttggaaccttttggccttattgctcgcaacaaaatctgacaataggataagttgcctcgatgcactgcggcaccccttcctttgtggacctaaatggagaataagtccatcagtgaatgttgtacgttggggcttgggatctactgctgtccgcctggctgaagattatatttatgggcatcaccagcgtagacggttagcatattttattgagttgatggaagtgctaaaccctaattcaagaacagagagttggcttcacctcctacctggtcgctggtgcctcttatactgtacaggaaggcacatcggtctaacacttcgtcagcctacccccagaatcctcatgagtgacgtgttcctcacatttgcacaaactccagagtctgttgaccccgttttatctctggcctcagatattggtttcaaaattatgccagaatctgactggcctcatgacaaatctggcaccgaaggaaatttgtctgttacaacatcagcaaggatagctcctgggaggatctatattaatgcagaagatagtaaagacagtaggatcacatcttcaaggagatatcttcacggcaaatggggaaaagcttcgaaaatgaaggagctgcctgctagcctccccaccgcaagcattaatgtcgatgaagacgaagttgatgtgtcaatgacttgtggctcgactttgaatgtcaattctgcacgtaaagtgctgcaagaggtccgtactcagaccccaccggaaatgttcgatttgtcaaagattgtttgtggtacatacatcgattcaaggttgatgattcttcgtggtgttaatgggtcggctttacttttcattagatcgaattgtacgtcagactcctgagaagaatattggaaccctgtgttttttcctgtacattcttgtatttgtaggtgtccattattgatttgtaacaactgtacataataagatgtccagcgaaatcagaatgttttatctaactttctttcgaa

SEQ ID NO: 49 - DNA, 844 bp, Brachypodium distachyon
acgctctcgtcgatcgatcagttcactcagctccttgcgatcccgccgttagcaagcaccggagctctagctcggccgatcgtattaggaggatatatagcttaattcggtcgatttctctccaagaggaagctagctacgcgcgatccgatcggcctggcggccatggccgatgactcgccgtcgtccccggcttcttacatccgattggtgcagcacctgatcgagaagtgcatctgctacaacatggacagggaggaatgcgtgaagacgctggagaagcaagccaacatcatgcccaccgtcacctcaaccgtgtggaaggagctggagaaggagaacagggagttcttcgagacgtacaagaaggagcgaggcgatcaggagccgttgcagaagagcagctgtactccttcggagcaggcgtctgcttccaagagctcagacgacaacgacaactagagtcgggaccggccgggatgggatacatgcacatgaaactatatatatggaggtgaccgttgatgtagtacagagcaattaaatcgcagctagccacgtatcctggcctagctagacgatcaatccatcgagcgtatattcattccgttggttggtcgacgaggaacgaggagaagattcagagtgtcatcgatggcagcgcggctcattcaaatctggcataccacgtggaggttggaaatggacgtccggaggcgacgacgtacgtgtgcgcgtcagtgtgacagtgcgtgtctgtttgtacgtacgtatgtatagtttgtaaaattgtacccatctgtgtgatcgaccagctctagctggctagctagttactgtcaca

SEQ ID NO: 50 - DNA, 2447 bp, Setaria italica
atggcggcggtggcaggcccttcgccggcctcgccgcggccacctctcggatcgcctccctcgggcgcgcaggcgacgctgcctccgcgcgcgccgtgttcgacgcgatgccgcagcgcgacgccgtgtcctggaacgcgatgctcaccgcctacgcgcgcgccggccggccccgcgacacgctcgagctcttcgcctgcgcgcccgcgtccgacgcgttctcgctcaccgccgcgctcgcagcggccgcggcactccggtgcccagccgcgggcgcgcagatccacgcccggctcctccgcctcggcctgcgggcgccgctccccgtgggcaacgcgctcgtcgccatgtacgccaagtgcgcccgcgccgacgacgccgcgcgctccttcgaggagatgcacgaccgcaatgatctgtcctggtgctcgctcctgcatgcctatgtggcttcaggccacttgaggcccgcgcaggagttgtttgatgaaatgcccaacagaaacaacgtcgcctggaacacgctgcttatggggtattcacgcagtggcaatgccagacagtgcctgcttctcttcaacaagatgcggatggcggggcttacctgtgatgatgcaacactctgcattctcgttgatgcttgcaccgagctggcccacccatctactggcttttcagttcacaagattgtattgcagagtggatggaatgcaatggctgaggtcagtaactccctggtttccttgtacactaagttcagcatgctcgatgacgctgtgcgaatctttgagtccatgaaggtgcggaccattgtgtcatggaattcactgatctatgcctacatgaagcttggctacacggaacaagctgcttctctctttcgaagtatacctgagactaatgtcatctcatggacttctatgattggaggacttgcaaggaacgggtgtgctgatgaagccctcacactatttttcgagatggttgcacatgagcatattcatccagatgacttcacttatggggctgtgctgcatgcttgtgctacttctgtgtctcttgcaagtggaaggatggtccatggtagagtgttccaaactgggttcgcatcctacctgtacgtagccaacagcttgatggacatgtatgccaagtgcggggatgtggagagtgcaagcaatgtgttcaatggcatctttgtcaaggaccttgtctcatggaacacaatgttgtttggatttgcgataaatggatgggccaacgaagcactgatggtgtacgacagcatgaagtcccatgaagtctgccccgatgaggtgacatttgcaggcttgctcacagcctgtagccactctggccttcttgagcaaggggaaatcttcttcgagacgatggtgtctgctcatggaattcaaccaaagccagagcatctttcttgcgttcttgacatgtatgcgagatcaggtaacattaaaaaggctgctgagatcctggatcattttgtagaatcgattcggacacataagagtgacgtacacgaagctctgcttagtgcatgctcgtccgagcacctgaatgccgggattgcaaggaaggtggtaaaagacatggtgaggaccgagcctgcaagagatgcagcttatgtcatgctgtccaacttgttttgcgccagtgggcaatggagcgaggccgagagggtgaggagagccatggctgagcacggcgtcaagaagtctcctggttgcagctggattgaggtggaaggtgctgttaaggtatttgtatcaggtgcgcaagatcctgatcttacaggttttgtatgcgatgttcttcgcttattggatggcgagataagaaatatcacgcgttgtggtgtgtagccatagagggtcatcatcggagtcatacatcgagattgttgttatattccaaataggactttccttattgatgttgcaggtgattggccatccatcgcatgggcggaaagaacactggcaaaagtgcgtaatttgacgcaacaagtagctaaaacaacacacgtctttcatgcatttccacgagcagcttgcgagcaagacatacgctgccaccgctttcgctgcagaggccgcctctcacccttgcctctgcctcgcgctcgatggcggagcgccgctcctcctcaccaactcagccttaccgtgccgctagcgcccgcgggaggcaacggttgcgcgccatcgtcctcgacggccgtggcgaccaaggtgatccacggggacgggtggcgctcatgctcgaccatccgggcctgttcgtctgcgattccggccccgcttcgccgtgggatgccgcctttccggcgtcgctgccgacgagctcctccagccacgccacgcatacttcctcctgcccgtggacatgctgtactccacggtcactgatgacgagatcgccgcggtctg

SEQ ID NO: 51 - DNA, 1911 bp, Setaria italica
ctcacacacactactaccttatctttacacaatcgtgccaaaagtagctaacaagtgatcacttgagaaagaaaaaaggaaaaaaaaaacaaggtgctttggtgaattggtgaggtagtatgggtaccatcgggttcccggtgacgaggacgagcaggtccctggtggcgccgtcgtcggcgacgccgcaggagacgctgcgcctgtcggtgatcgaccgcgtggcggggctgcgccaccttgtgcggtcgctgcacgtgttcgacggccgcagcggcggcggcgccggaggcgacgaggcgttgctggcgacgccggcgaggacgctgcgggaggcgctggggaaggcgctggtggactactacccgtttgcggggcggttcgtgacggaggaggacggcgaggtccgggtggcgtgcacggcggagggcgcgtggttcgtggaggcgtcggcggcgtgctccctggaggaggtgaagcacctggaccaccccatgctcatccccaaggaggagctgctgccggagccggcgccggacgtcaacccactcgacatgccgctcatgatgcaggtgacggagttcacgtgcggcggcttcgttgtcggcctcatctccgtgcacaccatcgccgacggcctcggcgccgggcagttcatcaacgcggtggcggactacgcgcgcggcctccccaagccccgcgtggcccccgtctgggcgcgcgacatcatcccggcgccgtcgaagattgtgtcgcggccgccgcgcttcgagctcttcgacctccgctacttcaccgtggacctcggcccggaccacatcgccaaggtcaagtccagcttcttcgaggcgacggggcagcgctgctccgccttcgacgtgtgcgtcgccaagacgtggcagtcccgcgtccgcgcgctccggctcgacgccgacgacccgtcccgcccagtccacgtctgcttcttcgccaacacccgccacctcctgccgccggcgccggggttctacggcaactgcttctacacggtgaaggcgacgcgtccctgcggcgagatcgccgccgccggcgtggtggaggtggtgcgcgcgatccgggacgccaaggcgcggctggccgcggacttcgcgcggtgggcgggcggagggttcgagcgcgacccctacgagctcaccttcacctacgactcgctcttcgtctccgactggacgcggctcgggttcctggaggcggactacgggtggggcacgccggcgcacgtcctgcccttctcgtaccaccccttcatggccgtcgccgtcatcggagcgccgccggcgcccaagcccggagcgcgcgtcatgaccatgtgcgtcacggagaagcacctgccggagttccgggagcagatgaacgccttcgccgccgggaactaaaccatgcttacctatcgtcgtcgtgtatcgccgtttcctcatcaaagcgtgtctacgtacgtgcatgcagcgaactactgcaagtttggaattcgccggtattgatctctcgatctccatcccctagcttgctatgcctcatcaagaactcatgaatggatttgcttgcgtgtaatttgtttttcaaaaaatttgccacagctagcgttgtgatccgtgctttgtgtacgcacatgtattcctgcccgtctgccaaaaaaagaaatggcgggctagctcgcttttctgtatgcgcctgtaaattgtaatacggatcgacgaaataaagatggatgcatggtttgtacctggttaggtttcggtcgtgtgcgttgcgaattgagtgtgcgcgtgtatgtgttgaaaaaatggttgatcgtgtaccgcccgtggtgtgacttgctggtggcgagcgtatgtgcatgtacgtacgatcaacgactgacgctgattttgg

SEQ ID NO: 52 - DNA, 1329 bp, Setaria italica
aatcatctctgtccgcccaacgccagtcgccactcccttctcctcatccccaccgtaccggaaggcgaaggcccgccgtggatcgagcgatggcggcgacacctcctcctcccgcggcggcgctggagcagctcagcagcaacaagatgttcggcggtcgcaacctccggttccgccaccagagcgccaccctcggctgccccatgaccttctccgtctacctgcccccgtccccggcgtccaaaattcccgtgctgtactggctctcgggcctcacctgcactgacgagaacttcatcattaaggccggcgctcagcgcgccgccgccgcccacggaatcgccctcgtcgcgcccgacacctccccacgcgggttgaatattgagggagagtcagacagctatgattttggtgttggtgctgggttttatttgaacgccacaaatgaaaagtggaaaaattggcgcatgtatgactatgttgtgaaagaacttccaaaagttctgagcgatcactttgaacagctcaacactacacaggcatccatttttgggcactcaatgggaggccatggtgcactgacaatttacttgaaaaacactgataaatacaagtcagtatcggcatttgctccaatcgtcaatccgataaactgcccgtggggtcagaaagcattctcaaattacctgggctcaactaaatcagattgggaggaatatgacgctacctgcctgattaaaaagaagaacaaagtttcagctcctatcctaattgaccagggggaggatgacaagttcctggctgagcagctgctacctcgcaactttgaggaggcgtgcaaggctgtcggggttcctttgatcctgcgcatgcagcctggatatgaccattcgtactttttcatcgctacatttgttgatgatcacattgcacaccatgctcagtttctgaagagcgcctgacttcaaagtctcctgtaatgtgaggaagccatcaagagagatggggaggcagctgtggttgcgaggcgtctgcttagcagtgtgtgtcactatatcctgctgccgacagtcgtctcgacgttcgcttgtctgctaggtgctagcctgaggtgaacaatatacccacatgcaaataagatgaaagactcgtccttgctgtctgttctagcaggaatggggatctcgactcggtggtgcatttgagtgtagtttccttgtctttggttgtgcgcaattattggccctgatgcagccatttctggtgcaaggaatgattgcccatgtgtgcacttgcctcttctttgcttctgcaggggaggaaacatgc

SEQ ID NO: 53 - DNA, 1191 bp, Setaria italica
ttccccgtcctcctccgtcagggccagggtcccggtcggccttcccccccggccccttcctccgcttcgctgcgcatcctcctcaggaatggagcccggcgctggcactgccctgtaccctctgcaccgctgcaaaaccatttacctggtcaggcacgcccagggcattcacaatgtcgcaggcgagaaggatttcaacgcctacaagtcgcatgacctcttcgatgcgcagctcactcctctgggttggagccaagttgatggtctgcgggagcacgtgaagaaaagtggacttgcaaaaaaaatcgagctcgttatcacttcccctttgctgaggactatgcaaactgcagtgggggtctttggtggtgaaaactatactgatggtgtaaatgcaccaccactaatggttgaaaatgctggacacagtggacgtcgggcgatttcaagtttgaactgcccaccatttcttgctgttgaaacctgtagagagcacttgggtgtccatccctgtgacaagaggaggagcataacagaataccggcctctctttcctgctattgacttttcattgatagaaaacgatgaagatgttctttgggaaccagatgttagagaagcaaatgagtctgtggggctgaggggtatgaagttcattgactggttatggacaagagaagagaaggagatagctattgtcagtcatagtggcttcttgtatcataccttgaacatgtacagcaaggagtgtcatccaaccataagagacgaagttggcaagcactttgcaaactgtgagctccggtcgatggtgttggttgacaggagtatgcttgggtcggattccccgagtttcaactaccctggcaagattccagccggactcgatcttcctagcgacgttgcagacgagaagcatcttgaggaagctcagaagaactgatgagcctgtctgaggctgttgagcattgatgccttgattcttttatcaactcactctgaccctgttcaagtttgtgttgaagaagacaaagctaaacaatctctacagataggacttacgggttgttaattgagcatgaattacggaatgtattacgtctgttatgtattacgaaatgtattgcgtctgttatgtcagcccatattgaaattcagggtattgaaatccatagcaataatacctacggt

SEQ ID NO: 54 - DNA, 1678 bp, Setaria italica
ccgtccgccctgtctcagctctcaactagtagaagcgagttgctagcacacaccggcggcggccaagcacaagcagaggaggagcagcaatggcggaggcgaggcagctgcggtcgttcgtggaggtgccggcgggttcgcacttccccatccagaacctgcccttcggggtcttccgccggcggcaggcgcaggagccgccgcgccccgcggtggcaatcggggacttcgcgctcgacctcgccgccgtcagcgacgccgggctcttcgacgggcccgcgctcgccggctccccgtgcttccaccaggagacgctcaacatgttcttggggatgggacggccggcgtggaaggaggcgcgcgccacgctccagagaatcctctcggctgatgaaccagtcttgcgtgacaacgaagccctcaggaagaagtgtcttgtaccaatgagtgatatagagatggttatgccaatcactgttggaggctacacagacttcttttgttctgttcaccatgccaggaattgcggatttatcttccgcgggccgcagactccagtcaatccaaattggtttcatcttccaataggttacaatggacgggcatcatctgtagttgtgtctggaacagatgtcattcgacccaggggacaaggacatccaacaggaaactccactccttatttcggtccctctcggaagcttgattttgaacttgagatggctgccattgttggtccagggaatgagttgggcaaacctattgatgttaatgatgctgaagaaaatatttttggcctagctttgatgaatgattggagtgccagagatatccaggcttgggagactatacctcttggacctttccttgggaaaagcttcagtactacaatatcgccatggattgtcactctggatgctttaaagcctttcacctgtgaggctcctaagcaggaacctgagcctttgccttacttagctgaaaagaatcacataaactatgatattcctcttgaagtctggattaagcccaaagaccaaagtgatgcctcaattgttgcaaagactaatttcaaacatttgtattggacggtgacgcagcagctagcacaccacactatcaatggatgcaacatgaggccaggggatatatttgcaaccggcacactcagtggacctgaacctgaatctctggggtgtctgctggagctaacatggaacgggcagaaggagatagcagttggaaattcgacccgcaagtttctagaagatggggatgaagtcatcttgaccggctgttgcaagggtgaaggctacaacattggattcggaacctgcacagggaaggttctgccggcgcttccttgagccaacatatcttcacttaataaggtctccggagtctcaataatcacaaagggttcatccggcgaatctagcaagctgcttagtctgtttcaggcctagtgatggtgattgaatattagggattgttttcttgaatgaggaaacttgtactctcgtctctactgcaataaaatcgatgctaagccatctttttatacatctgtgttcctctgtagtcgtaggcattcgcctgagaacgttcaagactagatattttccttaaactaaaaacaaacatttgtacttaatctaaaaacaaacatttgtgttcc

SEQ ID NO: 55 - DNA, 926 bp, Setaria italica
tagcaggcaggcaggaagacgatgggggcgtcgccgtcgcggcatgaggcgtcgtccgactcgtcgcgcgccggcaacggccgcgccgtggcggtggcgacgagcagcgccgcttctggcaccggtagcaacagcaaccaggcccagtcgaagcgggcgccggctcctcacatgttccatgagatcgtcgcgcaggagaagactgccactactgcagccgagctggaggatcaggtgcatggcgcagggatctacctggctggaaaaacaaagaagtactgggtgcacgagaaaaccaggtgcaactgcttcatgctgttccccagagggctgtccgtcacttggagtgaggaccccaactactggagctggcatcccctgaaagagacaagcgactccgagatcgaggcggtgtcgctgcagaacgtgtgctggctggagatccacgggaagctggagctgtcccacctcacgccaggagtcacctacgacgtcgtcttcgaggcgatgcttacagagccaacgtacgggtggaccgcgccggtgaacctccggctgaagctccccgacggggcggtgcaggagcggaaggagaagctgcaggagaagcccaggaaccagtggctggagctcaaggccggggagctgacggcgcagccggggcagaagggggaggtggagatctccttgttcgagtacgatggcgggcagtggaagagggggctcctcgtcaagggcatcaagattgtgccaaaggagtgaatgagtgattagcatttgtttgagggtgatcattagccttttgcctgtcaggtgtgctaagatcaatgggatacgtggaataatgatgtgtgtggcaccacatatttcaagcattgagctgaatgaaactttagtcttccaaagcaaagttacgcaaagtgatg

SEQ ID NO: 56 - DNA, 2375 bp, Setaria italica
aatcgcattccattctcctcctcgcttttgcactttgcgcctctttctctcttcctctatccttcctcccgccagactctgaagattgcttccgtcgagttctgaatctgggattgtggcggcttcgtaggcagccgccggaatccgcaaagagcggcagctcgtcggtgtcggcgcagggaaggtcctaacatgatggctgcggagttagttaagcagtactcaaacatcactttgggagaagacagtgagatatgtgatattaaacatgcgcttaaggcattgagaaagaagatccttagtttggattttgacaactctatgcatgtccatgatccacaggactcatttgagtacttggaagtgctgtacaaaatcagacgactgtctgaaaggttaaggaacctagacccttgtggagaagccaaacagctggatgaactcactgtgtatgccgatgacctttctgaaatggcaatggcaaggcttgaagaggaatttgtttatcttctgacacattacaaacagccattagaacaggaagttctctcttttcgctctacagaggatggcagtgtggaagacttttcaagcagctcattcagcgaggaacaatcagaagggaaggcaacaccaaatgatgtcgctggaggaccggagtatcttgttcctgatttgattcaacccggtgcactctctgctgtcaagtccattgctaaatttatgttcctgaatggctatgataaggagtgttgccaagcttatataaactcacggcagaatgcaatagatgagtactttgcatctcttcgtctggacaagctcagtatagaagagcttatgaacacaagttggaccaaactgaatattttaataaggagatggaaccgagcaatgagggtttttatccgagtctaccttgcaagtgagaagcgccttagcaatcatatctttggtgaacttacagattcaactgctgacttgtgcttctatgagatttcatttaactcagtaatacaacttctgagcttttatgtatctgtagctattggtcctccaaaaacggaaaagctttttcgtttgcttgatatgtatgaggtcctgaatgatcttctccctgaagctgaatccctgtttgaatcaggatatgatgatatgatcttgaatgagtatcatgaagcactactgcagctgggagaatctgcaagaaagacatttgcagaattcaagtatgccatccaatcatacacttcatcaaatgcagtggctcgtggagaagtgcatccacttacaaagtatgttatgaactacataagggctctcacagcatacagcaaaactcttgattcaattctcaaggacacagatcgaagacacctgcatcttgcttctgacattcagttgatggcgaatgcatatcctaatttcacagcaacagctttgcatctacagtctgttgccgcaattttggaggcaaatcttgaagctggttctagactgtacagagatgatcgattgcagaacatctttatgatgaacaacatccactacatggtccagaaagtgaagaactcggatctcaaaagctttcttggcgatgactggatccgggttcacaacagaaagtttcagcagcatgctataagatatgagagggcgtcatggaacagtgtcctctcttacctgagtgatgatggcttgtgcgctgctggtgatgctgcttctcgcaaaaccatcagggagaagataaaaaatttcaacctatcctttgaagaggtttatcgagttcagacagcatggtctgtcccagatgaccaacttcgtgatgatgtccggatttcaatatcactgaaagttatacaggcctataggacattcgtgggaagatatggaagcgtccttgatggctcaaggcatcgagatcgttacataaagtatagacccgaggatttggagacacttttgctagatctttttgaaggagctcaaaagtcactgctgcattcttgtcgagcgtgaagcttaaaccagttcgtcgaagagatgcatcagccccctccaccttatttttggttttcttctttggtttgtattatagaatcatagaatgtatagttgaattattatagtgatgtgttgttctgtctgcccaacttgcataattttgccttttgttcgcagctcctcttgctgcatagaattccttacaacattgccgaagttcagaggatgttagaaatagcaatctgttgttcccaaaactttgatacctgagtatgtatagtttctgaatgtcttggtactgatacagtaatcttgcatccttggttcgtttaataatttgcctgcactatgaaggatatgtgttgctctgc

SEQ ID NO: 57 - DNA, 1167 bp, Setaria italica
acctttccgtccccaatccatttgaaaccgcgccgcgtcggcgtgaatcgtcggcggcggcgatggaggtgggcgacctgcacaaggtctgggatgtccgggaactcaagaggaagcccgacgcggccgccgcccgcgcgctcctcgaccgcgtcgccaagcaggtccagcccatcatgcgccgccacaagtggcgggtcaaggtcctctccgagttctcgccacggaacgccaggctgctggggctcaacgtcggcgcgggcgttgaggtcaagctgcgcctgcggcgcgccggccgcgactacgatttcatcccctacgaggaggtgctcgacaccatgctccatgagctctgccacaacgaccgcgggccccacgacgcgcagttctacaagctctgggacgaactccgcaaggaatgcgaggaacttgtttcgaagggtatcactggaacaggacaagggtttgatggtacgggaaggcgggtgggtggatttacaatacatccgccaccaccatctctccgacaagctacattggttgctgcacagaagcgagcaaggaatggagctctattgccttctggaccaagaaagttgggtggaaacaacgatattatgagtgcgcttagtccagcgcaagctgctgcaatggcagctgaatggagaatgcatgatgatttgtggtgtggatcccacaatcaatctggtattgatgattcggatgacgttattattcttgaggaaccacctaataacatgacaataaaggatggaaaaaccacaaagggtagctgttccaacacttctgcagagtccagcacttcgtctggaattcacacagcagcacgagatggtccctcatctttttggacaacaggtgatgcagttgatgattcaaagtgggaatgtggtgcttgcactcttctaaatcagcctttggcaccaatctgtgaagtttgtggcactgcaaaacctaaaattgcaaaggcgaagtacatgacttggtcttgtaaattttgtactctagaaaacagcactaagcttgacaaatgctcggcgtgcgaccattggagatactcatatgggccacctatagccacttatggcccaagctatgattgagaattgagataacattgaaggctacaattgtacagttacagca

SEQ ID NO: 58 - DNA, 1156 bp, Setaria italica
ctcgagctcgccctcctccccccgcctcgctaccgacgcccgctcttccccggccagcgatcccgattcaactgatattaggatggacgaagtcacgcaagctgttgagaatctgaagaaagaatggaaccaagcggtttctcagcttgaggagagcattgctgcaatcagatcatgtggaaaaacagggaaagggacagaggaagcaaattctcttccaaggttgaatggttctgcacaggatgctctgcaattgctcaagtcactgcagtttcgtcttgatcttctagcacagcagcttcccacttttgaagaagtgcagtctggccaagcaaccttagagtcatgggatgaacaatacaagaagctgcgtgctagcctgaggaatgctaacttacaagcgaaagagaacattagaaaagctgctcaagaggagagagagcttcttctcgggggtggagaagagtctaccatccgcaggcgtaatctccagacaaagactgggatgacatcttctgctgaaagtatcactgagagcctccgacggtctcgccagatgatggttcaggaagtggaaagaagtgcaagtaccttggcaacatttgatgaatcaacaagtgttcttcggaaggctgaaggtgaatatcaaggacaccgctctttgctgtcgcggacccgtggtttgctctccacgatgcaacggcaagatgttcttgatagggtcatcctaacagccggctttatcattttctccttggcggttctctacgtcgtctcaagacgcattggtctgctgactctgcaaaggaaactggctgatgccatcagatcaggttcgctgtcagccgaggacatcgtagcgaaagcccagcagcatggacctgccgcagctgatgctgcaggccccgctcctcccatttacgatgaactgtgactcgcatctgcccatgagttttttttttttttgagagggcatttgcccgtggtttcttatacatgtgtacccagattcccagaagcaattgtaaggcaatagtttcacgaataagctattgttgagatatatatctacagtgcagtgatctgtgatcaactgatcatcaaatcatgcaccgacctgttcgattaaaagtccatgatctcggctcagcccacg

SEQ ID NO: 59 - DNA, 1714 bp, Setaria italica
ccatgcactgggttgctacttgctactccagttgaagctccacccgcactgaccagttgagtcccaaactcccaagcgagagctgccgagcttgctgcagacgctcccggccggccagatcaaccgaagctagccgccgagcggcacctgcgatggccgtgcgccactccctcgaggtggccgacgaccgctgcgacgacgacgggcaccgcccgcgccgtgccggcacggcgtggacgtgcgcggcgcacatcatcacggcggtgatcggctccggggtgctgtctctggcgtggagcgtggcgcagctgggctgggtcgtcggccccgcctgcatgttctgcttcgcgctcgtcacctacgtctccgctgcgctgctcgccgactgctaccgccgcggcgacccggagaagggccccaggaaccgctcctacgtggacgccgtccgcgcctacctcggcaagaagcacacctgggcttgcggctcgctgcagtacgtgagcctgtacggctgcggcgtcgcctataccatcaccaccgccactagcataagggcgatcctcaaggccaactgctaccacgaccacggccacgacgcgccctgcgactatggcggcagctactacatgctcgtcttcggcgccgcgcagctcttcctctccttcataccggacttccacgacatggcgtggctctccgtcgtcgctgccgtcatgtccttctcctacgccttcatcggcctcggcctcggcatggccaccaccatctctaacgggagaatcaaaggaagcgtaacaggtgttccgatgaggacgcctatgcagaagatttggcgcgtctcgcaggccatcggcgacatagcgttcgcatacccatactccttgatcctactggaaatacaggacaccctgaagtccccgccggccgagaacaagacgatgaagagggcgtcgatgatctcgatcctcgtcacgacgttcttctacctctgctgcggctgcttcggctacgccgccttcgggagcgacgcgccgggcaacctcctcaccggcttcggcttctacgagccctactggctcatcgacttcgccaacgcctgcatcatactccacctgctgggcgggtaccaggtgtacagccagcccatcttccagttcgcggacaggttcttcgcggagcggttcccggacagcgggttcgtgaacgatttccacacgatgcgggtgccgtgcctgccgccgtggcgggtgaacctgctgcgggtgtgcttccggacggtgtacgtggcgtccacgacggcggtggccgtggcgttcccctacttcaacgaggtgctggccctgctgggcgcgctcaacttctggccgctggccatctacttccccgtcgagatgtacttcatccagcggaacgtgccccggtggtccgcgcggtgggtcgtcctgcagaccttcagcgtcgtctgcctcctcgtcagcgccttcgccctcgtcggctccatcgaggggctcgtcacccagaagctgggataggactggtcactggtgtcctccatctctgttttggattggattgtgtttcttcttccggttgtgatggtaatggagaatgcagcgaatggggaggtggtgtttgtctccttgggatgatgatgaacaggagcagcatactagtagcaggtcatctgcagcctgcaggaccagggagtggcagg

SEQ ID NO: 60 - DNA, 2066 bp, Setaria italica
ggttggagcaacttcctagctccacgcgaaaactgtgatatgctgttgcactgctgaagaggaggatgatgatggaacggttgcttctttgagcagcaggcctcctacccacgctaccctggcaagtaaagtcagggggtgtgggaataacccggtgaataatcatggacagaagagctggagcaatcctagtgtgcctgctcttcgtcctagtccgggacgtgtcggccgtcgctgagaccgaggccggcaatgtgcgtttagtgcaggaggcgcccaataggaagatcgagggcacagggaggcaggatgatggtaaggtgggggggagggtgtcggtctcaacagttgcttggtctacgctcatcatggctgcggcaactggattgggagcagtgcccttcttcttcatggagctggaagctcagtgggcaggcctttgcaatgggctagcagctggggtgatgctggctgcaagctttgaccttgtgcaggaagggcaggtgtatggcagtgggagctgggttgttttcggaattttgagcggaggaatatttatttggctttgcaagaagtttcttgagcaatatggagaagtaagcatgctggatataaaaggtgcagatgcaagtaaagttatccttgttgtcggaataatgactctccattcttttggggaaggctctggtgtgggtgtttcctttgctggctcgaaaggattttctcagggtcttctagttactatagctatagcagtgcacaacataccggaaggcttagctgtaagcatggtactgtcatctaggggtgtaaccccacaaaaggcaatgatatggagtatcataacatctctaccacagccaattgttgctgttcctgctttcctttgtgccgacgcattccagaaggtgctacccttctgtactggttttgctgcaggatgcatgatatggattgttatagcagaggttcttcctgatgcttttaaggaagcgactccatcacaagttgcttctgctggaacacttgctgttgctttcatggaaacattaagtactgtgcttctgggatttactgatggcaacaactcagaagatgcatcaggtttcttggtatcacttgtatttggactcggtccacttattggaggaattatacttgtcacattctctcttgccttcagcatgccacaccctcttcttactggtgtggcatctggcattgctttccgtcttgcggcatggagacccgtacagcttctaatgtcctcaaaaatgggtctatttaccaccctctttctcctcattgttggttgccttgtctaccatgctgccacatcaagcatccttagggtggttaatcgcaaaaggtcttctgttaacgtcattacatcatcctctggtttctctcttagtgtcctcacactgcaatctctccttgcctgtggttctgtattccttcatgcatacgccgaaggacttgtgcttggtgtcgcggcacgcaaggcttatggccttggccgttacatggttctcccagcttccctccatggtctgccacgaggtgctgctgtcgcgagctgtgtatatggtgccacagatagctggcgcggggcccttgcagctgctgctctgaccgggcttgcaggacctagcgccgccatcagtgcgatccttgcgaggatcgactacgatggactcgactactggatggtgatcgcgtgtggggctctgatccccagctttggccgtgttttcaggcggtctttgcgattggacatgcggaagagcattgtggggctgctgataggtatcgccttcgcctccgtgtgcttgatgtcgactagattcatttgcttgcacaccccttactgcaactcggctccagaagcggtcacatgacttgtgtaactgtgttgtatacggtgatgttgtaaaacacatgtaataccagtgtaatgacttttgactatacaaagaatggaaggttatattgcacttgcaatgaggaggccatagttaatatacggtgaaatctgtaaaagtttttccaataataaagctgga

SEQ ID NO: 61 - DNA, 1889 bp, Setaria italica
aaccaccaccctccccaacctccaattccagttgtcttccccgcccgtgccagctcggacccctccgccctccccgatccccaattttaaacacctcctcctctctcctgcggcccactcgcctccctctcctcctcccccctcccacgccgcggagcgaatccggcgccgcgctcgcgctcgctgcccccggcgggacccgcgccgcggctcctgcacgccccgcgatggcggcgtccatggcgtcgccgcgggggcggtcgatccgggagacggtgctggagaccgtcgcggcgtaccacaaccagcagcggatgaggcgcaagctgcgcaagagcctcacctacgcgggggagctctcctccgcgggccgggcacgcggggacggcgcgtcatcgtccgcctcggtatcctcgctctgcgggcccgaggacgacgacgagcccttctgggaggaggaggagggcaccgtcgagctcgtccagctcggggccaaccgcgccaagaacgtcctcatcctcatgagcgacaccggcggcggccaccgagcctccgcggaggccatcaaggacgccttccggatcgagttcggcgacgagtacagggtcttcgtcaaggatctgtgcaaggatcacgctggctggccactcaacaacatggagagctcatacaagttcatggtgaagcatgtgcagctctggaaagtggctttccacagcacctcgcctagatgggtccattgcttctacctagctgctctcgcctcattctacgccaagaaggtggaggctggactgaagaagtacaagccagacatcataattagtgtccacccccttatgcaacacattcctctgtgggtgctcaaatggcaaggcctgcaaaacagagttgtctttgtaactgtcatcacagacctcaacacttgccaccctacatggttccatgccaatgtgaatagatgttactgcccctcagaagaagttgccaagagggcagcattggatgacctacaaccttctcaaatccgcgtgttcggtcttccgattcgaccatcattctgccgtgcagttcttgttaaggatgaattgagaaaggaacttgaattggatcctgagcttcctgcagtgctgctcatgggaggtggagagggcatgggtcctgtcaagaagactgcaaaagcccttggagaatcattgtttggcagagagcatggaaaaccaattgggcaacttattgtcatttgcggtcggaacaaaacactgagctcctccttgcaggcacttgaatggaaaataccagtaaagattagaggatttgagacccaaatggagaagtggatgggtgcttgtgattgtattataacaaaggctggaccaggtaccattgctgaagccttgataaggggtcttcctataatccttaatgatttcatacctggacaggaagttggcaatgtcccttatgttgtggacaatggtgcaggcgtgttctccaaaagccccaaggagactgctagtcttgttgcccgttggtttggtccagactcagaggaattgaaaaggatgtcagaaaatgcactgaaattggctcagccggaagctgtctttgacattgtcagagacatccatgagctctctcgggagcaaggcgtgatttcacagatatctagttccttgacgtcatccttctttataccatcacctgaaaccacacctctccaacttatctgaaaccttggagctgtgcatagctagaattgcaatctctgaccttgtggacttggcattctcccctacagcatgacctggaaatggaacttcagggagcctctctcatcagctgttggtacggggattccacaacttttcagttcatgccctctcatg

SEQ ID NO: 62 - DNA, 1003 bp, Setaria italica
aagctcagtcacccagtcgctccaaaacctgatcggattcgcatccatggccaagttcgccgtcctcctcctcctcgccgtggcggcctccgccaccgtgctggcgcacggccgcgagctcccgactcaaatcaagctggtgagaggcgcggtcgccgccgccggcggaggcgtgtccggcgacagcatggagtgcgtgtacacggtgttcatccggacggggtcgatctggaaggccggcacggactcgaacatcacactggagctggcggcggcggacggcaacggcgtggggatcacggacctgccgtcctggggcgggctgatggggcagggccactcctacttcgagcgcggcaacctggacatcttcagcggccgcggaccctgcatggcgaggccgccgtgctggatgcgggtggcctccgacggcacggggccccaccacgggtggtactgcaactacgtcgaggtcaccgtcacgggcccgcacaaggggtgcgcgcaggagctcttcaccgtcgagcagtggctagccaccgacgcgccaccgtacaagctcgaggccgtcgtcgaccattgcgcccgcgccggcgctggcgccgccgccgcgtgacgtggcctgggggtgacgagtcggagctgctgcagttcgtgcagcgagtcgaataatcgagagcctttgtcgcgtgggatgatgcatgcgtagtgagtaggtttggtggttttgtagatgccctgtgttggatcttgatctgtgttttgatcttttgagaaatggtgatctgcgttatcatgagtgttgtttcttctagcttgccggcgcttcagatagcgtctatatccagtctgctcgggtactgtagcaaggctttgccggcttctgtagctgaagccagcacaaccgagcatcatggacagcaccatccttgattgtcattctaattgaagtgttataagcatatatcttatgctatatcgatggggaaaattcgaggtttac

SEQ ID NO: 63 - DNA, 4916 bp, Setaria italica
gaagagtggaaagcaaacaagcccagcggagcggaggccgaaccttcaccaaaccccagccccgaccgcccacctcgccgtcgccggcgatcggctgccgcccccgccgccgcgctaatccctgccttatccgtacctccaacccgcggcgctggggctctgatgcgtcccgccccatggcatcccacattccccttccctgccaccggcgtcctccccctcctcctcctcggcctcttcgccgtcgcatccggggggacgggccctagcccaggggctttcaatcggggggaggcgggcggcgcggaggcgtactcgatcctcacgttccacgactacacgccgcccccgccccccgcgttgccgccgccgccggccgccccggcggcgacctgcgccggggacctccgcggcgtgggcgacctcgacacccagtgcgtggtccagaagtcggtgaggctgggcggcggggtgtacatcagcggcaacggcagcctcgtaatcctcggcggcgttgcggtcacctgcgagaggcccgggtgcgtcctctccgccaacctctcaggcggcatcctcctcgggcacagggcccgtgttgtggccgggtgggtttcccttgcggcggccaacatcacgctcggcgtcgacgccgtcgtcaacaccaccgccctcgccggcgacccgccggaccagaccagcggagtgcccaccgggacgtatggggatggcggtggacacggcggccgtggcgccagctgcttcgttaagaaggggcaggcgcaggaggactcatggggtggtgatacctacgcgtggtctgcactgaagaccccaaatagctacggcagcaaagggggatcgactactgtcgagaaggactatggtggtggaggtggtggtgtagtgtggttgttcgctaaagaaattgtgttgaatggaacagttcttgctgatggtggaaatggtggcaccaagggtgggggtggctctgggggcagcatctatctgaaggccgcaacaatgcgagggggtggcaaaataagtgcttgtggaggcaatggtttggctggcggaggtggaggacgtgtttccatcgatgttttcagcaggcatgatgatgcccaaatctttgttcatgggggaaagagttcaggatgcttggacaatgcaggagcagctggaactctttatgaagaagtgcctaagagtattactgttagcaatgataacttgagcacacaaactgatacagtttttctagatcccccatatgagccactctggacaaatgttcttataaaaaatcatgccaaagtttctcttcccttacgctggagtcgtattcaggctcaaggacagattcttttagctggtgctactctaacttttggcctgacacattatccgtattcagaatttgagctgttggctgaggaacttcttatgagtgattccacaatcaaggtctttggtgctttacgaatgtcagtaaaaatgctccttatgtggaactcgagaatgactattgatggtgacagagaatcaggagtagcaacttcactactagaaggtagcaatttgatagtcctgaaggaatcatctgtgatacattcaaatgctaatcttgggattcatggtcaaggcgttctaaatttatctggtcaaggagatacaatagaggcacaacgccttatattatcactgttttacaacatagtggttggacctggagctgttctaaggggccctcttataaatggaagtattggcgagatggcaccaaagctgaactgtgaagatgagagttgccctatggaaatttttcatccacctgaggattgcaacttgaactcttcattgtcttttactttacagatatgccgcgttgaagatattgatgtttccggccttgtgcaaggaactgttattaattttaacagagcaagaagtgtcactgtgcagacatctgggaccataagtgcaacaggattaggctgccagggtggaattggacaagggaaaatgttaagcagtgggattagtggtgggggtgggcatggtggtaaaggcggtgatggcatttacagtggtgatcatgcagagggtggacctgcatatggtcatgctgatttaccttgtgaacttggcagcggcagcggcaatgtcagtgcatcttcaacggctggtggtggtataatagtgatgggttctctggagcaatctctgccaaacctctccctttctggctcaattgaggcaaatggtggtagttttactggcttggcatctcatgccacaattggaggacctggtggtggttctggtggtacaattcttctttttgtgcggactttactcctaaaggaggactctgtactctcaagtgtcggtgggattggaaacaatggcagtggtggaggtggagggggtcggattcactttcactggtccgatattcccactggagatgattatgttccttttgcaactgttaagggaacaatacttacaagaggaggagtcagtgaaggccatggttttcctggtgagaatggaacagtcacaggaaaggattgcccaaaaggtctttatggaacattttgcaaggaatgtccttcaggaacatacaagaatattactggatcatctaagtccttgtgctcaccatgccctccaaatgagctacctcgccgtgctgtatacataagcgtccgaggaggtgttgctgaaaccccatgcccatacaaatgtgtgtctgatagatatcgcatgcctcactgttttactgctcttgaagagctgatatatacgtttggtggaccttggttgtttggcctgcttctttctggccttcttgtcttattagctcttgttttgagtattgctcggatgaagtttgttggtactgatgagttgcctgggccagcaccgactcagcacagttcccaaattgatcactcttttcccttccttgaatcactgaacgaggtattggaaacaaacagggcagaagaatctcactgtcatgtgcacaggatgtatttcatgggcccaaacaccttcagtgagccttggcatctcccacacaccccaccagagcaaatttcagagattgtgtatgaggatgcatttaacaaatttgttgatgagataaatgctcttgcagcctatcaatggtgggagggttcagtttatagtattctctgtatactttcatatcccctggcatggtcctggcaacagtggcgcaggagaaagaaattacagaaactatgtgaatttgttcgatccgaatatgatcattcatgcttacggtcctgccgttcacgtgcactttatgaagggctgaaggtagctgctactccagatttaatgctgggttatttagatttcttccttggtggcgatgagaaaaggactgatcttccccctcgacttcatcaaaggtttccaatgtccctcatctttggaggtgatggaagttatatggctccattttcacttcatagtgacagagtggttacaagtcttataagtcaggctgtaccatcgtcaatatggcatcgtcttgtagctggattgaatgcccagttgcgtttggttcgtcgtggaaatctaaacacaacatttcttcctgtgctcaaatggcttgaaactcacgcaaatcctgcattgaacacgtaccatgtgcgtgttgaccttgcatggttccaaactacagcattaggttactgtcagtttggtcttgttcttcatgctgtggggggaccggtggctgctgaacttcaaggtgactctgtaattataaccgagcagcattcagtaaaccagaatacatatgctgattctcagttgagccactcaaggatcaacgatgctcttttgtgtaaaaggataactggcaccgttctcaatgttgaaaacttaaagatgctcaaagacaggagagatttgttttaccctctctctcttatcttgcacaatacaaaaccagttggacatcaggacctcgttggcctagtcatctcaatattgcttcttgcagatttcagcttagtcttgcttactttcctccaactatattcatattccatggtcgatgttttattagtcttgttcattcttcctcttgggatactggcaccgtttcccgctgggataaatgctctttttagtcatggaccgcggcggtcagctggccttgctcgtgtgtatgccttatggaatattacatcactggtcaatgttgctgtggcttttgtatgtggttttctgcattataagtcatcaaacaagaaacattcaagcatgcagccatggaatttgggcggggatgaaaccagctggtggctattcccaacaggacttgtgctatgcaaatgcattcaagcaaggcttgttgattggcatgtatcaatcttagagatccaggaccgcgcagtttatagcaatgacccaacaatattttggcagtgacagcattttggatcacaggagtgctcatgatgggagctttacacaactcaagttttttgggagttgatgaaaagaagactaggaagagtccgttctttgtcggccagtcaggggaagcatgtacaaagtagaatgcttacagatgcctgcctatagacttatagtgcatcgttgaccttttgtccagttactcacccatctttattttccttgtacataggaaaagggtttagttgatccattcattgtaggatttaggatttagataccatagaattataattttacctaagctaatttcaatagatagtgggaaatatctttctttttttggttgaaagcgttctcgtggtattttacatttgatgttttgctgcaaaaggggtgaccatcaaatatgacggttactccctcgcccccgccaacaagaaaaaaaaaat

SEQ ID NO: 64 - DNA, 4170 bp, Setaria italica
cgtccgcgcccatcgccgccgccgccgctgccgcgagcacgctactgtcgccgctgccgccgccgcggcagctgcgagtaaggttggtcggagccgttgcggattttgcggatggctggttctgcagttacggatgattctgcggcaagcacagctgggatgagggatgacgaacgcagcctgtccggcgagtccttgtccgagtggagatcctgtgagcgggcagatagcgacagcccttcgacgtccccgcccttctgggacacggacggcgaggatgatgaccctggccccaagccttcggaattattcggacgttacacctggaaaattgaaaacttctcaaaggagaaaaagagagaaatgaaaagtgagccgtttgaagctggtggttacaaatggtatattcttgtgtatcctcagggatgtgatgtctctaatcatctttcgttgttcctttgcgttgctaatcatgacaaacttctcccaggatggagccattttgcacagttcactatagctgtaggcaatgtagatcctaaaaagatgaaatactcagatactttgcataggttctggaagaaggagcatgattggggatggaaaaagtttatggagttgtcaaagattcaggatggttttcttgttgatgatgttcttgaaatcatagctcaagttcaggttatcagggagaaagtggatagaccttttcgttgccttgatcgtccttatcggagagaattgcttcgtgtctatatgacacaagtggagcaaatataccggcgttttgttgaggagcgacggagtaaacttagcaaactcattgaggacaagacgagatggcccagcttttgtggattctggtcagcaattgacccaagcaccaggcgtcgcatgtccagggaaaagactgacactatattgaaagtcttggtgaagcatttctttgtagagaaagaagttacttctacattagtgatggactctttgtatacgagtctgaaggcacttgaataccaggtgaatggaaagaaaggcagtacaaaagtatcagacttggaagaactacctgcacctatggtccatattgacatggacatgtttgttttggctggtgatgttatacctttgattaaaagagcagcctcagagcccttgccttgtcaacctttagctcccaaggatgacaaaacttcccaaagccgcatgaaggatggaactgctggcgaggtttacaaagtttctatggagcgtgaggaaagacgcctaactgaacttggcctgaagatacttgaaacatttgtgctatctcatatatttagtggaattgaagttgcataccaagaagctgttgctttgaaaagacaagaggagcttattcgtgaggaggaggaggaggcagggcttctcgaaaatcatatgaaggggaagcgtggtggtggagcaaatgaaaaggacaagcgtgcgaagaaaaagcaggccaaacaaaagaagaacaatcgtaaggttaaagacagggaaagagatgagaaatgtgaagtgaaaattctggaaagatttcacgatgaaattgcaatcgataatagtgatggtttaccagtggtggaagtgacagcaaaggttgatgccttggaagaaggttcttcagatggatcagacatgccaaatagagggaaaaatcagcataacaagggcttaagcattgttggttttgccgaagaaggtgatggtcttccctccacctctagtgttgctggtggtttaggccgcaatagttctggcttctgcaccgttccaaaattggatcaggatactgttctacttaccttgagggataaacttcgtaagctagggcagcgtctgcacgagaagaacattgaggggcaaaaacttcttaaagctcattttgaagctagggatgcgaaagcaaaggaagcagagtcttccaactcatccagttctttggagaagccacctgatgttccagagagcccaaagcattcctcagaagttgcagttgatctaaaagctaatggaatgccaactaaggatgtctctgtggtcaattgcatgccagaggaagctgtttcaggcataccaccccctacaaatactgaagctgtgactgctcctgccacagcaaaaattgatctagtttcaaacaaagttaatggatcgagttcaaaaatgaaaggcaacacagcatctaaaccaccagcagttgatgtggataaagatgcccctcttccttcaaaatcaccgcgaatcaatagagctgcttcagttcccccaaaactgcctttggttgataaagtgactccagttcctcccaaatctccacccataaacaaagcaccggcagttcgccccaaatctccagcaattgacaaaacaactcaagttcgtccaaaatctccagctgtagacaaagcagctccagttcgttcccaatctccagcagttgacaaagcaacacccattcgccccaaatctccagcagttgacaaagcacctccagtttgccccaaatctccagccagtgacaaagcaacgccagttcttcccaagtctacaccagttgacaaagcttctccagctctggtgaaatcaccaacaggtggtaaagatgcttctggtccttcaagatcatcagtgcatgagaaatctattccagctcccccaagactaccacaagttgataaagcagccctgccatcctcagaattgccacaaacttcttcagacgctaactctgaagctccagaagcagctactttcaggaaggtcacagccaacttagtttccgaggttacagcatcgaggccttcaagtgcacctgtgttccccacaccaagatcaactgcaccaactacttcacatgttcacatttcttcattgctttcttgctctatgagtgaagcagctggacgatcagtaaatggtccctccccttctgccccaccttatactcctcagacataccgtaatgccattgttggtaaggctggcctgtgcacaacatctgcaagcctttcatatcactcaacttctctgagccaagataccaccctttcgcagcctttgtcggcatatgcatcaagtacagcagttatgatgcctcctgctggaagacctgatcagttgtcaactaggcatgtgttgaagtctgggctgggcaaattagaagcacatgacagctggcagcagtggaaaggtgatagtaacattaataagcatctctggagggatcaggctccttaccaacaaatgaccaatggtcaagcatatgaacaaccacggagggatgatagttatcagcaagcaagtagcagaggaacagaaaagctcagcaggtatggaggactgcaatctaggcagttccaatctgggacaagcgatagccatgtctggcaccaacagcagggaccagtaccagaagaatttccacaccttgacatcataaatgatttgcttgaggaggatcatatcaacagcaatatgccagattcattccgtcaagattaccatgcttttggccggccgttttcgtcgagaggcaacttggcagatatggagatggcttctgttagtagccctggtcggttcaattcaaccgaccattactacgatgatggattctcaaggtcctatgacatgagtgccctccatgggctgagggaaaggcaatttccctcgatgggtacttattctaatggcctgtccgacataagtgtttcaaagccttggctgaatggctctcctaatccagcggtgagtcttggagctaacacaaatggataccaccaccaggttggtgactacactaacctggggggcggggtgaacggagtctccgtgtggcgccgccatgccaacggtcgctggtaatgggaggtcctgtatacagtcttacagtcggaataatgcttgttgtaacagatgatgggttccgggcctgagctggtgtgccatgtaatttacaagttttaagttttaaaagggaaagaaaagagatacatcctgtaaagtccccgccgtgattaagcctaatccgagtgccttttctggttaaacgttgtattgtcgtaatgacgttcttcagagttactgtatactgtgttccgcagacctaagggtttgcaaaatggtcggctattatgcttatctctc

SEQ ID NO: 65 - DNA, 1525 bp, Setaria italica
catgcgttttgtcatctcgcatcactagttgaagagccctgctcgcttctctctccctcaggtcagtccaatccggaggagttgggagagtggccatccgcgagaggaggatggcgagcagcaacggcaagccggcgcagggggaggaggggagggcggcggcggaggggtcgatcggcgggtacgagtccctgcacaggctcctggaggccaacctctcccccgagctcttccaggaagcaagccgattgttgttgggtctgaattgtgcacgacctcttgaggctatctcactgcctgaagccacaaccactcttgcggaaacgcacaattttgatgtgcaggccttccgttttagtgcagacaaagagtttctgaggcaaccacgagttgttcgagttggtctaattcaaaactcaattgctgttcccactacttatcattttgctgaccaaaagaaggctatcatggacaaaattagacacatcgttgatgctgctggtgcttctggtgtcaatattttgtgcttacaggaagcctggacaatgccttttgccttctgcactcgtgagaaaagatggtgtgagtttgctgaaccagttgatggagaatctactcagttccttcaagaacttgcacaaaagtataacatggtaattgtgagcccaatccttgaaagggatgtaaaccatggggagactatttggaatactgctgttgtaattggaaataatggaaacataattggcattcatcggaagaatcacatcccaagagttggtgatttcaatgagagtacatactacatggagggtaacactgggcatccagtgtttgaaacagcttatggtaaaataggagtgaacatttgttatggaagacatcatccccttaattggcttgcatttggcctcaacggagctgaaatagtgttcaacccatctgcaactgttggtgaactcagcgaaccaatgtggccaattgaggcaaggaacgctgcaattgcaaacagctactttgttggatcaattaatcgggttggcacagaagtgttcccaaatccattcacatctggtgatgggaaacctcagcatgcagacttcggccatttctatggatctagccatttctcagcacctgacgcttcttgcaccccatcactatcacgctaccgagatggcttgatcatctctgatatggacctcaacctatgccgccagatcaaagacaagtgggccttccgcatgactgctcgttatgagatgtatgcttccttgctatcagagtacttgaaaccagattttaaacctcaagtcattgttgatcccttgattaacaagagggcataaaactgaggttgcatggatttaaaaggaggccatttgtgctgggacttcaacagcacgtgtttacagtttagcagaataatctctttgaaggtgcagacggaaggaagtctctgttttcctttccttttttacatcctgtaaaaaaaacatttggtgtacattcgctgaagtttgtc

SEQ ID NO: 66 - DNA, 2289 bp, Setaria italica
ttctttcctcctcctttcctctccgtctccgtctctctccatctcctcctccgccttcttccctctccccgccacgccacgccgcattcgcatctccggatccccgccgcccgcctcgccgccgccttccactcgccattcgcgccgccccattccgccctcgcgacccaccccccgcctcgatctcgcctcgattccccgcgccccgattcgtctaagtctcgcttgggtaggaggagatggcttggggcgggggctgctcgggccggcgcgggtgatctctcctcgcgcggggagccctctctcgcaccacgcggaggatcccgtcccggctggtgcccctctcctccgccttgttcctctccatctctctgtgtctgcgcgcgcgctcgcgacttagggtttcctccttctgagctagcggatagcggattcgatctcctcccctcccgctgctctgtctctcccccgcccgcccgcccgccatgttctcgcacggcgctgattccgcacacgacgccgggggcgtcggcgtcagcaccgccggagccaccgtccccgcccgctttgtttggccctacggtggcaagagggtcttcgtatcaggctcctttaccaggtggtcagagcatttgcaaatgtctcctgttgaaggctgcccctccgtatttcaggctacttgcagcctgtctccgggaatgtaccagtacaagttctttgtggacggggagtggcggcacgacgagcgccaacctactgtatcaggagagtatggcatagttaacactctatacttgacaagggaaattaatcaaataaactcagtattgagcccaagcacacctggaaccaggatgaacatggatgtggataatgaaacttttcaacgtacggttacggtgtcggatggtaataatcaagaaggtcctcttagagtttcagaggctgctatacaaatctctaggtgccgtgttattgaatatctgagtttgcatacaggctatgatttgcttccagattcgggcaaggttattgctctggacattaatttacctgtgaaacaatctttccatatcctgcatgaacagggaattcctgtagctcctctgtgggattcgttcagaagtcagtttgttggccttctgagcccattggatttcatactcatattgaaagagctagaaactcatggctcgaacttgacagaggaacagcttgaaacacacactatatctgcatggaaagaggctaagcggcaaacttacggaagatacgaggggcgaccgcatcagcctctagtgcatgccaccccttatgagtccttgagggacattgctctgaagatattgcaaaatggcatttctacagtgccaattatttattcatcatcgtcagatgggtcattcccacagctgttgcatcttgcatccctttccggaattttgaaatgtatctgtagatatttcaaaaactcaactggcaatttgcctattctaaaccaaccggtgtgcacgattccactgggttcctgggttccaaaaattggtgatccaaacagtcgtccattggctatgttgcggcgtactgcatcacttagctctgcccttaacatgttgattcaagctggagtcagctcaataccaattgtggatgataatgattcgctggttgacacttattccagaagtgacatcacagctctagcaaaagacaaggtctacacacatgttcgcctggaggagatggccattcagcaggctttgcaacttggacaagatgccaatacaccttttggttatttcaacgggcagaggtgccagatgtgcctccggtctgatcctttgctgaaagtgatggagcgactgtctaatcctggggtgcggcgggtgttcattgtggaagctgggagcaagcgtgtggaaggcataatatcgctgagtgatattttcaagttcttgctgagcttgtgagaagagcatggcatagatggtttgttgtgacaagtgccggagttttaactgtagcaaacagcagatgtgaagcaagctgccgtatgccatggacgaacgggtctctctgtctgtctgtccgtggcctttggataagtaaggccaggattaaaggtggctgcttgtcttcgcagataatgggcattattcagttcagggtctgtctgtaaagttccttgttttttttttaattttgtgccccctgttacacaaaatgtggtgatttttatttattggattgtttactcttgatggttgctcggccgctgagagaccgacc

SEQ ID NO: 67 - DNA, 1768 bp, Setaria italica
cccaatcccatccgtcgcgaacgcagaagatcccgtcccgtgccagcctgcggcggcggcggcggtggactggactacaaagtagccgatagccacccattccatccaggccgcctccaccccgtatccaccccgtctcgcggcctccctgccgctcctgccccccggcaatggctcggctcgtgctatccgagtgctgcggcctcgcgccgctccgcctgcgcgcgggccggggcgccattgcggcgccgtcggcccccgcatcgctctccgccgcggcgctgccgcggcgcgggcccgcggccgcggccatccaccgcgactgggcgctccgcgtatccgcgcccacgcgcctcacctcgacggtcgagggggaggacagggggagctccccgctgggggaggaggccgcgggcggggagttcgaccccggggcgccgccgccgttcgggctggcggagatccgcgcggccatccccaagcactgctgggtcaaggacccctggcgctccatgagctacgtgctgcgcgatgttgtcatcgtcctggggctggccgccgccgccgcgcgcctcgacagctggctcgtctggccgctctactgggccgcgcagggaaccatgttctgggcgctcttcgtcctcggccacgactgtggacacgggagcttctcaaacaaccccaagctgaacagcgtggtcggccacattctccattcctccattcttgtcccataccatggatggaggattagccacaggacgcaccatcagaaccacgggcacgttgaaaaggacgagtcctggcacccgctaccagagagcctgtacaaaagcctggacttcatgactcggaagctgcggtttaccatgccattccccttgctcgcattcccgttatacttgtttaaaaggagtccagggaagaaaggatcacacttcaacccaagcagtgacctgttccaacctaatgaaaagaaggatatcataacatcaaccgcttcctggctggctatggttggtgttttggctggtctcacctttgtgatgggacctattcagatgctaaagctctacgctgtcccatacttggtatttgttgcttggctggatatggtcacatacttgcaccatcatggccatgaagacaagattccttggtaccgtggaaaggaatggagttatctgcgtggaggactgacaacgctcgatcgggattatggattgatcaacaatatccatcatgacattggaactcatgtcatccatcaccttttccctcaaatcccgcattaccatctcattgaggcgactgaggcagcaaagccagtgcttggcaaatactacaaagaaccaaagaagtcgggtcctctcccgttgcatctatttggggtgctagcggaaagcttaaagcaagatcactatgttagcgataccggagatgtactctactatcaaactgacaagaaaatgacataaaccatagcaagtagcgaattcttcattcttctcaggggggctgtgcctgaagacttgaccaccttcctgggatttctgattggtgtgcctgagtccattgatatgtcgattcaagaatgtaagttggcaaagtattatcatgtaaaagggggtaaatgtagttctttccaatgatggaaaacggaggccgcctccgatgtaacaaacatgcaattctttggacaagaggtatattttatagtaaagagcgaaaaaagagcttagttacctgaaggctttctgagtttctg

SEQ ID NO: 68 - DNA, 1553 bp, Setaria italica
ccgaccgaccaaccaacctactcgccggcagcggcgaacctgcggatcccttccctttccctcccacgggaccctcccctctggtggtggctgctgttccccgcctcggatcctttccgttccccgctccctgatgcggcccgggccgccgccgccgcctccggatccgctgatctagctgctgctattgctgtccctgcttggttgggttcaggaggaagaggagggagtgggagatgatgttctggagggacggcggcgggagcgggagcgggagcgggcgggactccctcagcggcgggccgccctgcggccaggtgcgcgtcctcgtcgtcggcgactcaggtgtgggcaaatcttcattggtgcatctcttattaaatggttctgcagttgctcgaccagcccaaacaattggatgtgcagttggtgttaaacatattacttacagtagcccagggagttcatctaatagcatcaaggctgatgctgaaagaaacttctttgttgagctttgggatgtttcaggacatgagcgctacaaagagtgccgttcactcttttattcacaaataaatggtgtcatctttgtttatgacctctctcagaggaagacaaaaacaaatttgaacaaatgggcagtggaggttgctgaatctgggaccttttcagctcctcttgggtctggtggtccaggtggccttccggttccttacctagtgattgctaacaaagtggatattgctccaagagacggtagaagagtgagcagtgggaatcttgttgatgttgctcgtcaatgggttgaaaaacaaggcctacttccaccaagtgatgaacttcctctcgctgatagcttccctggcaattctggtctgctcacggctgcaaaagaggcaagatatgataaagaagctctgatcaagtttttccgcatgttgataaggagaaggtatttttcgaatgagcttcctgccccgagcccatggtcactcacttccagagaggataccatccttcctgtagaaactgtgaatgatgatgacctgttccaaagaaaaagctacgggagtcagagctacaaatacaatggggttgctccactgcctgcacagcgaaacctaactccaccccccacactctatccacagcagccaatgtcatcttcatcagagaactacagatatcacagattctcctcttcatcaattcctgattcaggcggtggtagaccaagccgagcagacatcaatatatgatgacctgggtctttagccattaccacctggaacgtggaaaagaacatgacgcctgggctttttgaatcccagccttttgatctttttgagttgttcatctgtcttgattgtaagatgtcatgtttccagggccctctttttaacataatatttgtgggatcactagtgataaattcttttattcatccctgtatatctttgaattttgtgtatgagttcaatagtcattttagagttacagaatggtgtacagtaatattctgtaatagcaatttgaatcaatctgtttcgccc

SEQ ID NO: 69 - DNA, 1498 bp, Zea mays
tcgcaacctgatccctattccgatctcgaggacgccacgccacgccacgccacgctcccgtcctctccgctggcctcgtgccccctcgtcccaactcccaactgccgatggggaaggagcaatccggtgtgcgcgcgcgggcgcggaagtgaaccccggttgagtagtaggtgggagatcgaggtcgcgcccttgccccacacgccactaaaggccgcgccgacgggctcatcagacgctttggagtttggacgggctcgcctcggccgctctggcgcttgtgcggtgggtgaagcgcgggtgctggtgcgggaagcctcgccagacctagcgctgccgactgccgagctgggtgcgggcgcgaggagtcgacgggaagacaagggtgaggaattatgagtgaaacagggcacactgtacaagtcactaacctctcgagcagagtatctgaaagtgatcttcatgagttcttttcgttctctggtcctattgagcatatagaacttatcagatcagaaggatacggtgccactgcttatgtgacattcaaggaacgctttgccttggaaactgcagtattgctcagtggggctactattgtggatcagccagtatgcataacctattggggacaacctgagggaacttttaatttctgggacaggccaacttgggaggttgaagaggaaatcgaatacaggaactaccaaacatgccagtacaacactactccgcaggaagcttttacagtggctcaagatatcatgaagacgatgctagaaaaggggtacgtgctcagcaaggatgctttggctaaggctagagcctttgatgagtcctatggattaacagctgcagcagcagccagggctgcagagctgagcaagagaattggtttaactgatagggtcaatgctggtgttggtgcaatgcgatcagtcgatgagacatatcgcgtaagagagacaaccaagacggttgctactgccactggaagaacggcagcaaaggtggtaaatggcatcgtcaccagcagctacttctctgcaggagccatgatcttgtctgatgctcttactagggctgccaaggccgcggcagatctggccgctcatggtaggcagaattaagtgaaaaatagacataaagttcatccttgcagttactaaacatgaggacgaacaccttcaagtgatgttgcttgatgtatatttatgacacaacagtgtcgtaaattaaaaggagacgatcactgcgtttggaacaaattgtttgctctgataagtttgattattgcaaatgtagtcaagtgatcgtgcagtcatgtttcggacttcctgcgcatttcatattcgcgcattgctgttgagtatctggagaatcaaagcaactgttctcccctagacaagtgttgtattacgaatataatatccctgattccagagcaaaaaaaaaatcatccttttttcaacagttttataggaccttctacagattg

SEQ ID NO: 70 - DNA, 3044 bp, Zea mays
ttccaccacgcgctcgttgtctcttgtcgctgcagcctcgtcccgtccaatccttccaagtctctcttcttgctgcaggctgccccaagcccaggctcaatccggctggacgaggagacggcattgctcgcatcgcctgccctgccctgccccccatgcgtgttgtgcgcatgaacagaggctaggctaccaacaacgcatagcatagccatggatcccgagttcggcgtcggcacggcgccacaaaaggggcggcgggcgtggcggacgacgctgctgctggcgtaccagagcctcggggtggtgtacggcgacctcagcatctcgccgctgtacgtgtacaagagcaccttcgccgaggacatcacgcactcggagaccaaccaggagatcttcggcgcgctctccttcgtcttctggacgctcaccctcgtcccgctcctcaagtacgccaccatcgtcctgcgcgccgacgacagcggcgagggcggcacgttcgcgctctactccctcatctgccgccacgccaatgtcagcctcctccccaaccgccaggtcgccgacgaggagctctccacctacaggctggagcgcccgcgcgaggccgccgggaggtccggcctgctcagggcgtggctggagaagcacacgaggctgcacaccgcgctgctcgtcatggtcatgatcggcacctgcatggtcatcggcgacggcgtcctcacgccagccatctccgtgttctccgccgtctcagggctcgagctctccctgtccaaggatcagcatgaatatgccgtcatcccgataacctgcgccatactggtgttcctgttcgcgctgcagcactacggcacccaccgcgtggggttcctcttcgcgcccatcatcctcgcctggctgctctgcatgagcgccatcggcctgtacaacatcgtccgctggaacccccagatctaccaggcactcaaccccgtctacatgatcaggttcctcaggaagaccaagaagtccggctggatgtcactgggaggaattctgctgtgcatgacagggtcagaagcaatgttcgcggatcttggacacttctcctacagcgccatccagcttgctttcacttctctagtgtacccttcactgatcctgggttacatgggccaagctgcttatctgtcccagcaccataaccttgacgcaagctaccagatcgggttctacattgcagttcctgagtgtgtacggtggcctgtgctggtgctggccatcttggcgtccgtggtgggcagccaggccatcatcagcgggaccttctccatcatcaaccagagccagtctctgagctgcttccctagggtgaaagtcgtgcacacgtctgacaaagttcatggccagatatacatccctgaggtcaactggatcctcatgatcctctgcgttgctgtcactgttggtttccgtaacaccaagcacatggggaacgcgtctggcttggccgtgatcacggtgatgctggtgaccacgtgcctcatgcccctggtgatcatgctgtgctgggaccgctccccctggctggccctcgccttcttcctcttcttcggctccatcgaggcgctctacttctcggcgtcgctgatcaagttcctggacggcgcgtgggtgcccatcctcctggccctcatcctgctcgccgtcatgttcgtgtggcaccacaccaccatcaggaagtacgagtacgacatgcacaacaaggtgaccctggagtggctgctggcgctgggcgacaagctgggcatggtgcgcgtcccgggcatcggcctcgtctacaccgacctcacctccggcgtgcccgccaacttctcccgcttcgtcaccaacctgccggcgttccaccgggtgctggtcttcgtctgcgtcaagtcagtgccggtgccgcacgtgctccccgccgagcgctacctcgtcggccgcgtcggcccgccgggacaccgctcctaccgctgcatcgtgcgctacggctaccgcgacgtgcaccaggacgtggactccttcgagacggagctcgtcgagagcctcgccacgttcatcaagctggacgcgctgttccgctgcagcgacgccgccggcgaccagcagcgggacagcagctactacgagcgcgagaacgcgctcacggtcatcgggagcaacccgctgcggcgccacctggccctgggctacgacgactcccactcccacgacgacggcgcgtcgtcagctggctctgaccgcgtggacggcatagagctcgccgcggcggcgccggcgccggcggtcgttaagaagcaggtgaggttcgcggtggctccgcccaggagccccggtgtggacgagaccgtgctggaggagctgcacgagctgtgcgaggcgcgcgaggccggcacggcgttcatcctgggccactcgcacgtgaagaccaagcccgggtcgtcgatactcaagaggctggccgtcggcgtcggctacaacttcctgcgccggaactgccgcggcccggacgtggtgctgcgcgtgccgccggcgtcgctgctcgaggtgggaatggtgtacgtgctgtaaccagaacgtggcggtgatgggtgactgcgatctctgcgtccggttttcgctgcgtgaactacggatctctctgctgtctgatgtgctattagagcatctccaacaacgtgacctataaaaatgtcttataatttaaaaataagtaaattttatagaatttagggcaccaacaaagcaccccgctccaacagtaaagccccaaatctagattatagggcagcccactacggtgtagtatatttgaggcacttgagagagtggcctatagttttttgacaaaatttgttgaattgaggcactgttggagtggtttttcctgtgtagagccctatatttcaatttgaggcactagtttgaggcattgttggagatgctcttatgcacatctcgatttgcccatgtataaattgtaacgagatgcgatggtaacagaggatgccctgtcatttccc

SEQ ID NO: 71 - DNA, 1966 bp, Zea mays
caaaacagccagccaaccaaccaaccagaccagggatggatggtgcgcaccaagaaagggggcaccgcaccgagccaatgatctgcaagaagagaggtaggatttaggcacggcacctatagcccctgacgagagagagagggagagagatttggtcttggataagagtggagagactggagacgggtgggtggagtgagagaagtcactcggggagcctccagattctgaatctcccgcaacccgtctcatcgccggagtggagttccaggcgagtgattatcgagccagtaagccatttgcaagcactgaactgaaccctcagagcgttgttgcgatggaccaaatcgctacccccgacgaaacagcacatgcctctgcaccttcagttcataagctgtttgatgctaaattaggccaccatagcgtgatggatggcaccttggcatccacgagtcagtcatcaaacatcaagacccagctgatccggtcatcaagcttgtcaaggagcatatcagttaaccttgagaagaggagccctgaatctgatcctgaaagcccacagtctcacgtctcgcatcctaaatttgcagaacccatgttctcgaattcttcgacgttctgcacaagcttgttttcgtcatcttcgacaacagagccatgccgtcaaatgggcactttacctttcctgcctcacccccctaagtgtgagcagcaggtttcagctggtcactcatcgagctcctctctgcttttaagtggtgataccggtttagatgtggctgaacagtcagatgatctgaacgacttgctcaatctttcgggagatgcttctgatggcagcttccatggagaaaacaatgccttagcttttgacgaacagatggaatttcagttcctgtctgagcagctagaaattgccatcactgacaatgagaagaatcctcatttagatgacatatacggcacaccaccacagctgtcatcacttccagtatcatcttgctccaatcagaatctagggtcaccagttaaagtccagcttagctcatctcagtcatcttctagctctgcaacagctaacaagtcaagattgaggtggacacttgagcttcatgagcgttttgtggaggccgtgaaaaagcttgaaggtcctgaaaaagcaactcccaaaggtgtgctgaaactaatgaaggtagaaggtctaacaatttatcatgtgaagagccatctgcagaagtatcggcttgcaaaatatattcctgagcctaaagacgataagaaggcttcctcggaggataaaaaagcacaattaggaaagggcagcattgattcaagcaaaaacaagaatttacaagtggcagaagctctaaggatgcaaatagaggttcagaaacagcttcatgaacaattagaggtgcaaaggcagttgcagctacggatagaggaacatgcaagatacttgcagaaaatactagaagagcagcagaaggccggcaatgtgccactaaaagctccaaccaaagcacaagcaacaaagtcgtcacctgaatcgacgtcagacgagagaactgaatccgaggtagacaccatttctccgcggccacccaagaacaggaacccgggtgtagacgcagaatgcaaatcgccgggaaggatcaagcgaacgaaggttcaggctgatcttgaaaacgagggcctgtgttcatagcgagggctcatgttcgtagctgtgcgggctcgccagtgattttctgaacatttgcacttcccgttttagttcaggagctatttgttactgtttgtaacttgaacagccgtagtatctccagcgatctgttgatatcttggcgtgaattggacttgacatcttagccattgtattatatagtaattcgcctttggaatggaaatggaataggtttatgtttgaatccccacccgatatatatgggtttgtttgttt

SEQ ID NO: 72 - DNA, 1322 bp, Zea mays
ccgtaccacaaaaaaaaacacacacacaggggagggagacgagacgagatccaaaattccctggcggtgggctgtgggctgtggctggtaataaagctcgcgccacgggagccacgcacgcggacgccggcatattcgccaaacgcatcgcatcggcctcagccaccggcgcggctgccctcctcttctccgtcgatccggagaggactttctctcgcctgctcgtctctcccgcccccgccggccggccggtcctcttcccggcccactccattccgatcgaccatggcggctaccgcccccaacggcaatcccactgtcagctccctcgcggcaaccgttccggtccaggcggttctgttcgacatcgacgggaccctgtgcgactcggatcccctccaccacgtcgctttccaagagatgcttctcgagatcgggtacaacaatggcgtgccgatagacgaggagttcttcatcaagaacatcgctgggaggagtgacgtcgaagctgcccagaacctgttcccggactgggagcttgagaaggggctcaaattcctagaggacaaggaagccaaatacaggagtctggcaaaagagcgcttggtgcctgtgaaaggcctcgcgaaggtggtccagtgggtgaaagaccacgggtacaagcgcgcggcggtgaccaacgcccccaggatcaacgcggagctgatgatctcgctcctgggcctctcggacttcttccaggccgtcatcgtcggaggcgagtgcgagcagccaaagcccgcgccgtacccttacctcagggccctcaaggagctccaggtgtccgcagagcacagcttcgtcttcgaggattctcctgctggtatccgggctggcgtcgcggcggggatgcctgtcgtcggtgtggcgacgaggaacccggagaagtccttggtggaagcaggagccgcgttgctcgtcaaggactacgaagatcctaagctctgggcagcgcttgaggagatggacggagaggaagctaagctgaagaaggccagcgaatgatctgatatgacgatgagccattgattagatttattgcagattaaatctgcctccagcatgattctgttcctagttatgcgctgcggagagagctcacctcatcagggtatttatgagattctagcttcgtatattgtttttcttcttcttgattgaactgagatcaaataagacaaagctgctgtgccttgttgtgtgccatctgtgtatgaacttttcggttcagcctccagcagtctttaatctgaaagaaagacgaggtaggaattctctccctc

SEQ ID NO: 73 - DNA, 1316 bp, Zea mays
cgcaacgcaaacccagacggcccgccagacccagcggtcgcttactcgcatcgcagcgcactcgcgccacagtcggcatcacagaccagatccctgcgggtgcggcggccatggccgagaacttccaactccagggccggcacggcaagtcccgcgtccgcgtctcccgcgtctggcgccgcccggccgcggcggggggcgacgtcatcgttgagtggaacgtcgccgtcagtatcgtctccgactgcctcccctcctacacctccagcgacaactccgccatcgtcgccacagattccatcaagaacaccgtgtatgtcaaggcgaaagagtgcacggaagtggtgtccatggaggaattcgccgtgattcttggaaggcatttcacctcgctgtaccctcaggtttcagaggccacggtgactatcgtggagcgcccatgggagcgtgtgactgtcgacggaaagcctcattcgcatgggttcaaagttggtgttgagaagcacagcacagaggtcattgtaaaaaaatctggaagcctgcgtataaattctggaattcaaggatactcgctgctaaagacaactcagtctgggtttgaagggtttgtgacggatcgctataggcttcttcctgatacaagggaaaggatagtagcaacagaagttactgcttggtggaggtatccctttgaacatgtttcgcagctcccatcgaagccattctgcttcacgcagagatatcaggatgtaaagaaagtccttgcagagacgttctttggtcctccggatgttggtgtgtatagtccatccgtacaaaatacgctatacctcatggccaaggaagtccttacaaggttcccagatatatcgtcagtccagcttagaatgccgaaccttcactttctgcctgtcaacttggggagcaaagaagctccgctggtgaagtttgctgatgatgtgtacctgccgacggatgaaccacacgggacgattgaagcaaccttaataagccgtcccatgtcaaagctgtaaaaaaaatgtagtcgtcaggctggtattagactcctgcttcgtctccccagcatccccaggcttaaaatggacagtaagctgtaagggaaagataaactgtcataaatcgtagcccctatgctttatgtgtggtggtggtaataagtgcacagacttgtattggatgttgtcagctgtagcctgtaggcgtccagcttgtgacgtttcgccactgtaatcgtgtacattgctcgtcttgtgtggaaaccagttaatatctttggaagctttggtcagttttac

SEQ ID NO: 74 - DNA, 3182 bp, Zea mays
attctgatcctgccgctacccctccgcttccgccctctcgctttcgttgtcatgaggagcctcaccgtggcaagccgccacccgggcgccgctttctctacccgccgccgcccccttcttcaccctgccgcagccggaagggactcgaccttccagcggtgctggcgatgggaaaaaactcaggacagctccttcgggagctcactaaggaccagccgccttccaagaactgtgcacggagatattttgaagaatttgctcgcaccaactgctggtgctgtttcagttgagcaagctgaagctattgctgacctcccaaaaggtgaaatgtggtcggtgcacaagtttggtggcacatgcatggggacctctgagagaattcacaatgttgctgatatagtccttcgtgatccttctgagaggaaactggtagttgtatctgcaatgtctaaggttaccgacatgatgtataatcttgtaaacaaggctcaatcaagggatgattcttacattgctgtacaggatgaagtttttgataagcatatgacaacagcaaaggatttgcttgctggagaagaccttgcaagattcctgtctcagttacatgcagacatcagtaacctaaaagcaatgcttcgggccatatatatagctgggcatgcaacagagtctttctttgatttcgttgttggtcatggagagttatggtctgctcaaatgttatcatatgcaatacagaagtctggaacaccatgcagttggatggatacaagggaagttctagttgtgaatccgtcaggagccaaccaggtagatcctgactatttggaatctgaaaaacgacttgaaaaatggttttctcgatgtccggctgagacaataattgctactgggtttattgcgagtacacctgaaaacatcccaacaaccttaaaaagagatggaagtgatttctctgcagccataattggttcccttgttaaggctcgccaggtgaccatctggactgatgttgatggggtatttagtgcagatcccagaaaagttagtgaggctgtaatcttaagcacattgtcgtatcaggaggcctgggaaatgtcatattttggggcaaatgtcttgcatccacgtactattatacctgtgatgaaatataatatccccattgttataaggaacatattcaatacttctgcccctggaactatgatctgtcaacagcctgctaatgaaaacggtgatttggaggcttgtgtcaaagcttttgcaactatagataaattggctttggttaatgtcgaagggactggaatggctggtgtcccaggtacagcaaatgccatatttggtgctgtgaaggatgttggagcaaatgttatcatgatatcacaggctagcagtgaacactctgtatgctttgctgttccagaaaaggaagttgcattggtttctgcagccttgcatgctaggtttcgtgaagcattggcagcagggaggttatctaaggttgaagtcattcataattgtagcatccttgctactgtcggcctgaggatggcaagtacacctggagtcagcgcgaccctttttgatgcactagctaaggcaaatattaatgtaagggcgatagctcaaggttgcagtgagtacaacattactattgtactgaagcaagaagactgcgtgcgggctctgagagctgcccactcaaggttcttcctctccaaaaccacactggctgttggcatcattggacctgggttgattggtcgcacactacttaatcagctgaaggatcaggctgctgtcctcaaggaaaatatgaacattgatttgcgtgtcatgggaatagctggttctaggacaatgcttttaagtgatataggagtagatttgacccagtggaaagagaagctacaaactgaagcagaacctgccaatcttgataagtttgttcatcatttgtctgagaatcacttttttcctaacagagttttggtagattgcacagcagatacaagtgttgcatctcactattatgattggctaaagaaaggaatccatgtcatcactccaaacaagaaagcaaattcagggccacttgacaggtatcttaaacttagaactcttcagcgtgcatcatatactcattacttctatgaagcaactgttggtgctggcctccctatcattagcactctgcgtggtctcctagagacaggtgacaagatattgcgcattgaagggattttcagtggaacgttaagttatatttttaacaacttcgaaggagcaagaacctttagtgatgttgttgctgaagcaaaaaaagcaggatacacagaaccagatccaagagatgatctgtctggtactgatgttgccaggaaggtcataattcttgcaagggaatctggtttggggcttgagctttctgatattcctgtacgaagtcttgtgccagaggcacttaagtcatgtacctcagccgatgaatacatgcagaagttaccatcttttgacgaggattgggcaagagagaggaaaaatgctgaagctgcgggagaagtcctgcggtatgttggagtggtggatgtggtcaacaagaaggggcaggtggagctgcgagcctacaagagggaccacccgttcgcgcagctatctggttccgacaacatcatagccttcaccacctcgaggtacaaggatcagccactgatcgtgcgaggtccgggggctggtgcagaagtgactgcaggaggcgtcttctgcgacatactgcgcctgtcttcctaccttggtgccccctcgtagtctgtcaaggttttgcggtgccgtggtgttgtgttgctgctctactactggttttttttgttgttgttgttgttagtgcttggaatagctggagtaagtatggattaagtgagttctggggtgttaagggttgggtgtcttagttagaaggtcgtattggagggaatggaatccgttcaccgttcttgcgtgttgcaataatcttgtgtggagtctccaggtttgttcggttgctaatagtaagccaagccaaaatggcgagtctagtgaagaaccaaataaaaaaaggctgggctgtaaggaatgtatccacacgttacttcattggtgtcaccataaatatatacctggatcatttggcttggttt

SEQ ID NO: 75 - DNA, 1033 bp, Zea mays
aatagggtagacgcccaactcgaacctgagtacctgagaaatggcggccgtctcctccacctcaaccgcctcctcctacttctccccgcagccgcagctgccgatctccaccgccgaccctgccgccagcaaaagtaggttgatgcggcagccacggcggagcagcagcttcgtgatggtggaggcgtcctctgccagcggcagcgacggcggggtggccaggacgaagagcctcacggaggacgacctggaggagctcaagggctgcctcgacctcggcttcggattcgcgtacagcgagatacccgagctctgcgggacgctgcccgcgctcgaactctgctactccatgacccggaggttcctcgacgagcagaaggcgccggggcaggatgaggagttggagcctgcgtcgccgccgctccccaattggaggatctctggcccgggtgacgatccagaagaagtgaaggcgaggttgaagtattgggctcaagctgttgcatgcactgtcaagctctgcagctaaactaaaggtcggatagaggctgaagaatctggttatatggttttgggatacagggagcggaagggggtgcttctgctctctggcatggaagcgacatgagtgatctcatctgcttctacaaaaaaacttgggaagggggaggaaccatgatacggaacagcgacagacctcgattcagaatttgagatccatggtctgagcttctacgaaagggttcggaagccttgccattcctcagggtgggtggtccgcatagtgcagcgtttccaaatgcatgacctgctggttctttttgctgtttccttgtaatgatcaataggtgctctaattgtcgcactcttgtaataatgtactgaatcgaattttgagttttggccttttgggtactgatccaagggttgattagttccaacattggtttattttgtgctactctgatattgccatgtgcattatgctgttctacacgttcgtagaagttaatagcgcgtttggtttcagtaa

SEQ ID NO: 76 - DNA, 965 bp, Zea mays
agtgcacggggactctagagtaaatcccggtgctaccggcggcggcggcgacgaatcgagcaggcgcggcggccatggcggcggcggttgagagcgtggtggtggtccataacgtggcgaagcggcacaacgtggggacgctggcgcggagcgcgacggcgttcggcgtcgcggaggtggtcgtcgtcggccgccgcgatgtcagcgcctttggcagccatggcgccacctcgcaccttcgcttccgtcacttcgtctctctcgcgctcgcccgcgcctacctcaaggatgagagaggatgtgacatttgcggcgtggaaatcaccgacgacgcgcagccggtgaccgcccacccgttccgtcggagcactgcgttcctcttcggcaatgagggtactggactttcacaaaaagagtgcgagatctgtgacttctttgtctacatccctcagtatggtggtggaactgcatctctcaacgttactgttgcagcttcaattgttctccaccactttggggtctgggctggctttactgaacgaggccgagagggcaacaaattcgtggtggctgaaagaccacaggggcactcgaggggactttactgtacagactcggttgaagcagtggttgaagagcggaaaatgcgaaaagaaaatgcctgcgatgtactcgaggaaaatgggtgcagccaccttcaggaatcaaacggtctagacttgatgtttgcagactagagtatgacaacatgttatcccatctctgatgttaaatctactccctgcatcctcattgatggcacaaagttgcaatacagaacatgacagggcttatgagagagagagagagagagaaatttatcctgacacacatgtatggttcacatttggttgtcttcttaaaacaagacgcgacaagatattttttttacataatctacaactcacagttatttcaaccaaata

SEQ ID NO: 77 - DNA, 1310 bp, Oryza sativa
acgtctcctcaactcagatctcccccatttcaactccctcctcctccactttcccccccgcatcgagcagcgaagcggcgatggcggaggagcagccgcgcgcggcggcggagggcggcggcgagacgctgatggagaagatcgccgacaagctccacatcggtggggacgggtcgtcgtccgactccgacgctgacgagcgcaagcagccgaagccctcggcgccgccggccccggccgaggtcgcaacggagtcgtttgttgattcggctgctgctgccgcggccgaggccaaggccaaggtgttccgcctcttcgggcgcgaggagcccatccacaaggtcctcggtggaggcaaacccgctgatgtgttcctatggaggaacaggaacatctctgccggtgtactaggcggtgccactgcgatctggatcctttttgaattgcttggctaccacctcctgactttcgtttgccatgggctcatattctctttgggtcttctctttctctggtctaacgcctcatcatttattaacaagtctcccccgcggatcccagaggtgattattccagaagatttggttgtcaacattgctctatctacacgttatgagatcaacagggcctttgccaatcttcgtcagattgctcttggccgggacatcaagaagttccttattgtgattgctggcctttggttgctttctgttcttggaagctgctgcaacttcttgaccttggtttatattgtgtttgtggtgctgcacacagtcccaattctgtatgagaagtatgaagatcagattgactcatatggtgagaaggggtgggttgagattaagaaacagtatgctgtgctcgatgctaaggtcctgagtaaagtaccaaggggccccttgaaagacaagaagcactaggaagaggtgatgcagtgcctcgtggcaggtgatagtagtggttgggttgtggttcttgagatgcactgctgtcacctattgccttgtgttgtgtatggctcttttgttgtctgatcttgatgggagtagctgagtagcttgcgctacgacagtatgcagctgcagcgcatgctttgctccatcgctgtttgatttttgatctgtaagatgtcgcatgcatattgtttatgcgatattgttttgttactaagattgctgcattttggaatttggtgatatttatgaaccaatgttgagactagatgtcatctacccgtcatttttgttgttgacgttggtgaaaaatcttgttatgattgcgctattaaagattcagcctgcgatgtgcac

SEQ ID NO: 78 - DNA, 674 bp, Oryza sativa
atcagcaaccaaagcaagaagcaattcttgagctcaatcagcaacaacatctatctccttcttgcttagttaagtccttcgccctcccaagaagaagaagatgtcttgctgcggcggcaactgcggctgcggcagcggctgccagtgcggcggcggctgcggcggatgcaagatgttccctgatgtggaggccacagccaccaccaagaccttcgtcctcgctgctccatccaacaaggcgagctctggaggaatggagatggcggtggagagcggcgagaacggcggctgcggctgcaacacctgcaagtgtggcaccagctgcagcggctgctcctgctgctcctgcaactgaatctatcgtcgtcgtcgcccggctgcatgaggatttatcgtatggatgctgctactgtcgatcagagctttgatcgaggccttaatttgcttgcattagtacccagcttatatgtaggcaggccttgccttttgctctgacgcctaaataaaaccgtcgtcgtcgttgtcagtgtgtgcgtgtgtcgatcaatgttggatggatccctagctagcttggatggatcatctatcatcatggtgatctcatcatgtactcctgctccatctcctcatgcgtgccaggcttcttaatataatctacctctgctttcatccca

SEQ ID NO: 79 - DNA, 2547 bp, Sorghum bicolor
gacgccgggcggcacaaggagaggaatcggcagctccgcccgttcccaccgcgttctcatcgatctctgtgtgtgtgcctccgctcccgctgcgagatgcgtccaccgcgacgtcttgctaattgccgtccacacgggccaagatgagcagagacgtgacggtgccgccggtgccgtccgggcccggcatataacctttctccggccggccgctccaggcactccatgttttttcgcgcgcggcgcgcggccgcacgacgaagccacacccacacgcccaccacacgcgcggccggccggacgcagtcggtcgcgatgggtttcttccagcaatgctccagctccagcagctccccgctgctccccgtgctgctcgcgctcatcggcctgtactgcgccgccgccgtctcgtgctcggcggccgccgcgcctctgccggcgccggagacgacgacgacgatgcacgagagctacgcgggcaagtcggagttcaggacggtgaaccggaaggagctcgactcgtgcctcaacccgagcccctacctggccatcaatgtcagcatcaccggcggggccggggccggggccggggccggggcggcgatccccgacgaggcgttcctccaggtcaccgtctccggcgtcctcaagcccgacgcctccgactgggtcgccatgatcacgccttccaactccagcgttgctggatgtcctctgagtggagtgaactacgtggagaccggcgacctggcgaatctcccgcttctctgccactaccctgtaaagtcccagtacctgacaagcgaccccgggtacatgggctgcaagaacgcggggtgcgggaagcgcgacgcgtccggcgcctgcaaggcccgcacctgcgccgccacgctcaccttccacgtcgtcaacttccgtaccgatgtcgagttcgtgctcttctccggcggcttcaagacgccatgcctcctcaagcggtccggcgcgctccggttcgccaacccggccagcccgctctacggccacctctccagcaccgactccaaggcgacctcgatgaagcttacctgggtgagtggagacgggaatccgcagcaagtgcagtatggagacggaaagtcatctacttctgaagtcgcaacgttcacgcaggatgatatgtgcagcgtccccgtgctgccgagccctgccaaggatttcggctggcatgaccccggctacatccactcggctgtcatgactgggctccagccatctcagtcctacacttaccgctacggaagtgattctgtgggctggagtgacagagttaagttcaaaactccaccagctgctggttcagatgagctatcctttgtgatctatggtgatatggggaaggctccactggacccgtcagttgaacactacattcagcctggatcaatttctgtgaccaaggcagtggctaaagagatccaaacaggaaacgtggactccattttccatataggagacatcagttacgccacaggcttcctggtcgagtgggacttcttccttcacctcatcacgccactcgcttctcaagtgtcctacatgacagctattggtaatcacgaaagggattatgcgaactctgcatccgtgtatgtgactcctgattcagggggtgaatgtggagtcgcctacgaatcatacttccccatgcctgctgtcagtaaggataagccatggtattctatagagcaagggaccgttcacttccttgtgatgtccaccgagcatgagtggtcggagaagtcagagcagtataattggatggacgaagatttgtcatcggttgatagatcaagaacaccatgggtgatcttcattgggcatagaccgatgtattcctcccatggtggtatactgcccaacgtggattccaactttgttgcctctgttgagccactcctgttcaactaccaggtggatttggttttcttcggccatgtacacaactatgagaggacctgtgcggtataccagggcgattgcaaaggcatgccaacgaaggacaaaaacggaattgacgtctatgacaacagcaactataccgcacctgttcatgtcattgctggagcaggagggttcaccttggacagcttccctaacaatggggaggcctggagcttatcaagggtttcggagtttggctatggcaaggtgcatgctacaagaaccgatatgctggttcagtttgtaaactcaagttcgatggaggtacgagaccaatttaggattgtgaagggagcttcggtaaacaagacaccgagcctgatacttcaataatagctgctgctcacaacagaaagaagatttaacgggacatattctcccttttttggaagaagaatactatttgtttttgtatactgtaaataggtgctaaagaatatattattgtatattctacagataactgtgtatctacaacattacatcaatagatggtccttttaaattagtcccttagtccgtcagcatgtgaaaggagacataagtgttatttaatgcttaata

SEQ ID NO: 80 - DNA, 1602 bp, Sorghum bicolor
catacagaggcaccaccccagcccacccccaccccaccccaccaccccaccaaaaaaaaaaaaacgcattccgcagtccgcacacgcgcggctggagggctgcggctgcgtggcggaggcgacggccgacggcgttgcggacgccgtgggtgggtgtagaggccgagagggagacgcggggaagctagctgctagcgtagccgggcgcggcgggcgtgggggctcgcgctgcgctgtcgctccatgtcggccaacggcgagagcggcggggatccggcggcggcgcgccgccggtgggatctcaccaacaaggggcccgagagcactccaatgttgaaagaggctgtggaaatgtctacagatgaagaatcagatggtgttgttatatgccatctgaatggtaacaccgatggatgcgacgaaaccattagtggtagtcgtgatgatgatagcccagaaggccaggaaactaattccattaaggaccctgatgtacaaggtgacacacaggaagacaagtgtgtaaatcaagattcactgaagttgattgatcaagagaagtctgctccccccaagtccccagcaaagtctgcgactgccagttctggatcggagaggcctaaacgtgttgttccccaaccattctctctttctacgcaaagaaggtcatcgggagtaaatggtggtgtgaccaatccatcggcaaataaggataaatctggtgataaaagtagcatatctccagcaagcatgacaaagaagagtacgccggtggcacctaagaagactttgcagcctgagcaggcatttcaccctgtggaagaggactcttgttctgtgacttcctcaactacaacatcaacaagagctggcagaactaagacaactgttcccgttgccccttcatttgtgtgtgctaaccgtgctgacaagaggaaggagttctacacaaaattagaggagaaacataaagctttggaagcagagaaggacgaggctgaggccaggaaaaaggaagagcaagacgttgctttaaaacaactaaggaagtcattggtgattaaagcaaaacccatgccaagcttctatcaagaagggcccccaccaaaggctgaacttaagaaggtgcctactactcgtgccaaatcaccaaaatttacaagttcaaggagaaagagctgcagtgatacaacacaaacacctgaggggaaaaataccaattcaacatctacccggtcacatcgtcacagcattgggacttctaaagacgctaacagagtacaatgctcgccgaagagtggtgtggcgaccaaaactagatccgtcaagcctgagctgaaggccctctgaagagcatggagcagccaagcgctgcgattgtctttgtacaaaccgaattgcctaactcttagccgtttccatttccatgcatttttttcttttattctatacccaacatctccaccaaaagaaggctgtagggccaatcacgttgttcgcgctgctgaaccttatccattttcttacattcgtcttgtactcgtaagaactctgttgctggaccatgtgatgtaaattacttgaagatccttgtagggagtt

SEQ ID NO: 81 - DNA, 1328 bp, Sorghum bicolor
gcgggccccaccagacaacggtacccaaccgcctctcgctctcgctttggttctctcgctctggggagagagctcaggagagacccaaatcccttttccgctccgccggactccgagagagggcggcgggtgcgggacgcgaaggcgaagccctagctcccctccctgccgcggacgccgatggacccacctcgcgccgtcgccgttcttctcctcgtactccttcccgtgctcgccccggtggcctccggcgtgcccttcgtcgtcctgcacgggattggcgacgagtgcggcaacgatgggctggcatccttcaccgagatgcttggggagtggtccggctccaaaggttactgcattgaaattggaagaggagcatgggactcttggttgatgccacttcaagagcaggcaaatacggtttgcaagaaggtcaagaaaatgaaagagctcagtgaaggttacaatatagttggcctgtctcaggggaacttaattggcagggctgtaattgagtactgtgatggtggacctctggtcaagaatttcatatcaattgggggtcctcatgctggtacagcttcagtgccactttgtggttctgggtttgtctgtattcttattgatgatctgattaaatcagagatatattcagattatgtgcaggcacatcttgcccctagtggctacctaaagatacccactgatatggaagattatttaaagggttgcagatttcttccaaagcttaacaatgagatcccaagtgcaagaaatactacctataaagaaagattcagcagcttggaaaacttggtactgatcatgtttgaggatgatgcagtattaatacctcgggaaacagcatggtttggttattaccctgatggagcctttagcccagttctgccccctcaagagacgaagctgtatacggaagattggattggcttgaggaccctggacgaggctgggcgcgttaaattcgtgtctgtgcctggaggtcacctgcgtatctccagaagcgacatgaagaagtacatcgtgccttacttgacgccggaggcgtcatccaagcagagcgtacaccggatgctgtcgctttgagcgagccacgtgcgtatctagcaaggtctgtatcgatggccactctgccctgacacgtggaccctgtgttgacgccttgtaaatacgctgaacatgaagggaggaaatgaaagcgcgggaaagagtggatccgattatccgaactcagtgtttggtcgtttccgtttcctgtctgacaagcaaatatgtctacgccgttgcaacgtgacgtataatttatt

SEQ ID NO: 82 - DNA, 2961 bp, Sorghum bicolor
tacttatttgacaagacaaccatgttagacaaattaggaagccaattgaaagctggagctttggtgggctgcaaaaggactcatcccaaagcatcggccggccaactcatataactgtaagttgcctcagcaacatgagttccttacatctaggaaggaaaaaggaaaaactcaaggagaactgagatgagcagaggttgaagcatgttttcaacgaatgaaggtataaggcaaagatacgatatatgcctgcaaaagtgagttcccttgtaattatagaagaaagtcgttgataaatcttctatgatcataaaatattgacacgatttacacattacgtaggtggaaaaatctaaattttcttccttgcatcgtgtgcatcagcttgactaacagataggatgccaggcttgacttctcttcctcttccctcctgtattggtcgagccacagataattaacctcctcctttactcttgcttcaactttcttgtctgatcttgcctttgctaagcttcaatgattagctctcatgcatttcttctctccctgcatggattagccatggtttccacacttataacaaacactgaagggcaagctttttgcccttctttctcctgtgggcatcttcaagacatacgatctcctttccgtatgcaaggtgatccacaaggttgtggttttccagagtatgagctggtttgcattgatagcaaggctataattcacatcaacagtggaagatactttgtgactaacatctcctacactgactctactttctgggttgttgatgccaatttggataatagcagctgtcccattcctgcgagcaaccaacatccctatataaatggtttgcaatccgaaggcagcaccttgctggatcctgatacagtaacttgggctgcctttatcacttgttcagagatgctaagtgatgttacttccttgttcagcagttgctgtagtggtatttacaggcctgtcaattgccgaagtacgaagaattcttttgtttatgtcttcactaccacattcttcccaatggttggatacatcaagccgtcatgtagatacttgtccatgattcctttgggcagtcgacatgtcaagcgaccagataatgcaagttatgaagatattgtaaaatttatgaggaatggcttttctgttgattttccttatagcagtggatggacatatcattggatcattaacttatgcctgaaagaggcaaagggttactacaatgataaaatatctaactcaagcattgtggatcagacttttgccaccgcttttgggatcgaccttcatttcttaagatgtgtaaatgattattcataccgaactaaattattttgggctgtggtcgccatgatatctgctgtggacattgtgaagttcgtgatagtgtttggaatgctatcgaggtttgtgtttgcaccattagctgtattgaccttcctcgcctacaaatactggaaaacaaggatatctattgatgcagttgagaagtttctccaaatgcaacaagctcttagcccaacaaggtatgcctataccgacatcactgcaatcacagggcacttcagagagaagcttggccaaggaggctatggatccgtgtacaaaggcatgcttccaggtgatgtcaatgttgctgtcaaaatgttgggcaattcattgtgcaatggagacgaatttatcagtgaagtgtccaccatcggaagtatccaccatgtcaatgtagtgcgtctcgtgggattttgttcagaagaaatgaagagggctctcgtctatgagtacatgcctcgtggatctcttgataagtacatcttttcttctgagcaaagattttcctgggataagctcaatgaaatagctttaggcattgccagaggaatcaactacttgcaccaaggatgtgaaatgcagatactgcactttgacatcaaaccacacaacatccttttagacaataacttcactcctaaagttgccgacttcgggctagccaaattgtacccgagggacaacagctttgtgccggtgagcgctgcatggggaactatcgggtacatagctcccgagatgatatcccgtaatttcggtgttgtttcatgcaagtcagatgtttacagcttcgggatgctattgctggagatggctggggggcgaagaaacttagaccaacatgcagaaaggagaagccagatgtactacccagcttgggtgtataatcatctaactcggcaagaggtaggcgagatttgcgaagcttttgatatccatgaggtggagaggaagctgtgtgttgttgggttatggtgcattcagatgaaatcacatgatcgaccaacgatgagtgaggtcattgggatgcttgaagctggcgttgatggtcttcagatgcctcccgagccattcttctgtggggatgagcagaattccgtaactggtactttccgtttgtcctcggagttgagtgcaatctcagagaatgaatgaggttactaattccacaagatgaaccgccaatgtgttacagaggatggagtggaagagtatggagatactctatcacagtatttctggcacggagcaaaactggagtatactttacacggaggacaaacgagcagctatcatggagaaaactggggatctcagatcgatggcgtggagatggttctggctgacaccatgatgttccagatggcaagtgggcggccagttatgaagctgttgatggatgatcttaattcggtgtctgctgtttagattccttttgcaatagtcctgtagagttttttgcttcagttctgttaaactcttttagctgttgtcgaggttgctctggagtttggtctttaatctcggatggtatgggaatttgtacttccatatgctgcgatcctggttgccatccaaacggaattcataagttttggg

SEQ ID NO: 83 - DNA, 2728 bp, Sorghum bicolor
ttcgcgagggttttagcgacgaagagaaaggggaggaggcgagcgccgagggaggtatagccgtacagggggagagggtgggagatggctgccatggttggagcgcgcagggcgctcttagccgcccggttctcccctcgcggcgccatagcggcgtcggccaagcctgcgcccctctaccggcgcgtggattcgccgcccagacttccagctgaaagtgtttgtctccagtcttgggttccacatcgagcggctggcagctttgcatctgaaaggactgatgaagactatcagcgtgagtggggacaaaacaaagcaggtagctatgctgactcccgttcaaacggctctagcctccatattcagagagatgtcccttcagctggttccacaacaggtattcacacaaatagggctgtggatggtggtggcagttctgagcaacattacagaagtggtggatcatatggcttccgaaacagtcatcagccgtatactggtgcaagagcgaataatgagacatctggatataatgcatcacaaccttacagaggtggtggtgcatacagccagcaaggccttgatgggtactttccaaatgatcgccaacagtataatggcacagaagctaatagtacatatagctctggatacaacacccaaagtaaccagaaggtttatgaaagagagggagttaattatgggcagtacggatatggtccttcaggacaagcatgtccaaacccgattggaaataaccatcacattcagaaacagcaatatgttgatcatagatctggggaaagttatccggatagatcgcggaatcatccctctcagtatgtaaatccaactcatttccataaggagcatgttgcagggtttcagcaaggcaacaatagtaattttggatataatgcttcgcagtcgtatcaaagccctcatttcaataggcaagctgatatgcatagtactcctcaaggatattccatgtacctaaatacagatgtgcaacgcccctctcatggagttcatcaagaaaaacattcacatgcgcaatctgctggatcatttgggaaccacttaaacaatgcacctcatgaagatggcaaatatcaccagtcactgcagggcaacttttcaaatgttggattgccttatgaagtacctaaagccgtcggcaaacacaaaggtactgttgaagaactggagaagttttgtgaagatggcaatgtaaaagaagctttggaagttctggctatgctaaaggaaaacagaattgtgctacatcctcctcagtacttcagattgatgcaagcatgtggtgatgcagctgcactctcagaagcaagattaatacatagtcaaatatctgaatcatcaactgttgttgacacagattttcaaaacgaaattctaaagatgtatgctaagtgtggttcaatggaagatgcaaagaagcttttcagttctatggatcatcataatttgacttcttggagcactatgatctcaggttttgtgcataatactcttggtgaagaagcaatagattttttcgatcggtttaagcagacaggggataagccagatcttggtatgttcagacatgttttcctggcctgtggaattttgggatctgttaatgaaggaatgttgcattttgaatccatgcagaaagattttggcatacatcccactatggaacattatgcaagcattattagtatgcttggacagtctggctacattgccgaagcctatgaatttgtggaacagatgcctgtggaaccaagcattgaggtatgggaaaatttgatgaacatgtgtcgacttaatggctttttagagcttggagatcgttgcgctcaaatcatagagcgcttggattcttctaggctgaatgaacagtctaaaatgggtcttttccctgtcgatgcttcagaccttgcaaaggaaaaggaaagaaaaaaggcaagtgttgctgaagctcggagcaaggtccatgaatacagagctggagaccgatcccaccctgacactcctaagatctatgaagagctgaggtacttgttggctcacatgaaggaagctgggtatattgctgacactcgatttgttcttcacgatgttgatcaagaaaccaaagaggatgctttactggctcacagtgagaggctggctatcagttatggtcttataacaagtgctccccgctcacctattcgagttataaagaatctccggtcctgtggagactgtcacacggctttcaagataatctcgaaacttgtcggccgtcagatcattgcaagggatgcaaagaggttccaccactttgaaaatggtgtgtgctcttgcaaagactactggtaaacaagatgatagaagcccacatcttggtcaattttgatctgcccaagaccgctataggttgtttatatgctgaaggtaggctgatgcctatctaacatttaggtagctgatagtttcatgtcagggacatgatgtatgatgtcgtcagggacaagcaggccctaagcccctctattttgcagttcatatgatataagcctgagtttttgctttaacgactgttgtctccgatttgttacttgccaccaaaataaaacagtagaatgttattgggttgtggtcccctggcatgtaaactttgattcagcttgactacaaagctttctgacagcattctgtatccattgcttat

SEQ ID NO: 84 - DNA, 933 bp, Sorghum bicolor
agggtttcctcccaccactccttcccctccaaccccaacacccggcggcgtcgagcggcggcgatgacgacgagcctgaagaagaaccggaagaagcgcggtcacgtgtcggcggggcacggccgcatcggcaagcaccggaagcaccctggaggtcgcggtaacgccggaggcatgcaccaccaccgcatcctcttcgacaagtaccacccgggctacttcggcaaggtcggcatgcgctacttccacaagctccgcaacaagttctactgcccctcggtcaacgtcgagcggctctggtcgatggtgcccgccgacaaggtcgccgaggcggccggtggcgacaaggccccgctcctggacgtgacgcagttcggctacttcaaggtgctcggcaaggggatgctgccgcccaagcccatcgtcgtcaaggccaagctcatctccaaggtcgccgagaagaagatcaaggctgctggaggcgccgtcctgctcaccgcataggtcttctttttttgtatcttgtttcacctatctgtgctaagaaaatttctaaatttttcgtggatcatgtgttgtgagttatgagaccccaatttttgtgctcttggtaacgaatgcgaattcaactccctgaaatatttcagatatactgtcgccccatgtttcttgctgcaagctatgattcctgtagttgatactgatatttcatctcggttatattatacggagtatatgcaattcatatgggtagactgtcgtgctactgagaaacggtctgaaatgtttgttttttttctgataagcttaattgtgtaggattggatatgcattgttatttttctgtgacaaccatgtaggactgtgattcaaagaacaaaatccaatgtaaggctatcagtcttaactgtgatttaaagaacaaaatccaat

SEQ ID NO: 85 - DNA, 1915 bp, Sorghum bicolor
ggatctcctcctgctacaaataatcgttggcggccgagccctaagccccacggcgcaagcgcgcagatcctctctctctctctctcggctctcctctccgctgcctctccacgccgatctcgatcgagcacctggggagaccacgagacgcgcgccctgcttcgcttcccgcatcacagctctcaagttctctgcctctcttttttttttcagtttttcaagtaatccgattgttgtagttgcatcttcaatttaccattttaattaatttgcgtttgatctgttagttccattgcttcttctttgattgcggttagtatagtttcgctgtttgttgctccgtgcttcttgttgttctgttgcttctaaccatggacgcaggcacctactccatctcatcagagaagagccacaaggcggcgaaggcagcggcggcgccacggccgcctctccaggaggccggctctcagccctacatgccgtcgctgagcacggggtcgcgcaacccgtcggccaagtgctacggcgataggttcatcccagacaggtcggcgatggatatggacgtggcgcagtacctgctcacggagcccaggaaggacaaggagaacgcggcagcggcggcatccccatccaaggagatgtaccggaggctgctcgccgagaagctgctcaacaaccggacgcggatcctcgccttcaggaacaagccgcctgagcctgaaaacgtctcagcaaccatcgcggcttccgcccaccacgccaagccggccaagcagcggcgacacattccccagtctgctgagaggactctggacgcaccagagctcgttgatgactactacctcaacctccttgactgggggagcaacaacgtgctgtccattgctctgggcgacacggtgtacctgtgggatgcctccactggatccacgtctgagcttgtgaccatcgacgaggacagcggtcccatcaccagcgttagctgggctccagacggcaagcatatcgctgttgggctcaactcgtctgatgtccagctctgggacaccagctccaaccgactgttgagaactctcagaggtgtgcatgaggcaagagttggctcactggcatggaacaacagcatcctcaccactggcggcatggatggcaagatcgtgaacaacgacgtgaggattaggaaccatgtcgtgcagacgtacgaggggcacagtcaggaggtgtgtgggctcaagtggtctggatcagggcagcagctggccagcgggggtaatgacaaccttctgcacatttgggacgtgtcgatggcatcctccatgccatccgctggccgcaaccagtggctgcacaggcttgaggaccacacagctgctgttaaggcactcgcatggtgtccgttccagagcaacttgctggcaaccggtggtggtggtagtgatagatgcatcaagttttggaacacgcacaccggtgcatgtctgaactctgttgacaccggatcacaggtctgtgcccttctctggaacaagaatgagagagagctgctgagttcacacggatttacacagaaccagctaacattgtggaagtacccatcaatggtaaagatggctgaactcactggccatacttctcgtgtccttttcatggctcagagccctgatggttgcacagtagcatcagccgctgcagatgagacccttcggttctggaacgtgtttggagcccctgaagcgcccaagccggtcaaggcttcccacactgggatgttcaacagcttcaaccatatccgataggatgaatcgtgagaacaatctcctctgataggatgaatcgtgagaacaatctcctctgttagatatggtcgtgcagcatatactacatgatcgactcttattggtatgttttagaa

SEQ ID NO: 86 - DNA, 2351 bp, Sorghum bicolor
gtccggcccaactagcccacgtatatactccaaacctaaccctagcagtacatctcgctctccacggcggcggcggctacggcaacacgtctcgcgcgggatcctaattccaaacagcactgctctccctccctccctccctccctctcgtggcgacgactgggcgggcgaccgctgccggtgtccaggtgcccaggtgtacatcggtacctcgccaggtcttcttcggcccttcgccgccgacaagctctgccaggttgctgtgttaagttgtcacatggatccagcacaatatttccaacccaggacattctcaataaagttgtggccaccaagtgaaagcacacggctcatgcttgttgagaggatgacaaagaatctgtccacagagtcagagtccattttctctcgcaaatacggtactttgggcaaggaagaagctcatgagaatgcaaaaaggattgaagaactttgctttgcctcggctgatgagcatttcaaaagggagccagatggtgatgggagttctgctgtccagctatatgcaaaggaaacgagcaagatgatgttggaagttctgaaaaaaggccctaggactactgcagaactggaagcacctgtagctgatacacctctagtgcctgatacacctcttgtgcctgctgatacacctcttgtgcctgctgatactgtactagatatatctggtggcaagcgtgcttttattgaggcagatgaagcaaaggaactgctgagtccacttacaaaaccaggaaattcatatcaaagaatatgctttagcaacaggagctttggtattggcgctgctaatgttgctgggccaattcttgagtcagttaagaatcagctcacagaggtagatatctcagattttgtggcaggaaggcctgaggatgaagctcttgatgtgatgcgcatattctccaaagcattagagggttctgtcctgagatatctgaacatctctgacaatgctttgggtgagaagggtgtcagggcattcagtgagcttctgaaatcacaggaatccctggaagaactatatgtgatgaatgacggtatatcagaggaagctgcaaaagctctatctgagcttattcctgcaactgagaagctcaaggttcttcacttccacaacaatatgactggagatgaaggtgctatgtatatcgctgagatggttaagcgttctccaaatgtagagagtttcaggtgctcagcaacaaggataggatctgatggtggagtcgcattgtctgaggcattagggacatgcactcgtctgaagaaacttgatctccgggacaacttgtttggtgttgatgcagggttagctctcagcaaaacccttccaaagcttcctgatcttgttgagctttatctcagtgatctcaatcttgagaacgagggcacaatcgcaattgtcaaagccctcaaacagtcagcaccgcagttggaggtccttgaaatggcaggaaatgaaataaatgccaaagcagccccagatttggcagaatgcttaacagcaatgcagtcactgaagaagctgaccttggctgaaaatgaactgaaggatggcggtgctgtgattattgcaaaatcattggaagatggccacacagatctcaaggaacttgatgtgagcacgaacatgctgcagagggttggagctcggtgctttgcgcgggcagtcgcagataaaccagcttttgtgcaactgaacatcaatggaaatttcatctctgatgaagggattgatgaggtgaaggaaattctgaaggctggtaagaaatccctggatgttctgggctcactagatgagaatgaacctgacggggagcctgatgatgaggaagaggaccaggatgctgaggacaatgaggatgagctggattcgaagctgcagagtgtgaaggttgagcaggatgattgaccaagttggttttaagattccaccagttacctgaagttgaccaagggaaacgttagctgccaccgacacctcattggtgacagtgagcgccggaggaagccaccacctggacctctcacttcacgatatggcaggcttgctgcatcttgttttatagagttgtagacccatactcgtaattttcaaatgcattattcatagatttctagatcgggaaaatcatacagattttatgaagccatgtgctatggctcgaatatgccaatccgttgttcctcaaatcattgtttcttcggagcctggtaggtccagaagctccctgctcgactcgattgtttgtttcttcagagcctcgaacgaatctgttgtttcaaatgcatatgccaatccccagcaa

SEQ ID NO: 87 - DNA, 2797 bp, Sorghum bicolor
ggaaaggagaggtggcggcggctcgccctcgcccgcgcccgcgccccgcccaaccggcaaaacccaaaattttgaacccttgggtgcctccgctgctgctactatagtctactacccccatcaaatcaaactcctccctccggcttcccctccatttccttcctctccccaccaatccgccatcattccccgttcccgttccgacagccaaaccctagcctgaccgccgccgccatgccggacctcccctgcgacggcgatggcgtctgcatggtctgccgcgccgcctccccgccggaggtcgacctcctccgctgctccacctgcgccacgccctggcactccccgtgcctctccaagccccccgccctcgccgacgccgccagctggagctgccccgactgctcccccgaccccgccgccgccgccgctccctccggccccgccaacaccctcgtcgccgccatccgcgccatcgaggccgacaccaccctctccgaccacgagaaggcgcgccgccgccaggccctcctcgccggcgacgcccacgacgacgacgacgatgacgacgccgcggcagacgatgccctcgagatcgtcggcaagaacttcagctgcgtcttctgcatgaagctcccggaccgacccgtcacgacaccatgtggccataacttctgcttgaagtgcttccagaagtggattcagaacaggaagaggacctgtgcgaaatgtagggcacagatcccggccaaaatggctgagcagccaagaatcaactcagctctagttgaagttatcaggatggctaagatttcaaagaatcctaactctgctggctctgcagttccgtatcactacatacgaaatgatgataggcctgataaggcatttacaactgacagggctaagaagtctggaaaagcaaacgcatcaagtggccagatctttgtgaccattgcacctgatcattttggccccattcttgcagaaaatgacccacgcaggagtattggtgttcgagttggggaaacatgggaggaccgacttgagtgcagacaatggggcgctcactttcctcatgtggctggtattgctggccagtccacgtatggtgctcagtcagtagctctttcaggaggatatgaagatgacgaagatcatggagagtggtttctttacactggaagtggtgggagggatctaagtgggaacaagcggacgaacaaggaacagtcatctgatcaaaaatttgagaagctgaatgctgctttacgcattagttgcttgaagggctacccggtcagggttgtgcggtcgcacaaagagaagcgatcctcatatgctcctgaaagcggtgtaaggtatgatggggtttacagaattgagaagtgctggaggaagattggtattcagggtaagttcaaggtctgcaggtatctctttgtacgctgtgataatgaaccagctccttggaccagtgatgatcacggtgatcgtccaagacccttgccaaagataaaggagctgcaaggtgcaactgatataacagagaggaaagggcgtccttcatgggattatgatgagaaagatggctggaaatggatggtgcctccgccagtcagcaagaagcctgttctctctggggatcctgagactgacaagcaaatccggagatcaacaaagcgtgctcatttgtctgttgctgaaaggctgcttaaagagtttggttgttctatctgccgggcagtgattaaagaaccacttacgactccatgtgctcacaacttttgcaagacttgtttgcttgggaaatatgatagccaatcctctatgagggaaagaagccgtggtggtcggactctaagggcacagaagattgtgaagacgtgcccttcctgcccaactgacatctgtgacttcttagagaatccccagatcaatcgagaaatgatggagctgattgagactttgcaacgcaaggctgttgaagaaggcaaggtggcttcagatgatgctgaggaatgtggtgatggtgactcggaggaaaatgatggtgctttggtgaagggagaggaggatgatagcggcttgaatgaggaagagcaagacagtgcagatgctgatgctaatgctgatggttctgtgaagattgtggttgaaatcaaggagggaggaaaagatgataaaaagtcagagatgggtgcgactgaagtggtggatgtgttagttgatgaagatgctgcgaaacagacgaagaagcgcaaggttgatgaagatgctgtgaaacagacaaagaagcgcaagggtgatgctgagactggcaccaacggtgccaagaggatgaagagcagtgctgccgtggaagaggttgctgtgtgtggcactcctgtgaaacggaccaggaagagtggtgatatggatgctgaaggcaacggcagtcctgctgtgagcagtggccgcagggtgacccgtagcagcagtgtgaatgccactggagctgatgatagtccggcgaggaggaccagaagccgtgctggagctgatgctggttgctgaaggggtagaggaagcgtggagcgtggatgctgatggtctggatggaagcagaagccagccatcgaagcgaggagccgtctttttttggggtggttgtacgtagactgggaaccttgcgttttcttttggttgggtgatgcaggcaagtgttgcagctgttttcttttggttcggtttgggagaccgattgctgcttcctggatgctaagcgttcatccaagacccttaaaactattaagtc

SEQ ID NO: 88 - DNA, 1876 bp, Sorghum bicolor
ccacccccgcgagaccgaccggtccgaatcgcgcccaggtccctcgctgggagtctcgccgacggccctcccgcctcacgcctgcccctagattcacgacggagatggcgtccgagctcacctaccgcggaggcgggccgtccgcggccgccagcgccggcgccgggggatactccccgaagccgtccaagccgctggcctggctgccccgcgccgcccgctacgccgtcgccgagaaccgcccgctcttcgcgctcgccgggatgctcatcgccgccgccgtcatctccatcgcctccccgtccgcctcttccacctccaccaccggctccgccgccgccgtctcgtcctactccaacaacaacaacaacaacccgctcgcccgcttctccgtcgagcccgcccaccaccgcgacgtggccacgcgccacttcgtcggcggcaaggtgccgctcggcctcaagcggaaggcgctccgcgtcctcgtcaccggcggcgccggcttcgtcggcagccacctggtggaccgcctcctcgagcgcggcgacagcgtcatcgtcgtcgacaacttcttcaccggccgcaaggacaacgtcctgcaccacctcaacgacccgaacttcgagatgatccggcacgacgtcgtcgagcccatcctgctcgaggtcgaccagatctaccacctcgcctgcccggcgtcccccgtccactacaaatacaaccccatcaagacaatcaagaccaatgtggttggcactctgaacatgctcggattggcaaagaggatcaacgccaagttcctcctcaccagtaccagtgaggtctatggtgatcccctccagcacccacaggtggagacttactggggcaatgtcaatcccatcggtgtcaggagttgttacgatgagggcaagcgtacagctgaaacgttgaccatggattaccaccgtggtgccaaccttgaggttaggatcgcacgtatcttcaacacatatggccctcgcatgtgcattgacgatggccgtgttgtcagtaactttgttgctcaggctctgaggaaggagcccttgacggtttatggtgatggaaagcaaaccaggagtttccaatatgtttctgatctggttgagggtctgatgaagctgatggaaggcgaccatgtaggaccattcaacctgggtaaccccggcgagttcaccatgcttgagcttgccaaggttgtccaggacaccatcgaccccaatgcacagatcgagttccgtcagaacacccaggacgacccacacaagcgcaagcccgacatcagccgtgccaaggagctccttgggtgggagccgaagatccccctccgcgagggccttcccctcatggtcagtgacttccgcaagcgcatctttggcgaccaagacgccgccgccaccactggaaaccagcaaggttaggatgaagccgcacgatacttgggaagtttttggtggcctgcttctagcctgcttggtcgctctccttatactgacaaaagctatggccacgtagttcgttgggaatgtgttactgaaataccttggttgatgctgtaatgctattctttttcctgtattttttttctcagttctctcagtccttagctatacaaaaaaatttcagttgaaccgttggagataaacccggatgatctaattctttgttgattgagagcatagcatcatatatatggtataaatcacggtttctgcaagtgttatgtatgcctgctttgatgtgtggtccgtttctttgttgaaacgcagaggatgcctaccctgctctcataaactagactagaacaaagaaacaaacaaacagttctgaagatgaaacaagatgacatcttttt

SEQ ID NO: 89 - DNA, 909 bp, Sorghum bicolor
ggagcaggaaggggagcagcagccgtcggggggaagaagaagaagatgtcgtacctgctgccgcatctccactcggggtgggcggtggaccaggccatcctcgccgaggaggagcgcctcgtcatcatccgcttcggccacgactgggacgagacctgcatgcagatggatgaagtgctggcagcagtagctgagaccataaagaactttgcagtcatctaccttgttgacatcacagaggtccctgatttcaacactatgtacgagctgtatgacccttctacggtgatgttcttcttccggaacaagcacatcatgattgatcttgggacaggaaacaacaacaagatcaactgggccctgaaggacaagcaagagttcatcgacatcgtggagactgtttacaggggcgcccggaaaggccgtggtctggtgattgctccaaaggactactccacaaagtaccgttactaagaagtgaagcattcacgcggagcagcagctgctgtttgctagcctagtatgttccccttatgcaatctattaggggatgtttactcagacagtcagttcgactggcaatgcttaactgtatcttggcatgccctagtatattcaagttgctggcgttaactatatcttggcatgccaaagtgatcttgtgaagttgtgatttgaggtgattgctggagtacccccccccaaaaaaaaaaggatttgcgttctccctccctttggaatggctatatgtttactaatgagaaacagttacatgtttggaacgtgggaactgtgctttgctattttgtatgaacgagtgcccctcaatctgtaagtccaatataaattgagctctttttgatggtgcccactgcccaggatatgcagaagctttgcttgaccgcgtcc

SEQ ID NO: 90 - DNA, 775 bp, Triticum aestivum
cactgtccacacacatttccttgtagttttgtgtgtaccacgaccacccctctcatctcatcccatccaagctagacaagtcccgcactgtgctgtggtgctccatctagccagcttttttgctcagcttagcttccaaatctgctccacagctccggcggcacaagaagaaaatatccgtgcgtccgcgagaggaagggagatcgtccatggagaaggacaaccacaaggagggggagggggcgacggcgtggatgacggtgccggcgttcggggactgggacatgaagaacggcgccatgccggactactccatggacttctccaagatccgggagatgcgcaagcagaacaagaaggagctctcccgcgccagcctcggcggcgacgacgacctcctcgcccaccacaagcagcagcaccagcagcaccagcccgccgccaaggctccccagcccaccaagctcggcgctccggccaaagaccacggcccgctccacggccgcgaccactcgcccacgggaaggaagaggttcctgagctatttccagtgctgcatcaaggcctgaagaccagctgctgccactgccctccgtcgaggtgtcgcagcatgaagcagcttagcaaatttagcctaggcttctttggtgtttggtcaagcttgcaactcaaatgtgtaatataattccacgtcctgacgctgcctgtttagagaacgagacggtttatgtggggaacagattgcttgtgaatgtcaaggttactatcttgccta

SEQ ID NO: 91 - DNA, 2147 bp, Triticum aestivum
acagccattgttcttgatgttgggacagctaataatagtgagcctatcgttttgcttccaacggaagttgagcctcagtcatcaatttctagtgatattcaggaggatacaatatttaactaccgtaggaagtaccttccaacccaacaggttgcttatcatacacctccacggtttccggcagaggtgatagattgcataagaaaaggagtatcccttttatttcgccactttggcctgcgtgacttcgctaggatagatggttggttcttaccaagtcctgctacttctctgccctcgtctgaaaacggtgttaaatttggaaatacagagtatggtgctatccttttcactgatattaacttgataagtgggatggagcaaaccagtttcttatttcaacaagcttcaaagattggattctctcactctcgaatcctccgtacaattgttcagcgtgcttgctcacgttttccttcccttgttccaagcaataatgcatggactgctttatccagaaaaatgcaatctgcaaaacaagcagagataatccaaaatggcacatgcaagcagaaggcatttgtgatatttggtggcgatacttcagagcggcaagtatctcttatgagtggcacaaatgtctggcttaatttgcaaggcttcgaggatcttgatgtgacaccgtgcttgcttgcaccttcgaatggatattcttcccacaacgaagattttagcgaaagttcacgcgacgtttggacactgccatattcattagtgttacggcataccactgaagaagttcatgctgcatgttttgaagcaattgaaccagagcgggttgaaataacatctcgcttacgtaatcaagtaatgaaagaacttgaacgagcattaagcaagcaagattggtttgcgggctttgacatcactgatgaacaacctatcaaatactctctgcaacagtggattgattatgttaaagaagctaaagctgtagtgttcatagcagttcatggtggtattggggaggatggtaccattcaatcgctgttggaatctgcaggagttccttacacagggccagggccaatagcttctagaacatgcatggacaaagttgcaacttcacttgccgttgatcatttggctagttatggcattcacactataccaaaggatgtaagagcaagagaagagctactaaagtcatctcttgttgatatctggaatgacctgaaagcaaaattacaaacagaaacggtatgtgtgaaacctgctcgtgatggatgctcaactggtgtggcaagattgcgatgtccagaggacctagaagtctatgcaaatgcactgaggggaacgcttccgcgtctgcctgctaactgtctatccaaggcacatggagttattgagatgccagtccctcctccggagtcactgatattcgaaccatttatcgaaaccgacgaaattattatctcaaataaatcgtggaatgatagtacccgccatctggtatggaagggtgaaaatgagtggcttgaagtgaccgttggtgttgttgggaagcgtggggagatgcattcactaaatccaagtatcacagtcaaggaaagtggtgatattttgtctcttgaagagaaatttcaagggggaactggaatcaacttgacaccacctccagcaacaatcatgagtgaggatgcgctacagaaatgcaaaagttgtatcgagatgacggcgaacacattaggtctggagggcttttcacgcatcgacgcatttgttaatgtgcacagcggagaggtgctgttgatagaagtaaataccgtacctgggatgactccctccactgtcctgattcaccaggcactcacggaagaaccacccatctaccctcacaagttcttcagaacgctcctcgatctggcgtttgcaagagcaggctagatatacaagggccctgaagaaaagaagaagatatatgcgcctctagctggggcgcgtcgatttcagtgcgaatagggtcgcttaccgctatgtactacggtatcgatttgtgttgtgcaactgtcaatgtatgcaagtgactcttgtgtgggatttgatagtcattggtgcgaaaagatgtggggtgtccagttgatacc

SEQ ID NO: 92 - DNA, 1557 bp, Zea mays
acgtctctatcctcccacttcgacccggccggccctatcaaaagctggccccttccacagcgcactccctcaccttcctccacggctccaccatcccctctcccctgccctgcccccaccgccccgcttccttccgccttgctccgttgcttcctcccaccacagtccactccactcgccggccctgcagctcagtatttgactgagactggtggtggagctgctagcagcgagcctgctacttcctggtcctgacggtgcgttcagacctcagaccagtgccgacgacgagctgtgaggagagggcaaggaaacaagcctgtgaggaaggcggcgatggagaggtacgaggtgatcaaggacataggatcgggcaacttcggggtggccaagctggtccgggacgtcaggaccaaggagctcttcgccgtcaagttcatcgagcgggggatgaagattgatgagaatgtccaaagggagatcatgaaccacaggtcactgaggcatccaaacatagttaaatttaaggaggttgtgctaactcccacacatttggccatagttatggaatatgctgctggtggtgagctatttgaaaggatctgtaatgctggaagatttagtgaggatgaggcgagatttttcttccaacaactgatttcaggagttagttattgccactcaatgcaaatatgccatagagatttgaaactagaaaacactctcctggatgatagtatagcacctcggctaaagatatgtgattttggttactccaagtcctctgtgctgcactctcaaccaaaatcaactgtcgggacaccagcttacattgctcctgaggtccttgctagaaaggaatatgatggaaaggtcgccgatgtttggtcatgtggagttactctgtatgtgatgcttgttggtgcctatccctttgaggaccccgacgaaccgaagaatttccgcaagacgcttactcggattatcagcgtccagtacgcggttcctgattttgtccgagtttcaatggagtgcaggcatctgctgtctcggatctttgtggcgaaacctgagcaacggataaccatcccagagatcaagaaccacccatggttcctgaagaacctgcccatcgagatgaccgacgagtaccagatgaacctacagctagtcgacatgaatgtcccctcgcaaagcctggaggagatcatgtccatcatactggaggcccggaagcccggcgacgggctgaagcatgcgggacagctccccggccttgggagcatggagctggatgacattgatgttgacgacatagacgttgaggacagtggcgactttgtatgtgccttgtgacgcggttcaggctgtccggcaccgttgctgcggtggactctcccccactctcctggtctttgtgtcttgctgttattccatgttgtttgtttcagcgagctccgagctcccattttgttgttgtaatatcacatgttttgtgtaaccaaggtagtgacgctgtggataaataatagacgttatgtgttgtattcttgctga

SEQ ID NO: 93 - DNA, 1346 bp, Sorghum bicolor
acgcgcgtccaagcaccccatcagtgtaggggctagctagcagcattggtgccgtgtcagtgtgacactggactgaaattctctagctataggtagtagcaagctaagagaaaaagcatgtcgaaggatgacgtgacggcggaggcggaggccgcggcgaaggcgccgtactgggatccgccgccggcgccgctgctggacacgagcgagctgaagaagtggtccctgtaccgcgcgctcatcgccgagttcatggccaccctcatcttcctctacgtgagcatcgccaccgtcatcgggtacaagaaccagtccaaggccgaatcgtgcaccggcgtcggcgccctcggcatcgcctggtccttcggcgccaccatcttcatcctcgtctactgcaccggcggcatctcaggcgggcacatcaacccggcggtgacgttcggtctgttcgtggggcggaagctgtcgctggtgcgcacgctgctgtacatcgtggcgcagtgcctgggcgccatctgcggcgtgggcatcgtcaaggggatcatgaaggtgccctacaactccctcggcggcggcgccaacgcggtggccacgggcccctccgacggggtgctcacgggttactccgtcggcagcgccctggccgccgagatcgtcggcaccttcatcctcgtgtacaccgtcttctccgccaccgaccccaagcgcacggcgcgcgactccttcatccccgtgctcgtgccgctgccgattgggttcgcggtgttcgtggttcacctggcgaccattcccatcaccggcaccggcatcaacccggccaggagcctcggcgccgccgtcgtgcacgcagcatggaaagaccattggatcttctgggttgggccgctgatcggggcgacggtggcggcgttgtaccacaagctcgtgctgcgcggggaggccgtcaaggcgctcggctccttcaggagcaccagcgccacggtgtgagagtgagagcatctaattctgcttcctgcctgcagcgtataaacgtgcatatgaagcgcgaagctgttgatttgcctgaacaagattggcgccctccgtgtgtgtagttcctccaactgattcccaattcgttgtcgatcgtctccttcaatatatgcaatatgctacggggtgcttattacacgaacagtatgtatgcacgcttgtccgtgccatttcttttttttgtttgggaactacgaggtcgtccatgtatataaacctatgttctgcttgattagttatctatacacatgttgttaccaattcagtacgtatatatgcatagtagcagactgttgtgctgctcaactaagaat

SEQ ID NO: 94 - DNA, 3160 bp, Oryza sativa
gatcagcaccgccgcagacgcccgcatccgccccatcgccttctccaccgtgccgtagcccggccgcacaagtcgccaccaccaccaccgcaccctcgccaccgcatcccatatccctccgccgcgcgcggcatgctgatcccactcgctcacctcccacgcccaccaccactcaccgcctccgctatatttcgcccccgcgcccctcgcctcctcgcctcgctctcgctcgccacccctcctcctcctctacttgcagcttcagctttcgcttcgctgccgctgcgggcgctgctctccgagtcccagcgggaggtggagatggtgggcgaatcggaggggaggccgctccgggttggcctcgtctgcggcgggccctccccggagaggggcatctccctcaactccgcgcgatccgtcctcgatcacattcagggggaggacttgctggtcacctgctactacatcgactgcggcatgaacgcctacgccatatcacctgcgcagctatattccaacaccccttcagattttgatttcaaacttgaaagtctagcccaaggattccaatccctatttgactttgcacaacatcttgccgcaaatgttgacattgtcttcccggtgatccatggcaaatttggtgaagatggtggtattcaggagcttttggagaaagcaaatgttccatttgttgggacaccctctaaaaattgcctccttgcttttgacaagtataatgcatcgcttgagctcaatgcacaaggctttttaacagtaccaaactttcttgtagagaaggacaaattagctaagtcgaaactggaggaatggtttcaaagcatcaatttggataaagaaaatggcaaagtagtggtcaaacctacaagtgctggatcgagtattggtgtagttgttgcttatggtgctaatgatgcagctgagaaagccgagggaataatttcagagggaattgacgacaaggttatcatagaagtttttcttgaagggggcactgagtttacagccattgttgttgatgttgggacagctaataacagtgagcctgttgttctccttcccacggaagttgagcttcaatcctccagtaatattgatattcaggaggatacaatatttaactaccgtcggaaataccttccaactcgacaggttgcttatcatacacctccacgatttccgtcagaggtgattgattgcatcagacaaggagtgtctattttatttcgttgtcttggcctgcgtgatttcgcgaggatagatggttggtttttacctactcccgttacctctctaccttcagctgaaaatactggtaaatttggaaataccaaatacggtgctgtcctttttactgacattaatttgatgactgggatggagcaaaccagctttttattccaacaatcttctaaggttggattctctcactctcgaatccttcgtacagttgttcagcatgcttgctcgcggtatccgtctcttgtaccatgcagtaatgcatggactgctttgtccagaaaaatacaagcagcaaaacaagcagaagcaatccaaaaaggtacatccaaaaaaaaggtctttgtgatctttggtggtgacacttctgagcggcaagtctctcttatgagtggcacaaatgtctggcttaatttgcaaggttttgatgatcttgacgtgacaccttgtttgcttacatctggaaatggttattcttccttccacaaccaaaatatgaatggaatttcacgtgatgtatggacattgccatattcgttagtgctacgacataccattgaagaagttaatgccgcatgtattgaggcaattgatccagaacggatggaattaacatcccgtttacgtgaccaagtaatgaatgaacttggacagtcattaagcaaatatgattggtttgcgggctttgacattgccgataagcaacctatcaaatactctcttcaacaatggatcaatcatgttaaggaagctcaagccgtagtgtttatagcagtgcatggtggtattggagaagatggtactattcaatcgctgttgggatctgcaggagttccttacacagggcctggacaaatagcttctaggacatgcatggacaaagttgcaacttcacttgccgttagccatctggctagctatggagttcacaccataccaaaggatctgagagcaacagaagagatactaaagtcgtctcctgacgatatctggaatgacctgaaagcaaaactacaaactgaaacggtttgtgtgaaacctgctcgtgatggatgctcaactggtgtggcaagattgtgttgtccgaaggacttggaggtatatgcaaacgcattggagagaaaattacagcgcatgcctgctaactgtttatctagggcacatggtgtcattgagatgccagtctctcctccagagtcactgatatttgaaccttttattgaaaccgatgaaattatcatttcaaccaaatcagtggatgatagcacccgacatctggtatggaagggggaaaataaatggcttgaagtgactgttggtgtagttggcaaacgtggagaaatgctgtcactaaatccaagtatcacagtcaaagaaagtggtgacattttatctcttgaggagaaatttcaaggtggaactggaatcaacttgacaccacctccttcaacaattatgagcgaggaagccctgcagaagtgcaaaagttgtatcgaaactttggcaaacactctcggattggaaggcttttcaagaatagacgcatttgttaatgtccagaatggggagatactgctgatagaggtaaacactgttcctgggatgactccatccactgtactgattcaccaggcactgacggagaaaccacccatctatccccacaagtttttccggacgcttcttgatctggcgtttgcaagggcgaactagctaagctactactgtaactatgtttgtgatgtattttcatttcagtgcaaataaggtgcctaccatgcatgtatcgatctgtattactgtatgcaatatgcaactgccgatgtgatgtgatcagtactgtaccgtgttgaaggattaatttttttttaaacctaaggcggaactttgttccactttt

SEQ ID NO: 95 - DNA, 1523 bp, Triticum aestivum
gccgaagcactggtcctccgacccgccggcaaccagtccatatcccctaccgcctaccgcacgtcacttgaccagccagccgccccactccaccctccactgcggcacgcgctcccggcgatgtcgtggctcgcgcgctccattgcggccaccctctcctccgcccccgacgacgacgaagacgaccactccgaggcagcctccggcgacaaaagcccggatcacgccgccagcgccgacgccgaggaggacgagcagccggacacccccggccgtggggtcaagggcgacatctccgagctgaccgagtctctcacccgacgcttctggggcgtcgcctccttcctcgcgccaccgccgccggccggggccgaggccgccgagacgtcgacggcggcggctgaggcggaggcggagggagagtatgggccccagtccccgcgggtcgccgggatccggaacgacctggctgagatcgggggcagggtgaggagcggcatctcgatgctgtccaacgccaacgccgtggcggagatctccaagatcgcctcgtcgttcctgcctttcgtgccggaggaagaggaggaggaggtggatgcggtgggcgtgacggaggaggtggtggtgttcgtcaggcacatctcgacctctcccgagacgtggctcgatttccccctcttcgtcaacgaccggcacgccgatgattttgaactgtcagatacacaatatgaacatgcattggctatagagcgtatagtaccaagcttatcatatctcagaaccgaactttgttcgaccaatatgagtgaagcatgcttttggaagatctattttgtgcttcttcactcaaagctcaacaaggaagatgctgaacttctttcaacgacacaaatcctggaagcaagagaagagttattgcagagctccccaaggatgaaaaatgtagcgtctgagggtcctgggggctcatcagaaagcagcaatgttctatctacccaagctgaagatatagagttgtcaccctcaagcatccaagacaagagtggaatggctgaagcaacatctttccaagaaccaactcctgatcctctgccaggggctgaggctgacaagcatcccatttcaaccagcgagccggaaattattgacaagtctgtaattgaagaagagctggtggtgaaaactgaaatcaagaatccgggtgacaaacccaacctgtacaccccggaggatgacgacgacaaagaagtggaggattggctagaggacatggaccatgccgacaacaaaacaggcaatatcacctcggttgggcaggacgaagacgtgtcattcagtgacctggaggatgacgatgatgattaagggttgcctggtggtatataccaagcccagtgcctgatacatatgctgcggcttcaagacatacgctcgctgttaaacgaaggatcgtgtctcagtagctactacaaagcgaacaacgcggaagcagaatcacgacaagttgataagtgtgtgtctcc

SEQ ID NO: 96 - DNA, 927 bp, Setaria italica
gacttcctcagcaattatggtgtatcgtgaggcagtttcaactgggctagtaccttcaagtgatgttttatctcaagtgttgggatgtttgaggcttcctcatgacaattcgctgaagagtagtttcattgaaaacatgggaataagttgtgatattccacataatccaaatattaattcactctttgaaggattcggtgaatatgacatccgtgctttttcgatgctggaggaggctgcttcattaggtgcagtttcaagtatttccatgaaagataccaggattgttattgatgcaagaaagttaaagatctacagtgccgaggtttctcttcttacaacattgagatctttgaagcatcgactcgctgcaggtgcaagattaccaaacgtgacaatcttgttacccacagaaaagaaacaggttgacattgatgaaagagaaaaaacactaaagctatctggaagaattggtcaagcaatcggttctctcctgaggcgattaggaatttcataccagggggaggagtcgcacgggaggatgaggatcaatggcctcaccttaaggagatggttcaatccaaagttgaatagcaaatcctccagtgccgcgccagctgatttgcttcccctatcgtcgcgtttagcaaaagggattgctgatcagcaacgcgacatcagaagcctttcgctcgagtagtgcaggacaatccagcagcaaccgatctcggtaacctttgtgagaacatgtccaggatagtaaaatgtcttaagagtttgttcagggaaagaaataaaaaatactacatttatatagtaatctgtgaaaagattattcaaaagaaagaaatcacagtacatcaaattttgtaaacaggatgcataaaacaatttaatttatagtgtgtgaagcatttttgtctcgtt

SEQ ID NO: 97 - DNA, 2222 bp, Hordeum vulgare
ccgtcgtgctcaagggcaagccgcgcttcgccgacttcagcctcgtgccccacggctggggcgccaaggtctccccctgggtcgccgcgctcggccccgcctacccgcgcctcgagcgcatctgcctcaagcggatgaccgtctccgacgacgagctcgcgctcatccccaagtcattcccgctcttcaaggacctctcgctcgtctgctgcgacggcttcaccacccgcggcctcgccgtcatcgccgagggctgcaggcatcttcgagtgctggatctgactgaagattatttccatgaggaggagagcgaggtggtggattggatctccaagtttccagagtgcaacacgtccatcgagtcgcttgtatttgactgtgttagcgtcccattcaacttcgaggctctggaggcacttgttgcacgctcaccagctctgcggcgtctgcgtgttaatgatcatgtgtcgatagagcagttgcgtcgtctcatggcaagggcaccccatctaactcaccttggcaccggatcattccgatctgagccaggccctggtggtgccttgtctgtgtctgagctcgctgcctcttttgcagcgtccagatcacttgtttgtttgtcaggtttcttggacgtcaatggagcgtacctcccagcaatctaccaagtttgtcccaatctcacttccctcaattttagctttgcggctctaactgccgaagagttcataccagttattcgccactgcatcaatcttcgcactttatgggttcttgatactgtgggtgatgaaggccttcgggctgtggctgaaacatgctcaaatctccgtgagctacgggtttttcctctggatgccactgaggattccgaggggtcagtctcagatattggtctccaggcaatctcagaaggctgccggaagctcgagtcaattctctacttctgccagcgcatgacaaatgcagcagtggttgccatgtccgagaactgccctgaccttttggtgttccgcctctgcattatgggccgccaccgccctgatcggattactggggagcccatggatgagggttttggggcgattgtgatgaactgcaagaagctcaccagactttcagtctctggcctgctcaccgataaggcgtttgcgcacattggaaaacatggaaaactcataaagactctgtctgttgcctttgctgggaatagtgacatgtctcttcaacatgtgtttgagggatgcactaggttgcagaagcttgaggtcagagacagcccttttggcgacaaaggactgctctctggtctgaactatttttacaacatgaggttcttttggatgaactcatgcaggctaactgttaggggttgtggggatgtagctcagcaaatgcctaatctggtggttgaagtaatgaaggaaaatgaaggggaaatggataccgttgataagctgtacctgtatcgatcattggcaggaccaagggaagatgctccatcatttgtcaacatcttgtagtactgccattgaagaagtttgttgtatggtcatgtttgttctactattcctgaccattgctgttgtattcctgttcaagtattgccagagccagagaggaagctccccgcggatgattttgaattgcgggaaatatgaatgcatcattaattaagcagatcatcaattattcttttctgggctgattgagtcgaggcttgaacctgtacgaggtttctttgatgtatgtatcttagtgaggcatctcaccttgttcccaacggaatctgagctattttcctagccagcaccagactgatgactttgttgtaccatagttgagttgtcggaactgattagtgattgcacagagactggctgaaggtcgactccaattcggcagcagattttacatggttccttttgccctcgagtctgcagccgttgatgttttgccatgtactgttcaatctatctgctcggacgaaggaacggcattatctacgctggaatgctccgtaaactttttgccttgtattttagattatcccagctacgataaatttcctcttcccatttttttttatagtttccacaagttatttttgtagatcaatgtagaccactaccacttttcttggtcacaaccttctgctgttattaatcaagaagatattggatgatgaaattcagtcagcatcaatttgttatcacgttctc

SEQ ID NO: 98 - DNA, 1413 bp, Hordeum vulgare
agagcactttgtggacccagaggacaagtctcatccaaagtttagtgatgtttctgatctagagttcctgatgtttccgagagaagatcaactgacaggaggatccgccacaagacttcagctcggtgaagctgtttctgagggaactgtgaacaatgagacccttggctacttcattggaagggtctatctcttcttgacacagcttgggattgacaaagaccgtctacgattccggcagcatctgccaaatgaaatggctcactatgctgctgattgttgggatgcagagatcgaatgctcttatgggtggatcgagtgtgttggaattgctgataggtcagcgtatgacttgcgtgcccactcggataaaagtggtgttccactcgaagctcatgagaaattcgcagaacccagagaagtggagaagttagttataaccccatcaaagaaggagcttggtcttactttcaaagggaaccagaaggcggtgctcgaagcattggaagccatgggtgaaactgaagctctgggtatgaaagcagctttagagtctaaaggggaggttgagtttaaggtctgtacccttgggagggatgttaccgtaaagaggaatatggtttcaattaacatggagaagaaaaaggaacatcaaaggaagttcactccatctgtcatagagccatcatttggcatagggagaattatttactgcttgttcgaacattgcttctatcaaaggactggcaggacagatgatgagcagttgaatgtttttcgtttcccccctcttgttgctccaatcaagtgtaccgtgtttccactggtcaaggttgagaaatttgatattgtcgccaagaaaatttcaaaagctttgacaacagcagggatttctcacattatcgacatcacaggcactacaatcggtaagaggtatgcaaggacagacgaaatcggcgtccccttggcgatcacagtcgactcaactacaagcgtgactatccgtgacagggacagcaaggatcaaattcgtattgaggtcgacgaggtggcttcggttgtgaaggaagtgaccgatgggcagagcacctgggcagacatcatgtggagatacccagcacacaccaccttggccaccgatgaggaagaagcttcagaaacctgaagggtacagtcgaagagtcttccatgggttaaatgatatttggcttttgcagtttcggatgcgtgtcatgttaacagaaatgctaatggagcgttgccctgtaatcctagtcccgttttcccttcacgtatggttttcatccgttccttgtcgatatgtactgtatctacatgttcatctcgtgtgattaaaaggaagagacgtgtgcatattttctttcgggtctgattgatattgttaagatttgt

SEQ ID NO: 99 - DNA, 1287 bp, Hordeum vulgare
aacgacctggctgagatcgggggcagggtgaggagcggcatctcgatgctgtccaacgccaacgccgtggcggagatctccaagatcgcctcctccttcctgcctttcgcgccggaggaagaggaggaggatgaggtggatgcggtgggtgtgacggaggaggtggtggtcttcgtcaggcacatctcgacctctcccgagacttggctcgatttccccctcttcgtcaacgaccggcacgccgatgattttgaactgtcagatacacaatatgaacatgcattggctatagagcgtatagtaccaagcttatcatatctcagaaccgaactttgttcgaccaatatgagtgaagcatgcttttggaagatctattttgtgcttcttcactcaaagctcaataaggaagatgccgagcttctttcaacgacacaaatctcggaagcaagagaagagttattgcaaagctccccaaggatgaaaaatgtatcgtctgagggtcctgggtgctcatcagaaagcagcaatgttccatctacccaagctgaagatatagagttctcaccctcgagcatccaagacaagattggaacggctgaagcaacatctttccaagaaccaacccctgatcctctgccagcggctgaggctgacaagcatcccatttcaaccagcgagccggaaatagttgacaagtctgtaatcgaagaagagctggtggccataactgaaatcaagaatccgggtgacaaacccaacctgtacactccggatgatgacgacgacaaagaagtggaggattggctagaggatatggaccatgatgacaacaaaaccggcaatatcacttcggttgggcaggacgaagatgtgtcattcagcgatctggaggatgacgatgatgattaagggttggctgatggtatataccaaaacccagtgcctgatacaaacgctgttaaaagaaggatcgtgtctccctagctattacaaagcgaacagcatggaagcagaatcacgacaagtttataagtatgtccctgtggttttgctttctcgattctagttgcacgtttacttgtgtgccatcatggtctgtacatagaaacactagccgcccgtgtgcaactaccacttcttcgctgtgtcgatgcaggattctgattgtagataccacaaccagcgtacgcacaatacggtctacctatcagatatcttgtaactggttaagttcaagcaaactatttttgttttcctttttcaccataggtaaattgcaaaaaacca

SEQ ID NO: 100 - DNA, 2685 bp, Hordeum vulgare
gttttgtttcatgctgttgtttggcttctccccactgtaggcattatattttggatctgatgagagtgactcctcgagatgctaactacattggactgcagcaccgtttctgtgtgttgagacctgagcttgtagcctcatttgttgaggctgaatccataaagaaatcccctacgcagaaagttccggatgttcccacagaattgaatgggcaagaatctgatgaccaacatgtcagggcttctgatactacggctgcttctgtggaggaaaatgacaagtctgatgaaggccctgcttctgcacctgccgaaagtaacgactcaactgatgaaattcttttcaatccaaatgtatttacggagtacaagcttgctggcagtcctgaggagattgaagcagatgaagctttggttaaaaaggttggttcgtatctgctagatacggtgatcccaaagtttgttcaggatctttgctctcttgatgtctctcctatggatggtcaaactttaactgatgtgctgcatagcaatggaataaacgttaggtatctgggcaaagttgcaggcatgatcaaggatctgccacatttgtgggacttattttcggctgagataattgttaggtctgcaaagcatgttgtcaaggacatactgaggcaaagcccggaccataatattgcacctgctgttgctcatttcttgaattgtttttttggcaaagttttggctgttgcaacaaaaggtactggcagtccgcagtcgaaaacccagaagggccagaaatcaagtcaatcagcttcttcaaaaaagggtcaatctgcatattcccagctaacatctgacggagtttggtctgacattaaggagttcgcgaaacataaataccagtttgaagcgccagatgatgcgagggctggggctaaaagagttgctgttctccgcaatctttgccagaaggtgggaataacaattgccgctcgcaaatacgatctgcattctactgctccattccaatcttcagatatcttgaatctccaaccagttgttaagcactcagttcctacctgtactgatgcaaggaagcttatggaagctgggaaaatccggatggctgagggaactctaaatgaggcgtatggactattttctgaagctttttctctacttcaacagatcaatggtcccatgcacaaggatgctgcaaactgttgccggtaccttgctatggttttgtaccatgctggcgacacagcaggagcaattgtgcagcaacatagagagcttatcataaatgagcgatgccttggtctagaccatcctgatacagcccacagctacggtaacatggctttgttctatcatgggctcaatcaaaccgaacttgcactgcgacacatgtcccgtacactgttgttgctgagtttagcatctggtcctgatcatccggatgttgcagcaactcttataaacgtggcgatgatgtaccaggatgcgagcaatatgagtactgctcttaggtatcttcaagaagcacttaagaagaacgagcgccttttaggcccaggtcatattcaaacagcagtttgctatcatgctctcgcaattgcattcagctgtatgggtgcatacaagctttcagttcagcatgaaaccaagacacatgatatactggtaaaacagttagggagtgatgattcacgaacaaaagattcagaaaattggttgaatacattcaaggagcgagaacagcaggttattgcgcagaagcaaaaaggccaggtaactgccccctctgctaacgctgttgaattcttgaaggctcatcctggattgttccaagcaatgaaggcagctgcaatccaatctggtggtgatggaccagcaaatgtcaacagaggaagaggaggggacgagcgtgctgctaaggcggccgcagaagcccgaaaaacagccgttgccaggggtgttaatctgcgcaacgggcctgctgcgagcgtttctgacatcaatcaaattctcaacctcatcaactctgctgcatctgcatctgctgcctctcctgccgccaatgctcagacacctgaatctgaagtgccgcagtccaatggtactaccctgaatggcgcaaaggaggctaaggatgcaagtcgactggccgctaaggctgacggtcaagccccagtaggattaggtgcgtcattggagctgaagaagcagaagtcgaagcagaaggcatagaaatgaatctgcaatggctgttttctccttgcaattttgaacctctagggtgattattttttggcccatagggattgtcacgtccacatagtggcagagtaattttatttgtggtggggtgggggttcgtagaatgagtgcaataaaaataatagcaacgagaatggggtgaagacaaattcttctggtggtactgctgattgatgagataaaagccttgcatggctcatccttttgagccctaatttctgtaaactggctacaccaatttgtttgctgcacagaagttaacaagttgaaggttttattgagccgtaggaaggtcaatatcttttcttctttcttttatcctttacttttgtgcctcgtacgtggattgcacaccagaaaatatattgtttcatttcatcctatatcagtaagcagacgtctttcattgcatcca

SEQ ID NO: 101 - DNA, 1441 bp, Hordeum vulgare
ctaccggggcggccgccaccgggaggcgctggagctctactcggcggcgctggcggccgcccggggccacgcgcagcgcatcgccctgcacagcaaccgcgccgcctgctacctcaagctccacgacttccacaaggccgcagaagagtgcacatctgtcctcgagttggacaccgagcatgctggagctctcatgctacgtgcccagactcttgtcactctaaaggattaccagtccgctctatttgatgtaaaccggctaattgagataaatccatcctctgaagtatatcggaaccttcatgcacgactgaagacacagctgtcactagccccgatcccagagtctgatgaggagtccctgtatactgaagaagacaaagaagatctgccaccaaaagacaatacgaagaatgagactgcccttgttaagtctgatcaaccttctgcaaaactgattcctgaaaataaacctgtaacaaaagctctgaaggttgaagtccttcccaatctacattcaaaacctgagggtaccatacaaaaaccaaagggccattcagagcttgattacaaggaacctttaacggaagctccgaaggttcaagtgtctcccagtctgtacaaggaacctttaacagaagctcggaaggttcaagtgtctcccagtttgccttcaaaacctgagtgttgggggaccatccaaaaaccaaagggccattcagggcttgattactcgaaatgggacaaagttgagaatgattcgagtgaagatgacgatgatgatgaagaagatgacttgcctcgatataaattcaaagtcagaaccatcggtgtgcgtaccgtgaagtgaatgggatcatcgataaataagtttactccatggtctgtgtatagctgtttgacagcatccctgctaactgtggtctcatctgttcggttgcatcttgagatacttggatgaagtgttgccgattggtgggtgaagacatgagtacccgctgctctcgtctcgtgcgctgcagctcaggttttttgaccttagccaaggaaacaagtctggaatgaaatcatgttttcagcgcaaccgcggcaaccgtgggttggagcacacagcacagcatgtgttaatcatgtagggagcccctttagattcgagctaacaatcttagaccattgttcatcttcgttgattctatagcctagcagtctctgtacatagattgcgcattcatcatatgtataaaaagcttatttgtgtcccgccccaagacatcgtctcaagatctcagtcagcaaattgttcaactgcgatgaatgtgctgattagtcgcgcactcacactgtaatcagagaagtttccgccatgcatgtgctccagggcgatgaatattactccgtatgattaagaaggtgtgctccagggcgatgaatgggctgatta

SEQ ID NO: 102 - DNA, 2919 bp, Hordeum vulgare
accattcctctcccctccccagcataaacacagctcagcaggccccatctccaatctccattccattctctctctctccctccgggccggggcttaaatccagcacggcaattgcctcgcattgttcccgaggactccttggttctggctgcgtcgtaccagggacagggtagcggtgccgttcttggagcgctgttcccgggcagctgcttgaggccagccgtcccgtcagggtgctgttcgccggcggcgaggcaatggggagcggccgcgtctgctacgttgtcgcgtccgtcgtgttgctctggctgggcgtggccactgcgcagggtgactctccttggaagacgctcagcggcaatgctccggcgatcatagccaagggtggattttcaggcttattccccgactctagcgaattcgcttaccagttcgcgatgattgcgagctcgcccgatacagtcctgtactgtgatgtccggctcacaaaggatggccttggcgtctgcctaccagacattaagatggacaactgcaccaacattccagatttctatcctaagggtaagaagagctaccttgtcaatggcgtatcgacaacggggtggttctccgtggactacaacggcaccgagctatcgcaagtgtctttgaagcaagcaatcttctctcgcacgcctaggtttgatccaagcttctttccattgctcgctgtcgaagatgtggcgtccaagtttaagcctcctggaatgtggctcaatatccagcatgacgatttctacagccagttcaatatgagcatgaggaaatacatcctttctgtgtctagacgtgtcatcgttgactacatctcatcgcctgaagcaagcttcctcaccagcattagtggaaggattagcaacaacacaaagctcgtgttccgctttcttgacgaggccactcttgaaccatctaccaaagacacatatggttccatgttgaaaaatcttacatttatcaagacatttgcatctgggatacttgtcccgaagaagtacgtctggcctgtttcaccagataattatctgcaaatgtacacttcgatcgtcgatgatgctcataaagtggggctggaaatttatgctgctgattttgccaacgactttgcgctcagttacaaccatagctacgatccgttagctgaatctctatcgttcattgataatggtgcattttctgttgatggcatattgactgatttccctgtcacgccttcagaagccattggctgttttgcgaatttgaacaaaagcaacacagctcatgggaaacctctaattatttctcacaatggtgctagtggagattacccaggctgcactgatctagcttatcagaaagcagtcgatgatggtgcagatgtcattgattgccctgtgcaagtaaccaaagacggcataccagtatgcatgggatccattaacttgatggatggtactactgttgcaaaatcaccatttgcgtcccagacagcagtaatgaaagatattgagagtgtcctaggagtctttactttcaacctcacttgggatgacatcgtgaagaatctaaaacccaagatatctaccccacttagcaccttcagtttggacagaaatccaaggtacaggaatgcaggaaatttcatgaggttatcagactttctggacttctcaaaagataaggatttatcaggaatcatgattagcatagagcatgctgcttttctggcagcggaactcggatttgacatggtagatgcagttatcaaagcgcttgacgattcgggctacaacaaacaaactgctcagaaagttatgattcagtcaaccaacagctcggtactggtgaagttcaagcagcaaacgaagtacgaccttgtgtacatgatcaatgaagatgtcagcgatgccgcgccttcctccctcgcgggcattaaaaagtttgccgatgccgtttctgtcgaaaccagctctgttttccccgaaaaccgccatttcacttcgcaccagacagaccttgtcgagtccttgcagaccgccgggctctcggtctacgcctacaatctcatgaatgagtttgtttctcagccgtacgacttcttctcggatgcgaccgcgcagatcattgcctatgttcagggtgccggagtggatgggctgatcaccgacttcccggcgaccgcccggagatacaaatcgaacacttgcatgaacatggggaacaaaaccccaagcttcatggcccctcctcgtcctggtgatctgctgcagctcatcagtaagccggcacaaccaccggcgctagccccgatgccgcttctattggattctgacgtgtcggagccgcccctaccgcctgcaagatcgaacactgctactacagctccagcaccttcgtctgcacgcaggacgcagactggtatcccattcctcgtcaccttggcaatgctttgcgcctgggccgcgatctgaggtggcaatgccacatgtcagtatggcacgctagaggtctgccggtctactaatccaatgttgtcttctccttcggtgattcatttgttcttgtaacttttgcgttgcggggttatatccgggatgcccctataacactccctagtgattattatcagtacatatgtgttggaatatatcctcttttgttctggaccgagcgtttgcaatcaagctggtacagttctcatcaatctgagtttctacattaaaagtagaatctaattttctgaggcatgatttatcgtgtgcgagtgttagactatgtaagtgtattacgtatatcttatgtatacctaaccgcgtatggttaggagttatatttgtacctatgtgcttccaatatatatacaactcatgccacccctagagggttgtgcgattcacc

SEQ ID NO: 103 - DNA, 1852 bp, Brachypodium distachyon
ctgcccgcgctgcatatccacagagcatcttctcccactccactagcgcgtttcacgcagtcggcagagtctccctctagagagcgagtccgcgcgccgaggccagagcaagcaagagagaatggcgagcaaggcggtgaccatcggcgatctgatccagcgggtcacctcctcctgcctctccaaccgcttccccggcaactacgccctcaacgactccggcgccgacaccgacctcgacgaggaggacgacgaccccttcgcggatttcggggacgccgccgacgaatgccggccttcgcccggcgaggtaacggcggcggccgcggcgggtggggagcaggaggaggaagagcggaagctgaagatctgggaggaggaggagaagcggaaggtggcggagacggcggcggagacgaaggggggcgagcgggcgcgggaggcggacgcgctgatggcggaggtgttcgacgcggtgtccggcgtgcggcgcgcgtacgcggcgctccagggcgcgcactgcccctgggacccggaccggatgcgcgcggccgacgcgggcgtcgtcgccgagctccgccacctcgcgcgcctccgcgaccgcttccgccgctcagcggcctcccccgacggccgcatcccgcaagccaacccttccccgccgccgctccgcgaggcgttagccccgtacgaggccgcgctcgaggacctccagcgccagctccagagcaagcaggccgaggtcgacggccttaaagagaagctcgcctcgaacaccagcagcagccgccgccgcctccacccctccaagaagcagcagcaccccaatggtgcagaagccgttgtcggcgcgccgacggcggagctgttcgcggcgtgcgcggagcaggcgcgggcggcgacgcgggcgttcgcggcgcacctgctgaaccttatccgcgcggcggggctggacccggcggcggccacccggtcgctcaccaagatcccggtggcgtcttcttccccgaaggtggccaagcacgcgatggaggcgcacgtgacacgggtgctgctgggcgggttcgagcacgagtccttctacctggacggctccctctcttccctcctcgacccggccgcgtcgcgccgggaccggcacgcgcagttccgcgacatgcgcggcatggaccccgccgagctcctgggcgtgctcccggactgcgccttcggccgctacgccgccgccaagttcgcgtcgctcctgccgccgcgcgtcgaggaggccgtcctcggcgccggccacaggggcggcggcgggggcaagcacccgaggacgccgttctacggggagttcctgcgggccgccaaggccgtgtggctgctgcacctgctggcgttcgcgctcgagccgccgcccagccacttcgaggccggccgcggcgccgagttccacccggagtacatggagagcgtggccggcccgccgccgccccgcgccggggccggcatggtcgtcgggttcgccgtcgcgcccgggttcaagctctgcaacgccgccgtcgtgcgcgcccgggtctacctcgtgccccgcggcaccacgggccaccaccctcctccctgctagtgctacctcgttgctcattggtgtggaggaacaaggactgcacctgagtagtaccatctcctggctgccttcattattagtaggtctctactccgtgctattattagttgcttttcctctctgaagagatctcatgtagtagtacaacaaagaggctttgaaatgtatgatcgatcatgtgttgaagtactcactaacagtgatgtttgatcacgtagtagtcatgactatagtacagtactctaa

SEQ ID NO: 104 - DNA, 2313 bp, Brachypodium distachyon
acgggcactgccgctgtgccgcacggtcgctgccgcggcgcggggtgaggcgagcgcgcgccgagctcatggctgtgcgcccctgccgcttccccgcacgcaaccgcctcgcgcctcctcctcttcttaagtctcaatccccgcttccttccctccccgtcagtccactcccccctgctaggctgctagctcctccgctacaacgatctccatcccacggaaccgaacccgcatgcctctcgcggcggccgccaccgtcgccgctgcgcgcccctccccgattggcctgccccgcccgttatgccgcgcttccgcccatccacgccgccggttccggctgcaggcgacctcgcccgcctccacgccggcacctgcgcccgcgccggcgacagcggacgagggacccggtgcggggccgtgccccgtggttaggttcgacatggctgacttcactgtcgccgaccgcgtcagcgtcgggctccacggacggtcggatgagatgatcttcgaggccacggtgcgcgatccgagcagtgagctatacgggtcaacggtggtgttgaggcagctgacgagctcgcaggccaagcgcaggggccggcgcgcgctagaggtgctgaagaagctggctcgccgccagatcatgtaccactcgtacgcgatgcaggtccatggctatgtcactccaagcaatgtcatggaggagggcgatggaccattcattttggtgcacgggtaccatgggagttactccttgcgtcactggttgcaactctcggattggcttccaaccttagaagcaacattggcattggatgaagaacaagtaaggagggtaggagatgattcgattggaggacctgctgttactcggcagctacgtctaatcaggatattgatgagagaccttctgattggtgtaaattatctacatagccatggaatggcacatactgagcttagactggagaatgttcatgtaagcccagtagacaagcatgtcaaagttggtattcttgggaatgctgttgattttcatgacagtgatcctaacaatagttcagtaccaagtaacaatgacagacgaaaaatgatgatagcatttgacatgagatgcgttggtttcattatggcaaagatggttctgaaagagctcatggattcttcaacattcctaaaattcaagtcattcttgaataagggaaatgatccatcatgtttgcgcgagttccttgtacctattcttagccaaaattctccaactgggaatattggtctgcagatgctcgatagacactggggtgctggttggaaccttttggccttattgctcgcaacaaaatctgacaataggataagttgcctcgatgcactgcggcaccccttcctttgtggacctaaatggagaataagtccatcagtgaatgttgtacgttggggcttgggatctactgctgtccgcctggctgaagattatatttatgggcatcaccagcgtagacggttagcatattttattgagttgatggaagtgctaaaccctaattcaagaacagagagttggcttcacctcctacctggtcgctggtgcctcttatactgtacaggaaggcacatcggtctaacacttcgtcagcctacccccagaatcctcatgagtgacgtgttcctcacatttgcacaaactccagagtctgttgaccccgttttatctctggcctcagatattggtttcaaaattatgccagaatctgactggcctcatgacaaatctggcaccgaaggaaatttgtctgttacaacatcagcaaggatagctcctgggaggatctatattaatgcagaagatagtaaagacagtaggatcacatcttcaaggagatatcttcacggcaaatggggaaaagcttcgaaaatgaaggagctgcctgctagcctccccaccgcaagcattaatgtcgatgaagacgaagttgatgtgtcaatgacttgtggctcgactttgaatgtcaattctgcacgtaaagtgctgcaagaggtccgtactcagaccccaccggaaatgttcgatttgtcaaagattgtttgtggtacatacatcgattcaaggttgatgattcttcgtggtgttaatgggtcggctttacttttcattagatcgaattgtacgtcagactcctgagaagaatattggaaccctgtgttttttcctgtacattcttgtatttgtaggtgtccattattgatttgtaacaactgtacataataagatgtccagcgaaatcagaatgttttatctaactttctttcgaa

SEQ ID NO: 105 - DNA, 2197 bp, Setaria italica
gggaaggtcctaacatgatggctgcggagttagttaagcagtactcaaacatcactttgggagaagacagtgagatatgtgatattaaacatgcgcttaaggcattgagaaagaagatccttagtttggattttgacaactctatgcatgtccatgatccacaggactcatttgagtacttggaagtgctgtacaaaatcagacgactgtctgaaaggttaaggaacctagacccttgtggagaagccaaacagctggatgaactcactgtgtatgccgatgacctttctgaaatggcaatggcaaggcttgaagaggaatttgtttatcttctgacacattacaaacagccattagaacaggaagttctctcttttcgctctacagaggatggcagtgtggaagacttttcaagcagctcattcagcgaggaacaatcagaagggaaggcaacaccaaatgatgtcgctggaggaccggagtatcttgttcctgatttgattcaacccggtgcactctctgctgtcaagtccattgctaaatttatgttcctgaatggctatgataaggagtgttgccaagcttatataaactcacggcagaatgcaatagatgagtactttgcatctcttcgtctggacaagctcagtatagaagagcttatgaacacaagttggaccaaactgaatattttaataaggagatggaaccgagcaatgagggtttttatccgagtctaccttgcaagtgagaagcgccttagcaatcatatctttggtgaacttacagattcaactgctgacttgtgcttctatgagatttcatttaactcagtaatacaacttctgagcttttatgtatctgtagctattggtcctccaaaaacggaaaagctttttcgtttgcttgatatgtatgaggtcctgaatgatcttctccctgaagctgaatccctgtttgaatcaggatatgatgatatgatcttgaatgagtatcatgaagcactactgcagctgggagaatctgcaagaaagacatttgcagaattcaagtatgccatccaatcatacacttcatcaaatgcagtggctcgtggagaagtgcatccacttacaaagtatgttatgaactacataagggctctcacagcatacagcaaaactcttgattcaattctcaaggacacagatcgaagacacctgcatcttgcttctgacattcagttgatggcgaatgcatatcctaatttcacagcaacagctttgcatctacagtctgttgccgcaattttggaggcaaatcttgaagctggttctagactgtacagagatgatcgattgcagaacatctttatgatgaacaacatccactacatggtccagaaagtgaagaactcggatctcaaaagctttcttggcgatgactggatccgggttcacaacagaaagtttcagcagcatgctataagatatgagagggcgtcatggaacagtgtcctctcttacctgagtgatgatggcttgtgcgctgctggtgatgctgcttctcgcaaaaccatcagggagaagataaaaaatttcaacctatcctttgaagaggtttatcgagttcagacagcatggtctgtcccagatgaccaacttcgtgatgatgtccggatttcaatatcactgaaagttatacaggcctataggacattcgtgggaagatatggaagcgtccttgatggctcaaggcatcgagatcgttacataaagtatagacccgaggatttggagacacttttgctagatctttttgaaggagctcaaaagtcactgctgcattcttgtcgagcgtgaagcttaaaccagttcgtcgaagagatgcatcagccccctccaccttatttttggttttcttctttggtttgtattatagaatcatagaatgtatagttgaattattatagtgatgtgttgttctgtctgcccaacttgcataattttgccttttgttcgcagctcctcttgctgcatagaattccttacaacattgccgaagttcagaggatgttagaaatagcaatctgttgttcccaaaactttgatacctgagtatgtatagtttctgaatgtcttggtactgatacagtaatcttgcatccttggttcgtttaataatttgcctgcactatgaaggatatgtgttgctctgc

SEQ ID NO: 106 - DNA, 1252 bp, Setaria italica
ttttcttaaacgccgcgcctcgcctcaagaccgcccacctttccgtccccaatccatttgaaaccgcgccgcgtcggcgtgaatcgtcggcggcggcgatggaggtgggcgacctgcacaaggtctgggatgtccgggaactcaagaggaagcccgacgcggccgccgcccgcgcgctcctcgaccgcgtcgccaagcaggtccagcccatcatgcgccgccacaagtggcgggtcaaggtcctctccgagttctcgccacggaacgccaggctgctggggctcaacgtcggcgcgggcgttgaggtcaagctgcgcctgcggcgcgccggccgcgactacgatttcatcccctacgaggaggtgctcgacaccatgctccatgagctctgccacaacgaccgcgggccccacgacgcgcagttctacaagctctgggacgaactccgcaagggtatcactggaacaggacaagggtttgatggtacgggaaggcgggtgggtggatttacaatacatccgccaccaccatctctccgacaagctacattggttgctgcacagaagcgagcaaggaatggagctctattgccttctggaccaagaaagttgggtggaaacaacgatattatgagtgcgcttagtccagcgcaagctgctgcaatggcagctgaatggagaatgcatgatgatttgtggtgtggatcccacaatcaatctggtattgatgattcggatgacgttattattcttgaggaaccacctaataacatgacaataaaggatggaaaaaccacaaagggtagctgttccaacacttctgcagagtccagcacttcgtctggaattcacacagcagcacgagatggtccctcatctttttggacaacaggtgatgcagttgatgattcaaagtgggaatgtggtgcttgcactcttctaaatcaggcaagatttctattccaccttcctttggcaccaatctgtgaagtttgtggcactgcaaaacctaaaattgcaaaggcgaagtacatgacttggtcttgtaaattttgtactctagaaaacagcactaagcttgacaaatgctcggcgtgcgaccattggagatactcatatgggccacctatagccacttatggcccaagctatgattgagaattgagataacattgaaggctacaattgtacagttacagcacagtactgtgccaggtctttaacaatctttcaattttctttgtgtaaggttc

SEQ ID NO: 107 - DNA, 1711 bp, Setaria italica
cggcacctgcgatggccgtgcgccactccctcgaggtggccgacgaccgctgcgacgacgacgggcaccgcccgcgccgtgccggcacggcgtggacgtgcgcggcgcacatcatcacggcggtgatcggctccggggtgctgtctctggcgtggagcgtggcgcagctgggctgggtcgtcggccccgcctgcatgttctgcttcgcgctcgtcacctacgtctccgctgcgctgctcgccgactgctaccgccgcggcgacccggagaagggccccaggaaccgctcctacgtggacgccgtccgcgcctacctcggcaagaagcacacctgggcttgcggctcgctgcagtacgtgagcctgtacggctgcggcgtcgcctataccatcaccaccgccactagcataagggcgatcctcaaggccaactgctaccacgaccacggccacgacgcgccctgcgactatggcggcagctactacatgctcgtcttcggcgccgcgcagctcttcctctccttcataccggacttccacgacatggcgtggctctccgtcgtcgctgccgtcatgtccttctcctacgccttcatcggcctcggcctcggcatggccaccaccatctctaacgggagaatcaaaggaagcgtaacaggtgttccgatgaggacgcctatgcagaagatttggcgcgtctcgcaggccatcggcgacatagcgttcgcatacccatactccttgatcctactggaaatacaggacaccctgaagtccccgccggccgagaacaagacgatgaagagggcgtcgatgatctcgatcctcgtcacgacgttcttctacctctgctgcggctgcttcggctacgccgccttcgggagcgacgcgccgggcaacctcctcaccggcttcggcttctacgagccctactggctcatcgacttcgccaacgcctgcatcatactccacctgctgggcgggtaccaggtgtacagccagcccatcttccagttcgcggacaggttcttcgcggagcggttcccggacagcgggttcgtgaacgatttccacacgatgcgggtgccgtgcctgccgccgtggcgggtgaacctgctgcgggtgtgcttccggacggtgtacgtggcgtccacgacggcggtggccgtggcgttcccctacttcaacgaggtgctggccctgctgggcgcgctcaacttctggccgctggccatctacttccccgtcgagatgtacttcatccagcggaacgtgccccggtggtccgcgcggtgggtcgtcctgcagaccttcagcgtcgtctgcctcctcgtcagcgccttcgccctcgtcggctccatcgaggggctcgtcacccagaagctgggataggactggtcactggtgtcctccatctctgttttggattggattgtgtttcttcttccggttgtgatggtaatggagaatgcagcgaatggggaggtggtgtttgtctccttgggatgatgatgaacaggagcagcatactagtagcaggtcatctgcagcctgcaggaccagggagtggcaggttttgcgcagtgtcttgttctgtgccgtgcacctgcatcagagtggaacatgtacacagtgtcagagtggcagagtgcatacatgtcatgttgatattgccgatacttcagaagttcagaagaatgggaagaacctgt

SEQ ID NO: 108 - DNA, 2153 bp, Setaria italica
aaccaccaccctccccaacctccaattccagttgtcttccccgcccgtgccagctcggacccctccgccctccccgatccccaattttaaacacctcctcctctctcctgcggcccactcgcctccctctcctcctcccccctcccacgccgcggagcgaatccggcgccgcgctcgcgctcgctgcccccggcgggacccgcgccgcggctcctgcacgccccgcgatggcggcgtccatggcgtcgccgcgggggcggtcgatccgggagacggtgctggagaccgtcgcggcgtaccacaaccagcagcggatgaggcgcaagctgcgcaagagcctcacctacgcgggggagctctcctccgcgggccgggcacgcggggacggcgcgtcatcgtccgcctcggtatcctcgctctgcgggcccgaggacgacgacgagcccttctgggaggaggaggagggcaccgtcgagctcgtccagctcggggccaaccgcgccaagaacgtcctcatcctcatgagcgacaccggcggcggccaccgagcctccgcggaggccatcaaggacgccttccggatcgagttcggcgacgagtacagggtcttcgtcaaggatctgtgcaaggatcacgctggctggccactcaacaacatggagagctcatacaagttcatggtgaagcatgtgcagctctggaaagtggctttccacagcacctcgcctagatgggtccattgcttctacctagctgctctcgcctcattctacgccaagaaggtggaggctggactgaagaagtacaagccagacatcataattagtgtccacccccttatgcaacacattcctctgtgggtgctcaaatggcaaggcctgcaaaacagagttgtctttgtaactgtcatcacagacctcaacacttgccaccctacatggttccatgccaatgtgaatagatgttactgcccctcagaagaagttgccaagagggcagcattggatgacctacaaccttctcaaatccgcgtgttcggtcttccgattcgaccatcattctgccgtgcagttcttgttaaggatgaattgagaaaggaacttgaattggatcctgagcttcctgcagtgctgctcatgggaggtggagagggcatgggtcctgtcaagaagactgcaaaagcccttggagaatcattgtttggcagagagcatggaaaaccaattgggcaacttattgtcatttgcggtcggaacaaaacactgagctcctccttgcaggcacttgaatggaaaataccagtaaagattagaggatttgagacccaaatggagaagtggatgggtgcttgtgattgtattataacaaaggctggaccaggtaccattgctgaagccttgataaggggtcttcctataatccttaatgatttcatacctggacaggaagttggcaatgtcccttatgttgtggacaatggtgcaggcgtgttctccaaaagccccaaggagactgctagtcttgttgcccgttggtttggtccagactcagaggaattgaaaaggatgtcagaaaatgcactgaaattggctcagccggaagctgtctttgacattgtcagagacatccatgagctctctcgggagcaaggcgtgatttcacagatatctagttccttgacgtcatccttctttataccatcacctgaaaccacacctctccaacttatctgaaaccttggagctgtgcatagctagaattgcaatctctgaccttgtggacttggcattctcccctacagcatgacctggaaatggaacttcagggagcctctctcatcagctgttggtacggggattccacaacttttcagttcatgccctctcatggtagttatgggtgggctggtttgactaactggttgttgtttggattgttggcttcatgttaattctgtgaaaaccattcattcatatcatgtttccacccttcatcatcagtgggggattggtggtggtggcttgtaaaatacactcaattttgtgcatggaaaagtcagacccttgtcatgtgctaaccatgtgataagttcatgtaagtggaagatgtgtataatatgatgggagattggttgagtggaaattttgtttgcg

SEQ ID NO: 109 - DNA, 2517 bp, Sorghum bicolor
gacgccgggcggcacaaggagaggaatcggcagctccgcccgttcccaccgcgttctcatcgatctctgtgtgtgtgcctccgctcccgctgcgagatgcgtccaccgcgacgtcttgctaattgccgtccacacgggccaagatgagcagagacgtgacggtgccgccggtgccgtccgggcccggcatataacctttctccggccggccgctccaggcactccatgttttttcgcgcgcggcgcgcggccgcacgacgaagccacacccacacgcccaccacacgcgcggccggccggacgcagtcggtcgcgatgggtttcttccagcaatgctccagctccagcagctccccgctgctccccgtgctgctcgcgctcatcggcctgtactgcgccgccgccgtctcgtgctcggcggccgccgcgcctctgccggcgccggagacgacgacgacgatgcacgagagctacgcgggcaagtcggagttcaggacggtgaaccggaaggagctcgactcgtgcctcaacccgagcccctacctggccatcaatgtcggggccggggcggcgatccccgacgaggcgttcctccaggtcaccgtctccggcgtcctcaagcccgacgcctccgactgggtcgccatgatcacgccttccaactccagcgttgctggatgtcctctgagtggagtgaactacgtggagaccggcgacctggcgaatctcccgcttctctgccactaccctgtaaagtcccagtacctgacaagcgaccccgggtacatgggctgcaagaacgcggggtgcgggaagcgcgacgcgtccggcgcctgcaaggcccgcacctgcgccgccacgctcaccttccacgtcgtcaacttccgtaccgatgtcgagttcgtgctcttctccggcggcttcaagacgccatgcctcctcaagcggtccggcgcgctccggttcgccaacccggccagcccgctctacggccacctctccagcaccgactccaaggcgacctcgatgaagcttacctgggtgagtggagacgggaatccgcagcaagtgcagtatggagacggaaagtcatctacttctgaagtcgcaacgttcacgcaggatgatatgtgcagcgtccccgtgctgccgagccctgccaaggatttcggctggcatgaccccggctacatccactcggctgtcatgactgggctccagccatctcagtcctacacttaccgctacggaagtgattctgtgggctggagtgacagagttaagttcaaaactccaccagctgctggttcagatgagctatcctttgtgatctatggtgatatggggaaggctccactggacccgtcagttgaacactacattcagcctggatcaatttctgtgaccaaggcagtggctaaagagatccaaacaggaaacgtggactccattttccatataggagacatcagttacgccacaggcttcctggtcgagtgggacttcttccttcacctcatcacgccactcgcttctcaagtgtcctacatgacagctattggtaatcacgaaagggattatgcgaactctgcatccgtgtatgtgactcctgattcagggggtgaatgtggagtcgcctacgaatcatacttccccatgcctgctgtcagtaaggataagccatggtattctatagagcaagggaccgttcacttccttgtgatgtccaccgagcatgagtggtcggagaagtcagagcagtataattggatggacgaagatttgtcatcggttgatagatcaagaacaccatgggtgatcttcattgggcatagaccgatgtattcctcccatggtggtatactgcccaacgtggattccaactttgttgcctctgttgagccactcctgttcaactaccaggtggatttggttttcttcggccatgtacacaactatgagaggacctgtgcggtataccagggcgattgcaaaggcatgccaacgaaggacaaaaacggaattgacgtctatgacaacagcaactataccgcacctgttcatgtcattgctggagcaggagggttcaccttggacagcttccctaacaatggggaggcctggagcttatcaagggtttcggagtttggctatggcaaggtgcatgctacaagaaccgatatgctggttcagtttgtaaactcaagttcgatggaggtacgagaccaatttaggattgtgaagggagcttcggtaaacaagacaccgagcctgatacttcaataatagctgctgctcacaacagaaagaagatttaacgggacatattctcccttttttggaagaagaatactatttgtttttgtatactgtaaataggtgctaaagaatatattattgtatattctacagataactgtgtatctacaacattacatcaatagatggtccttttaaattagtcccttagtccgtcagcatgtgaaaggagacataagtgttatttaatgcttaata

SEQ ID NO: 110 - DNA, 4516 bp, Oryza sativa
aacggagggagtatatattcggccggccggcggcataataggatagtggagtagtagagaatctgttgcttgagcataatagtaccaaatatcctctgatgtgatgaaagaaaagtaaaataaaaaaaaaacaagagttaaataagaaggtgcggcctgtgaatcatggcgcgcgggtgcgggcggccggcgtggggtgggagggggactggtgagtgacgcggcgccggaggaaacgacgcgacaaaggtggagccgccgcaaacggacaaagctaccttacccggcgccggctccagcgatcagcaccgccgcagacgcccgcatccgccccatcgccttctccaccgtgccgtagcccggccgcacaagtcgccaccaccaccaccgcaccctcgccaccgcatcccatatccctccgccgcgcgcggcatgctgatcccactcgctcacctcccacgcccaccaccactcaccgcctccgctatatttcgcccccgcgcccctcgcctcctcgcctcgctctcgctcgccacccctcctcctcctctacttgcagcttcagctttcgcttcgctgccgctgcgggcgctgctctccgagtcccagcgggaggtggagatggtgggcgaatcggaggggaggccgctccgggttggcctcgtctgcggcgggccctccccggagaggggcatctccctcaactccgcgcgatccgtcctcgatcacattcagggggaggacttgctggtcacctgctactacatcgactgcggcatgaacgcctacgccatatcacctgcgcagctatattccaacaccccttcagattttgatttcaaacttgaaagtctagcccaaggattccaatccctatttgactttgcacaacatcttgccgcaaatgttgacattgtcttcccggtgatccatggcaaatttggtgaagatggtggtattcaggagcttttggagaaagcaaatgttccatttgttgggacaccctctaaaaattgcctccttgcttttgacaagtataatgcatcgcttgagctcaatgcacaaggctttttaacagtaccaaactttcttgtagagaaggacaaattagctaagtcgaaactggaggaatggtttcaaagcatcaatttggataaagaaaatggcaaagtagtggtcaaacctacaagtgctggatcgagtattggtgtagttgttgcttatggtgctaatgatgcagctgagaaagccgagggaataatttcagagggaattgacgacaaggttatcatagaagtttttcttgaagggggcactgagtttacagccattgttgttgatgttgggacagctaataacagtgagcctgttgttctccttcccacggaagttgagcttcaatcctccagtaatattgatattcaggaggatacaatatttaactaccgtcggaaataccttccaactcgacaggttgcttatcatacacctccacgatttccgtcagaggtgattgattgcatcagacaaggagtgtctattttatttcgttgtcttggcctgcgtgatttcgcgaggatagatggttggtttttacctactcccgttacctctctaccttcagctgaaaatactggtaaatttggaaataccaaatacggtgctgtcctttttactgacattaatttgatgactgggatggagcaaaccagctttttattccaacaatcttctaaggttggattctctcactctcgaatccttcgtacagttgttcagcatgcttgctcgcggtatccgtctcttgtaccatgcagtaatgcatggactgctttgtccagaaaaatacaagcagcaaaacaagcagaagcaatccaaaaaggtacatccaaaaaaaaggtctttgtgatctttggtggtgacacttctgagcggcaagtctctcttatgagtggcacaaatgtctggcttaatttgcaaggttttgatgatcttgacgtgacaccttgtttgcttacatctggaaatggttattcttccttccacaaccaaaatatgaatggaatttcacgtgatgtatggacattgccatattcgttagtgctacgacataccattgaagaagttaatgccgcatgtattgaggcaattgatccagaacggatggaattaacatcccgtttacgtgaccaagtaatgaatgaacttggacagtcattaagcaaatatgattggtttgcgggctttgacattgccgataagcaacctatcaaatactctcttcaacaatggatcaatcatgttaaggaagctcaagccgtagtgtttatagcagtgcatggtggtattggagaagatggtactattcaatcgctgttgggatctgcaggagttccttacacagggcctggacaaatagcttctaggacatgcatggacaaagttgcaacttcacttgccgttagccatctggctagctatggagttcacaccataccaaaggatctgagagcaacagaagagatactaaagtcgtctcctgacgatatctggaatgacctgaaagcaaaactacaaactgaaacggtttgtgtgaaacctgctcgtgatggatgctcaactggtgtggcaagattgtgttgtccgaaggacttggaggtatatgcaaacgcattggagagaaaattacagcgcatgcctgctaactgtttatctagggcacatggtgtcattgagatgccagtctctcctccagagtcactgatatttgaaccttttattgaaaccgatgaaattatcatttcaaccaaatcagtggatgatagcacccgacatctggtatggaagggggaaaataaatggcttgaagtgactgttggtgtagttggcaaacgtggagaaatgctgtcactaaatccaagtatcacagtcaaagaaagtggtgacattttatctcttgaggagaaatttcaaggtggaactggaatcaacttgacaccacctccttcaacaattatgagcgaggaagccctgcagaagtgcaaaagttgtatcgaaactttggcaaacactctcggattggaaggcttttcaagaatagacgcatttgttaatgtccagaatggggagatactgctgatagaggtaaacactgttcctgggatgactccatccactgtactgattcaccaggcactgacggagaaaccacccatctatccccacaagtttttccggacgcttcttgatctggcgtttgcaagggcgaactagctaagctactactgtaactatgtttgtgatgtattttcatttcagtgcaaataaggtgcctaccatgcatgtatcgatctgtattactgtatgcaatatgcaactgccgatgtgatgtgatcagtactgtaccgtgttgaaggattaatttttttttaaacctaaggcggaactttgttccacttttatatttagaagaagagaattgacccagtttataaggaaaaccgggtccgaaaaccatacaactgcacggttaattacaaacccaccgctacacaactaacaacaactgtggagtccaatcacaggacatcgctgccaagctaaacacaaaagcgacacaacaactcccatatcgcagaagaggttatcgttgccgagctagccgccccagcgactcagcagcgccgacttcacaaccgcaacaatactgaagacgaaagtcgccaaagcgaaaagcggctccgacgtccaacaatagacatcagccaagccagcgaggagccacttccttcatacggctagcacaaggactccttggaagagactgcaacatgtcatcgttgccaagcgtcgccgcaccctgtcagcgagcagcttcgacttcattagcagaaacaaccgaagagcgtgtcgcccaccataagaatgaagcggacccaagaaggcgaagcctcgccaaacacaagatatgaaagcttttgaaccgaaaagaaccatcaacagccatcgatgcattgaaacttctccgtagcgacgccctcaaggagggcacgacgcgtgacgccgccgccgctcgtccgaaaatcggaacaaggttttcacctggagatttgtggggatatgaaagaacacaagacaacgcctccaaggagggaaatgatgcccacgggcgccgtcgttgtcgaaccggccaaaagcacggcaaggctttcgccagcatcttcacatcacccacacaagcacccccacatcgatggccgcagaatagtccatgacgtctcacgagcagtcataccttgatcgtaatcaacagcaatggcgggcccttggccaccctcgaaacgccacgtcaagccccattcctgcttcacgccagcacaagccgtcatcccgccaactccacatccgcacattgccgccaatcaacgatgagcgagccagccgaacaggaggctggccgccaacttcacgccagcgagccgccgccgcttgccggagctcacacgcagccgccccg

SEQ ID NO: 111 - DNA, 1796 bp, Triticum aestivum
gccgaagcactggtcctccgacccgccggcaaccagtccatatcccctaccgcctaccgcacgtcacttgaccagccagccgccccactccaccctccactgcggcacgcgctcccggcgatgtcgtggctcgcgcgctccattgcggccaccctctcctccgcccccgacgacgacgaagacgaccactccgaggcagcctccggcgacaaaagcccggatcacgccgccagcgccgacgccgaggaggacgagcagccggacacccccggccgtggggtcaagggcgacatctccgagctgaccgagtctctcacccgacgcttctggggcgtcgcctccttcctcgcgccaccgccgccggccggggccgaggccgccgagacgtcgacggcggcggctgaggcggaggcggagggagagtatgggccccagtccccgcgggtcgccgggatccggaacgacctggctgagatcgggggcagggtgaggagcggcatctcgatgctgtccaacgccaacgccgtggcggagatctccaagatcgcctcgtcgttcctgcctttcgtgccggaggaagaggaggaggaggtggatgcggtgggcgtgacggaggaggtggtggtgttcgtcaggcacatctcgacctctcccgagacgtggctcgatttccccctcttcgtcaacgaccggcacgccgatgattttgaactgtcagatacacaatatgaacatgcattggctatagagcgtatagtaccaagcttatcatatctcagaaccgaactttgttcgaccaatatgagtgaagcatgcttttggaagatctattttgtgcttcttcactcaaagctcaacaaggaagatgctgaacttctttcaacgacacaaatcctggaagcaagagaagagttattgcagagctccccaaggatgaaaaatgtagcgtctgagggtcctgggggctcatcagaaagcagcaatgttctatctacccaagctgaagatatagagttgtcaccctcaagcatccaagacaagagtggaatggctgaagcaacatctttccaagaaccaactcctgatcctctgccaggggctgaggctgacaagcatcccatttcaaccagcgagccggaaattattgacaagtctgtaattgaagaagagctggtggtgaaaactgaaatcaagaatccgggtgacaaacccaacctgtacaccccggaggatgacgacgacaaagaagtggaggattggctagaggacatggaccatgccgacaacaaaacaggcaatatcacctcggttgggcaggacgaagacgtgtcattcagtgacctggaggatgacgatgatgattaagggttgcctggtggtatataccaagcccagtgcctgatacatatgctgcggcttcaagacatacgctcgctgttaaacgaaggatcgtgtctcagtagctactacaaagcgaacaacgcggaagcagaatcacgacaagttgataagtgtgtgtctccggggttttgctttcttgattctagttgaacgtttacttgtgtgccgtcatggtctgtacatagaaacagtagccgcacgtcacttgtaagctgtgttgatgcaagattctgaatgtagatgctaaaaacatgtttatttttctagtgaacgcaaactacgatacggactaaagctgtcagatatcgtgtaactggtcaagttcaagtaaactcgttttgtttccgtattctactttctttgagtttgaggagcaggctgcttttactctaacc

SEQ ID NO: 112 - DNA, 3212 bp, Setaria italica
ccccaatggaggcctccgcttctgccccagcggtgctcctcccgctgctggccgccccgccgcgcttcctccacctccctctgcgccgcccctccacccgccgccacggctgcggaagtgggttcctgctccagccgccgccgctaggccccggctcccgcgcccgctgtaggacaacctgttgcgcgtcgggcccggaccatgcggacgtgctgctgggcggggcctcgctggtcagcgtcgcggcggtcaccctcctcgctgccctgcagctggtgtggttacggtggcgcagcgcgatgcacggggattccccggaggttttacatgaacatggcaaaagcattgtaaataaagtccttggtgcatcaaaaacaatgtatgacagcaactgtgcagcacagacaactcatgatagtgggcttccagagcttggcgtttctggaagaatgactgttgatacacaggcttgttctgtaattagtcctttggcacctccggttacatcagcagatatttctggaccagaagttatttgctcaactgcaactgcaaattgttccatcgaaaaggttacaagtgttcctgtgatgccagattctgtatcagaaggacaagataaaaccaagtatttgtctaacagtacgggccgggtagctgggctaccttatcaatttttatccctttcaggacatcaggaagtgatgcaaaatagccaaggtcatactggtaagcaaatggatgcctcggatgctaatttagttggatgcaatcagagtgatcaagaggaacatcttgattttacatctctttcgtccttcaaaagaatagcagaatgtcatctcggttttgttcccctggccagcaaccgcaatttgttcaaaccaaggaaatggattgaattcaccaactcaaatgcagggagctcttattccccagcaggtcagttttctccagttgcatgcttaagggaagaccctgtgagtaaacaagagaaagctgtgaaggaccatgatgattcaccagtcacaggctttagcatttccaatatactaaacaaggagaatccagataatttcactcaagcaaagagagggggactgaagggcacgaaggatacattagattactcaaggatatacaatagtttcttaattgatggaaggttgaaggactgtgtggacttgttagaaagcatggagcaaaatggattgcttgatatgaagaagattcaccatgccagctttttcagtatgtgtaagaagcaaaaggctgtcttggaagctgttcgcttctgcactttgattgacaacccgaaaataagtaccttcaatatgcttttgtccgtgtgtgctaattcacaagattttgatggagcactccaagttatggagctcctaaaggaagctgggctaaaacctgattgtaaactttacacaacactgatatcaacttgtgcgaagtgtggaaaagttgatgccatgtttgaggtcttccatgagatggtcagtgctggtatagagccaaatgtcaacacatacagtgcattaattgatggctgtgctagagctgggcaagtggcaaaagcatttggtgcttatgggattatgagttcaaagaaggtgaagccagatcgagttgtcttcaatgctttgatcagtgcatgcggtgaatctggtgctgtggctcgggcgtttgatgttttatcagaaatgatggcagaatcttcggaatcaaaaggatccggaccaatacttcctgatcatgttactgttggagcgctgatgaaaacatgtattcaggcaggccaggctgatcaagctcgtgaggtgtacaaaatgcttcaggagtacaatataaagggtaccccagaagtttacacaatcgcattgagaagctgtagcttgactggtgatttagggtttgcactgaagatatatgaagatatgaacaagattggagtaaaacctgatgagatgttcttgagtgctctagttgatgtagctggccatgctaggagggcggatgccgcgtttgaaataatgaaagatgcaagagcaaaaggattacacgtgggaacaattgcctacagttcattaatgggtgcttgctgcaatgcaaaggactggaagaaggcactgcagctatacgaggagattaagtctatcaaattaaccccaactgtttcaatgatgaatgctttgatcacctctctgtgtgatggtgatcaggtcctaaaggctgttgatgtccttaatgagatgaaaggaataggaatctgtccaaatgagataacctattctgtcttatttgttgcttgcgaaagaaacggtgaagcacaactaggtttggatttgtttgaacaattaaaaatagatggcattggcatcaatcctaccattattggttctctgactggtttatgtctacaaatgtttgacagtgatctctcgcttgggaatattattgtcaacttcagcttagggaaaccacaaattgacaacaaatggacttcctcagcaattatggtgtatcgtgaggcagtttcaactgggctagtaccttcaagtgatgttttatctcaagtgttgggatgtttgaggcttcctcatgacaattcgctgaagagtagtttcattgaaaacatgggaataagttgtgatattccacataatccaaatattaattcactctttgaaggattcggtgaatatgacatccgtgctttttcgatgctggaggaggctgcttcattaggtgcagtttcaagtatttccatgaaagataccaggattgttattgatgcaagaaagttaaagatctacagtgccgaggtttctcttcttacaacattgagatctttgaagcatcgactcgctgcaggtgcaagattaccaaacgtgacaatcttgttacccacagaaaagaaacaggttgacattgatgaaagagaaaaaacactaaagctatctggaagaattggtcaagcaatcggttctctcctgaggcgattaggaatttcataccagggggaggagtcgcacgggaggatgaggatcaatggcctcaccttaaggagatggttcaatccaaagttgaatagcaaatcctccagtgccgcgccagctgatttgcttcccctatcgtcgcgtttagcaaaagggattgctgatcagcaacgcgacatcagaagcctttcgctcgagtagtag

SEQ ID NO: 113 - DNA, 578 bp, Sorghum bicolor
actcttctcgcctccgattctccggagattcgtcatcagaatggcggtggcggcggcggctcgtgccgggttccggcggctattctccgtgtcggcgttcgctgcaccacctccacccgctgcgcgccccgcggcggagccctgcaacaacctcttcgtctcagggttaaataaacgcacaacatccaatggacttaaggaagcattttcgaaatttggtcaggttattgaagcaagagtaatcactgatagaatatctggatactccagaggatttggctttgtcaaatatgcgactgtacaagaagctggtgaggccataaaaggcatggatggaaagttccttgatggttgggttattttcgccgagtatgcaaagcaaagagaagccacacagccgtcacaacaaggagcaccatatgaatactctagctaatgattgaagttgccatgcacagtcgattacatacactgtattcctttttttctgccgagagtgtaatattggatgttgcttgccatccaaaaatttacagagagaatgtagcttgctgtgctccacttgaactgcctttgtt

SEQ ID NO: 114 - DNA, 1350 bp, Sorghum bicolor
accgcctccccgccccctcaccggagcagagcagcgcgagggagcgcgggacagaggccagccatgggcaaggaaggggccagcgccggcggcggcggcggcgacggcggcatgtcggagtcggtgatccgcaaggtcctgatctcgtacatgtacgtggcggtgtggatcttcctctccttctccgtgatcgtctacaacaagtacatcctcgaccccaagatgtacaactggcccttccccatctccctcaccatggtgcacatggccttctgctcctccctcgccgtcgcgctcgtccgcgtcctccgcgtcgtcgacctcccgtcctcccccgccatgacgtcgcagctctacgtctcatccgtcgtccccatcggcgcgctctactcgctctcgctctggttctccaactccgcctacatctacctctccgtctccttcatccagatgctcaaggcgctcatgcccgtcgccgtctactccatcggggtgctcttcaagaaggagaccttcaagtcctccgccatgctcaacatgctctccatctccttcggcgtcgccattgccgcctacggcgaggcccgcttcgacgcccgtggcgttgccctgcagctcgccgccgtcgccttcgaggccacgcgcctcgtcctcatccagatcctcctcacctccaagggcatctccctcaaccccatcacctcgctctactacgtcgcgccctgctgcctcgccttcctcgtcgtgccctgggtcttcgtcgagttgcccaaactgcgcgaagtcggcagcttccagccggacctcttcgtcttcggcaccaactcgctctgcgccttcgcgctcaacctcgccgtcttcctgctcgtcggcaagacgtccgctctcacaatgaacgtcgccggcgtcgtcaaggactggctgctcatcgccttctcctggtccgtcatccgcgacaccgtcacccccatcaacctcttcggctacgggatcgccttcctcggggtgggctactacaaccacgtcaagctgcaggcgctcaaggccaaggaggcacagaagaaggcggcgcaggccgacgaggaggccggctcgctgctgcaggagcgcgactcgcacggcgaccgcaagactgacacccaggcctagcgagtgtgatggatctcatgatccaaccgccctcgccctcattcggtcggttctgaacccagcccccctgcctagtgtactccaaatgtgtgatccatccaacccttacaagtttgatgcgaaatttgttcatttcttgtctttgacttgatctggtggtagcaaggcaaataagcacgggaaagatgcaagctttgtgtc

SEQ ID NO: 115 - DNA, 1436 bp, Arabidopsis thaliana
aaaggatccttggagacgctctttctctttcatagagagagagtgagaaagttctgatacggcggcttctcactgtcatctagctgtaccactgacgataaatctctctcttcctctaaatcgttaacttatacttgcagattctcgcgttgatagtaaaaagatggtgaagcttttggagctgttcataacttcatcaaaaccagtcgttgagattctgttgataacatcagtcggattttatatggctctcgatggagtcaatcttcttggtcatgatgctcgtaaatatctgaacaacattgtcttctatgtgtttagtccttcgcttattggaagccgtttagctgatagtgttacatacgaaagcttggtcaaaatgtggttcatgccggtgaatgttctgcttacattcatcattggttcattacttggctggattgttattgtcatcactaagcctccttcacaccttcgtggtctcattcttggttgttgtgctgctgggaatttggggaatatgccactgattataatcccagctgtttgtaaagaaaaaggaggtccctttggagatcctgagagttgccagaaatatggaatgggttatgttgctctctccatggctatgggatctatttacatatggacttatgtatacaatcttatgcgtgtgctatcgaactctcccgttgaaacccctccctctgttgaatccaactacgacagctacaaagttccccttatttcttccaaggaagaagaaaacaaccaaaaggctgggaggtgggaaaaagtcaagcggagattggtttcactgtcacaaaaagtcaaccttaagacaatttttgctccatcaactattgctgcgatgattgcacttgtgatcgggctcattactcctttaaggaagctaataatcggcacggaagctcctctccgggtgcttcaagactcagtaactctagtgggagatggggcagttcctgcaatgaccatgattataggaggaaacctactcaaaggtttgaggagttcaggaatgaaaatgtccagtattatcggcgtcttggttgcgcgttacgttttactgcctatgagcggtgttttaatcgtaagaggagcatataagttggatttagttacatcagagcccttataccaattcgttcttcttcttcaatatgctgtcccaccagccatgaatctaggtacaattactcagttatttggaactggggagagtgaatgctcagtgattatgctctggacttactctttggcttcgattgcactcactgtttggccaacattcttcatgtggcttgtagcttagaatagacccccatactcatcatgttacatgtattgttttgttccattgattcaagaattgttcttggacttccagatgattggatcaagttagggtacct

SEQ ID NO: 116 - DNA, 1311 bp, Arabidopsis thaliana
tcactatccgagatttgggttgaaaaatacaaacccccttttatttctcctcttctctcctacatgctcattcagaactctcaacatttccggtagagaaaaaaaaaccgttttttttttaatctctttctaaagaaggatatcaaaacaaaacacaaagttgaaaactttgcatctgggtttgtctattttagattcagatcttagtttttttcgattgaatatctacaatggtaatggaaacagagtcaaagttccatgttttagctgttgatgatagtctttttgatcggaaaatgattgagagattgcttcaaaagtcttcatgtcaagtaactacagttgattcaggctctaaagctctggaatttctgggtttaagagtagatgacaacgacccaaatgcactctctacatcgccacaaattcatcaggaagttgaaataaatctaataattacagattactgtatgcctggcatgactggttatgatttgctcaagaaagttaaggaatcagcggcgtttagaagtatacctgtagttataatgtcatctgagaacgttcctgcaagaatctccagatgtttggaagaaggagctgaagagtttttcttgaaaccagtgaagttagctgatcttaccaagttgaaacctcatatgatgaaaacgaagttgaagaaagaaagtgagaaaccagttgccatagaagagattgtggtgtctaaaccggagatagaagaagaagaagaagagtcatcagtgattgaaatcttgcctctccaccaagaaattgaatccgaacaacttgaaccaatgttgagtagtaataagagaaaagcaatggaagaagtggtttctactgatcgatcacgtcctaaatacaatgatatcacaacctcggtctgaaggaggactaacgcaacccgagaagccactacaagacctatatggagaatgccaacagaatctctcagtagaagatctgctaactcttgcatctgaagcaaacaacaacggactgcaaggaggactaacgcaacccgagaagccactacaagacctatatggagaatgccaacagaatctctcagtagaagatctgctaactcttgaatatgaagcaaacaacaacggactgctaggagtaataccgcagcaacatcgttatcatcaggaaaaagagacaatgcagacacaaggagatccactaaatcgaatacctattcaatcagaagcttcaaaccattcagatagtggtgatagcacactaacaatggctcaaaaccaggatggtctcggacacagtagt

SEQ ID NO: 117 - DNA, 1913 bp, Arabidopsis thaliana
ttcatatggatttgaacgagagtgttgttcacttttctcgtggcaatggtattgcaaagcttgacaatttcggcgatactgctcttagcttgaaatgtcttggaagcagtgcagggagattgattgggagctctcaccataaccataagctttgttctgatgtttctaattgtcctgatggtggttgccggttggttctcggtttgggtccaacaccgccttcgtattattacaatgtcagggtcaatgataataacaacaaaggctctgcttcttctgggagtgttcaggaactctcatcaggaggtaactcaatcctgcaacttggtcctcctgctgtgaccatggatactttcagcggacttgagggttctctgttgacatatgcggatactaatgtgtcccaagctgctgttgatgagggttctacctcagcaaggcgatcaggtggctatatgccatcgcttcttttcgctccaaggacggagaatgttagaaaaccttcaaggatgcaagagtgtagtactaattgtggaactgatgcttataattcacagctgagccatgagtcagagttctctgtaagcgctttctctgacaggtcggcctctgccacgtcttctcagcaaaggatgagcaacccgaagaagtgcaagtttatgggatgtgttaaaggagctagaggagcttcggggctctgcattggccatggaggtggccagagatgccaaaagctaggttgcaacaaaggtgctgagagcaaaactactttctgcaaagcccatggcggaggaaagagatgccaacacttgggatgcacaaagagtgctgaaggcaaaaccgatctctgcatatcacatggtggtggaagacggtgtggattccctgagggatgtgctaaggctgcacgtggcaaatctgggctctgcatcaagcacggtggtggtaaaaggtgtaggattgaaagctgtacacgaagtgctgagggacaagctggactctgtatttcccacggtggtggacggcgttgtcagtcttcaggctgtacaaaaggtgctcaaggaagtacaaactactgcaaagctcatggtggtgggaaacgctgcatatttgcgggatgtacaaaaggagcggaaggtagtactccgctttgtaaagcacatggtggaggaaaacgctgtatgtttgatggtggtggtatttgtcctaagagtgtgcatggtgggacgagtttctgtgtagctcacggtggtgggaagagatgtgttgtggccgggtgcactaagagcgctcgtgggaggactgattgttgcgtgaagcacggtggtgggaaacggtgtaagtctgatggttgtgagaagagtgcgcaaggtagcactgatttctgtaaggcacatggtggtgggaaacgttgctcatggggaggagactggaaatgcgagaaattcgctagaggaaagagcggtttatgcgctgcgcataacagtatgtcacaagataaagctggaagcaaggttggtttgattggaccgggacttttccgtggccttgtctctacttctttacaaaccacaacaactgcaactactactactactaccactgatcattctcaatctggagtcagtgcggtctctgattgcatggactccattgatcgcccgctgccaccgttgcatcatcaacccgagaaaagacagaagctgatgataccaatgcaggttcttgtgcctccatcaatgaaatccttaagcttctcaaacaccgagagacccgatatcgaaacaaacaacaatagtagtggcagcaatgggaggaacatatttgactttatgattcctgaggaaagagttcatggtggcgggcttatgtctctgcttaatggtaacatgaaacaaacactccgttgatga

SEQ ID NO: 118 - DNA, 1461 bp, Hordeum vulgare
cgttcttcttcttcgagtttgttatcagccatgggtaaggagaagactcacatcaacatcgtggtcattggccacgtcgactctggcaagtcgaccaccactggccacttgatctacaagcttggtggcattgacaagcgtgtgatcgagaggttcgagaaggaagccgctgagatgaacaagaggtcattcaagtacgcgtgggtgcttgacaagctcaaggctgagcgtgagagaggtatcaccatcgatattgccctctggaagttcgagaccaccaagtactactgcaccgtcattgatgcccctggtcaccgtgacttcatcaagaacatgatcacgggtacctcccaggctgactgtgctgttctcatcattgactccaccactggtggttttgaggctggtatctccaaggatggccagacacgcgagcacgctctccttgctttcactcttggagtgaagcagatgatctgctgctgcaacaagatggacgccaccactcccaagtactcgaaggcacgttatgaagaaattgttaaggaggtctcttcctacctgaagaaggtcggctacaaccctgacaaggttcccttcgtccccatctctgggtttgagggtgacaacatgattgagaggtccaccaaccttgactggtacaagggcccaaccctgcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtgacctttggtcccactggtctgacaactgaggtcaagtccgttgagatgcaccatgagtctctcctggaggcgcttcccggtgacaacgtcggcttcaacgtcaagaacgttgctgtgaaggatctgaagcgtgggtttgttgcatccaactccaaggatgaccctgccaaggaggcagccaacttcacctcccaggtcatcatcatgaaccaccctggtcagattggcaacggctacgctccagtgctggactgccacacctcacacattgctgtcaagtttgctgagctggtgaccaagatcgacaggcgatcaggtaaggagctggaggccctgcccaagttcctcaagaatggtgatgctggtatagtgaagatgattcccaccaagcccatggttgtggagacctttgccacttaccctcctcttggtcgttttgctgtccgtgacatgaggcaaactgtggctgttggtgtcatcaagggcgtggagaagaaggaccccaccggagccaaggtgaccaaggctgccatcaagaagaaatagaggcgtttacctgaatccatctatgtcttgcttttgagatctctctagtagtttagtaagttttgctactgttagcgccgtgtgata

SEQ ID NO: 119 - DNA, 608 bp, Hordeum vulgare
gagcgatgtcggcggcggcggcgccggcgccgatcggcctgtcgtgggcgccccagctgccttccctggcggcggccggcggcagcaagaagggctcggcgccgaccccgagcattgacgcgcaggattccctctggaagccccgcaacgagctcgtggacgggctctacgtgcccccgagggaccccaggaaggtcaacaagatggcgaggaagaacgtcaaggacaccgccggcaagggctggttcgacatgccggcgccgagcatcactcccgagttgaagaaagaccttgagattttgcagctgaggcatgtaatggaccctaaaaggcatttcaagaggtctggtaaatccaaggctcttccgaagtatttccaagttggaacagttattgagcctgcatctgagtactactcaagtaggctgacaaagcacgaacggaagcagaccttggttgatgagctgttatctgaccaaaaactcaagaactacaggatgcgtaaggtaagggaaattcaggaggcccggacgcccggaggtaaccagaagtggaagaacaagggcaagcaaacgttcaaaagggccaaggacaggcggaaatagtag

SEQ ID NO: 120 - DNA, 838 bp, Hordeum vulgare
tctccgttctccaagtctcaacccctctccgaggttggtggcggccggcgggcgaagcagatcagatccgcggcttttcggcgcaggggcgaggccctccccggagcttcggccatccgattccgcagcccgcctctgcgatggtctctggctgctgctgctgctgactgtggtgatgaattcgaggccgatcgtgctcgtcttcctcctgctcgtgctcatcatatcatcgcagtttgagtggaagcagcagatcggcgaggccgaggcgagcccggatgctacgcggcgcaggcagccagcgctggtcgtaagggaagacgccgttaaagagaaaataatactggcgcaggagaagaacatccaacaactcaccgagctcatccagagcctccaggtgcagctactgcattgccgtggcagcaacaacactgctcagggcgcctcctcgactcagtcttcatccagttacaccgaagcggacagacatcagataatcgatgactgatcgcccatcagcatgcccaggtcgtttgcgtcagcagacggcgatcaaggacatgctcctgaatggatatggaagacaccgtcgtcacggaccactatgtagttagggtcctggtctcctggagtctagggagctgtcttagtgtactgatgtgccttgctattgacagcactatgaccaccgccttcaccctcggctgtatagggttatattgtaactgtatcatgtaaatttagcccaccttcctcattgagattgagattgtactcatacagattcctgccgcgatcatcatcgattctttccttccatcttctacgaacatctgca

SEQ ID NO: 121 - DNA, 2110 bp, Hordeum vulgare
tttgtggcatccggcaccacacgctggctagcgggtcccgaccgtcggcctctcgccgcccgcgtcgcatctgcaaccccgcactgcccatctatccatgctcctccgcctcctctcgtcctcctctcgcgccatcgcaacaaaacctcacccaccgcaaaccttagccgctgctgcagctggcgccaccacctcaaccacccggaagctggcagccatggcaggtaaccgggaggcgttccgcgtggtggtggcgaacacgctcgagcggcgcctcttctacgtaccgtccttcaagatctacggaggcgtcgcggggctctatgactacgggccgccagggtgcgccgtcaaggccaacgtactcgcctcctggcgccagcatttcgtgttggaggaagggatgcttgaggtggactgtccatgtgtgacaccagaaattgtcttgaaggcctctggccatgttgagaagtttacggacttgatggttaaagatgaaaagacgggcaactgttatcgtgctgatcacttactcaaggacttctgtaaggagaagctcgagcaagacactacattgtcaccagagaaggtagaagaattaaaccatattcttgctgtcttggatgatctgtcagcagaacaattaggtgctaagattaaggagtatgggattgttgctcccgacacaaagaatcctttgtcagatccatacccctttaatctcatgtttcagacttccattggaccatcaggtttgagcgcagggtatatgaggccagagacagcacagggtatctttgtggacttcaaagacttgtattactacaatggcaacaagttacccttcgctgcagcacaaattggccaggctttccgcaacgagatatctccccgtcaaggccttctaagagtccgtgaatttacattggcggagattgagcactttgtggacccagaggacaagtctcatccaaagtttagtgatgtttctgatctagagttcctgatgtttccgagagaagatcaactgacaggaggatccgccacaagacttcagctcggtgaagctgtttctgagggaactgtgaacaatgagacccttggctacttcattggaagggtctatctcttcttgacacagcttgggattgacaaagaccgtctacgattccggcagcatctgccaaatgaaatggctcactatgctgctgattgttgggatgcagagatcgaatgctcttatgggtggatcgagtgtgttggaattgctgataggtcagcgtatgacttgcgtgcccactcggataaaagtggtgttccactcgaagctcatgagaaattcgcagaacccagagaagtggagaagttagttataaccccatcaaagaaggagcttggtcttgctttcaaagggaaccagaaggcggtgctcgaagcattggaagccatgggtgaaactgaagctctgggtatgaaagcagctttagagtctaaaggggaggttgagtttaaggtctgtacccttgggagggatgttaccgtaaagaggaatatggtttcaattaacatggagaagaaaaaggaacatcaaaggaagttcactccatctgtcatagagccatcatttggcatagggagaattatttactgcttgttcgaacattgcttctatcaaaggactggcaggacagatgatgagcagttgaatgtttttcgtttcccccctcttgttgctccaatcaagtgtaccgtgtttccactggtcaaggttgagaaatttgatattgtcgccaagaaaatttcaaaagctttgacaacagcagggatttctcacattatcgacatcacaggcactacaatcggtaagcggtatgcaaggacagacgaaatcggcgtccccttggcgatcacagtcgactcaactacaagcgtgactatccgtgacagggacagcaaggatcaaattcgtattgaggtcgacgaggtggcttcggttgtgaaggaagtgaccgatgggcagagcacctgggcagacatcatgtggagatacccagcacacaccaccttggccaccgatgaggaagaagcttcagaaacctgaagggtatga

SEQ ID NO: 122 - DNA, 1529 bp, Hordeum vulgare
caccaacgaaccagccacagcccttccgcgcgtccccggcggcggtcagaccacaagccgccgccatgccgccggcctccacctcgccgtccaccgccccggcggccaccaagccgcccccgcgccaccccctggggctggacaccctcgcctccaccagccggtccctcttcgccgcgggccggcggtccccggtcaccacgctcgtctgcgccatcgccctcctcgcgctcatcatgtacggcgaggacgcgcgcaccatcgccgagctctccatcgacgactacctctacccggacgccgacatctacaacgtctccggccttgcccccatcgcgctgcccccgcccacctgcgacctagcccacggccgctgggtcttcgacaacgaatccctccccctctaccgggagaaagagtgcaccttcctcaccaagcaggtcacctgcctcgccaacggccgcaacgacgatacatggcagtactggcaatggcagcccaacaactgttccctccccacgttcgacgccaggaggttcatggagaggatgagggggaagcggctcatgttcgtgggggactcgctgaacaggaaccagtgggagtcgctggtgtgcatggtgcagtccatcctgagcaaagggaggaagaagatagtcaaacggggatcgctcaccatcttccacgccaaggagtaccgcgccactctcgaattctactgggcgccattccttgtcgagtccaactccgacaaccccaagatccacagcatcgagcaccggatcatacggcctgagaggatcgaggggcacgcccagtattggagggatgtggactacctcatcttcaacacctacatctggtggatgaacaccgccgacatgaaagttcggagaccagatacaaggtattggtcagagcacgacgaggtgccgaggatcgaggcctatggccgggtgctcaaaacatggtccgactggctgaacgagaatatcgatccggcgcggacatccgtgttcttcatgacaatttctcctcttcacatcagcccagataaatgggggaacccccacgggatcaagtgcgcgaaggagacgctcccggtactcaattacacggagcccctggacctcaaccacgacatgcggatgtacgatctggtggcgagcacggccaggtccatgaagaaagtgccggtcacgctcatcgacatcaccaggatgtcggactaccggaaggacgcccacacgtccgtctactccgtccggcagggctacctgctgaccgcgaagcagaagaacgacccggagaagtttgccgactgcatccactggtgccttcccggcgtgcccgacgtctggaacacggtgctctacaccaggatcttctcgaaatcagccccttcttcgccgccggccatcgccctcccgcctccccagtgagagagacgcggagctcctccataggaaatgttattcttgttcaatctttttttttctttctttggtggtagtctgggtaaaggctag

SEQ ID NO: 123 - DNA, 2636 bp, Hordeum vulgare
gctcgctctccactagtagtattaacccctaatccacctagtaataatccccggccggccatggcgtcctccctcacgccgcgcagccaattccagaagaaggagaacctggggaacgcgcggagggggatgggctacaacgcgccgccgcgacgcaacgtgctctcggccatcaacaacggcggcggcgccaacgccgacccggcgccctccgaggccggctccgaggcgcccgccttcgagttcagcgggagggacgacgtggaccgcctgctcaacgagaagatgaagggcaagtccaagaacgactacaaggggaggacggagcagatgagcgagtacatcaagaggctcagggcctgcatccgctggctggtggagctggaagacggctacttggccgagcaggagaagctccgggggcagattgattcagacaatgctcgtcacgcggagtttgaggctcagctcagtggcgcgcttgaagagttgaaagctgcaaacttggagatgacaacacggtgcgactcactggaggagagcctgaacaaggagaaggccgccaggctgcttgctgtggaatcctatgagaaggaaagagaagaaagggaatcagccgaggcttcacgggatgtactgacggtcgatcttgaaagggtcactcatgaggcaaagcggtttagtgagcagctaaaaatggtccaagacaccaacaaaagacttcaggaatacaactccagcttgcagcaatacaacagtaatcttcaagctgatacatctaagaatggagaaatcatctcgaagctgcaaagggagaagagtgcaatgatggaagccatgactaatctgaaagatctcaacaactcaatgaagaaccagttggattcatccatgtcctcccagaaagaagcaattagagtgaaagaagaacttagaaaagaagtagagtgcctcagagctgatttacaacaagttagagaagatcgtgatcagtctgttgctcaactgaataccttgaccgctgaactggccacttacagcgaacaggctagaaagtcttcaaaagactctgaacttttgcaaataaaagcggcagcctttgaggaaacatgcagttcacagcaagagcaaattgaaacattgcagaagcagcttgcagttgcaaccgagaagttgaagcatgctgatgtgactgcaattgaggcgatgacaggatatgaaacgcagaaagtgacaattaaagatctggaagagcgtttggcacatgcagagtttcaaatcattgaagctgacaagctacgaaagaagctgcataacaccatcttggaactaaaaggcaatatcagagtattttgtagggttcgaccctttttatcggacactgattctaatggtcaggaagaagccattatttcttatccatcatctgtggaaaatgctgggcgtggtatagatttaatgaatcaaggccagagatgttctttttcatatgacaaggttttcgatcacagcgcttcgcaagatgatgtgtttgtggaaatgtcacagctagttcaaagtgcgcttgacggatacaaggtatgcatatttgcatatggtcagacagggtcaggtaaaacttatacaatgatgggtaagccaggccgtgatcagaaaggtatcatacctcgatctttggagcaaattttcaagaccagtcagtctctagaaacccagggatggaagtattgtatgcaggcatcaatgttggaaatatacaatgagacaattcgtgacttgttagcgccaggccgctccagcagtgagatgcctggcggtaaacaatacacaataaagcatgattcccagggaaacacaacggtctccgatcttactactacaaatgtgttcagcactgctgatgtgacgtctcttctagagaaagcatcccatagcaggtctgtaggtaagacccaaatgaacgagcaatcttcccggagtcattttgtctttacactaaagatatttggatcaaatgagagcacaggccaacaagtacaaggtgtactgaacttgattgatttggccgggagtgagcgtcttactaaaagtggtgcaacaggcgatcgcttgaaggaaactcaggccatcaacaaaagcctgtcagctctcagcgatgttatctttgcgattgcgaagaacgacgaccacgtacccttcaggaactcgaagctcacgtacctcttgcagccttgccttggcggggactccaagacgctcatgtttgtcaacgtctcgcccgaggcgacctcggccggggagacgctctgttccctgaggttcgcgtcgagggtgaacgcatgcgagatcggggtggcgagacggcagacgcagtccaagtcctcatcatcggataacagtaacaggctgagctacgggtgaactctgccctgtctgtcaatggccatcgtggcctgatgctgatgtgatactgctacataacgagctaagctagctagcggctctgtgggccgacttggccacgagtgtgctgtgctggcgacgcggagcggctggcctctggcattagtaacaatgtacagtcagtagggagagtggcagagcatgcgctgtggcattgagagcaggagagaact

SEQ ID NO: 124 - DNA, 1595 bp, Hordeum vulgare
agcagatggatgccgcggcggagatggacgccggcgagctggaagccgtgttccgtgcggcggccgacttcgcctcctacccaggagtgcatggcgaggacgcagtgaggcagttcctggagcagttccctcttcatgacctgctaggtgcgttgcagagtcagggagccgagcctgagacggttgaaactgttgcagcttgcttggacaaagtattttcgtccagatatggagcttcacttctgcccagctatgctgcatttattgaagctgggttgctcacaaacctaaacaatatcagacaactggcctgcaaagcggtggtacatcttcttgacaaggctgaagatagtgatgttgccgtggacacatttgtacagcacaatctgtaccctcttctgatcaactgcttgattgagggagacgaagagatctcagcaattgttttggatgccataaagcgtctagcagaaattcctaaagggaccgatatcatatttccaccagatgggcaaggattgcaactcaacaaagtggcagcccagtcatcctcaatggcacgaattcgcattctatctttgatagctaagctctttgccgcatcaagttgtactgctactgcaattcgtgactcaaaccttctcagcttatttgaggacgagataaaagatagaaaagacatgcttaaaaccctgagtgcactagaggtcctctatgagcttgcggagcaccctcacagcaacatgttcttgttaaagaccagtttgcttcaacacataactgatgtgattaacgatccctcagctgattctattgtacggtcaagggcatcattgatcagtgggaggcttcttgcttcagctgacgcttttatgaccatagaacaatcttgtgttacgaacctgctcttggccatagacaaaatattgaggacggaggaaagtcaaaatactgatgaaattgagagcgcattggagaccttaggtctaattggtacaacaagtcaaggagcatgcttgttgttctctgatccaccaaatgttgctaaacatgtggtagaaatgtcctttgataggcagggcagagggaaacagctggccgctttacatgcatttggaagcatatgtggtgttgatcgagaagaagaccagatgaaactggatgattatcaagcagaagagtgcctgaagcgtttagtctacagtgcagcatcaaacagtccaaaattaactccttcagctcttcttctctcaattctacaacaagatccagacgttcggattgctggttacagagtactatcaggactggttgtccgagaatggtgcctaagggaagtttgctcaaagccagagataatcggagttgttacggatccaaaaatggagacaacaaaacttggcatggaggcacggtatgcttgctgtgttgcaatcaacaaggccttggcatcgtcgcaccttcttcatgagccgagcctttctgaactcattggaaagctgaacgaggcagttagaaggggtccctatctttcccagaagaagccgcgcgtggaggcacagccggtggttggtaccatggagaggttttaataa

SEQ ID NO: 125 - DNA, 843 bp, Hordeum vulgare
ctacgttgagccaggaccaggacccacccagctctggtcacggggagcgcgcgtctgcgggcgggcgggcggccggagcgagcggggatggggaactgccaggcggctgaggtggcggcggcggtggtgcagcacccgggcgggcgggtggagcggctctactggtccgcccccgcggcggaggtgatgcgcgcgaacccgggccactacgtcgcgctcgtcacgctccgggtcgccgaggagcgccaggacgccggcgcccgccgcaccgtgcgcctcacccgcgtcaagctcctcaagcccaaggagacgctcctcctcggccacgtctaccgcctcatcaccgccaacgaggtgaccaaggccgtgcaggcgaggaaggaggagaagctgaggaaggcgcggcagcagctccagcagctggagtcttcgacgcggcagagcaaactgcggccggcggccgacggtgacgacgatgacgacgacgacgaggccagcttggatgagagtctcgatcagttggcgcggcaggacggaggagacggccaccggagctccggcgcccggcaccggcaatggcggccctcgctgcacagcatcgacgaggccgcgagctgatgcccggccatacgtgcacagccctcggtggatcttctgtattttcggcgtccaccggggcttcgacagattaatctagctcgtgttcatgggttgttgccgcccacgtctgcgttggatcgacaccccgaggcgagcgggccgcttctgaagcgactccgtcgatcggagcgtgtcctgtgtcgtctgtacatcttcagcgtttctcgtcaggatctgttatag

SEQ ID NO: 126 - DNA, 470 bp, Hordeum vulgare
attccatggccaacagcaacctcccgcgccggatcatcaaggagacgcagcggctgctcagcgagccagcgccggggatcagcgcctcgccgtccgaggagaacatgcgctacttcaatgtcatggtccttggccccgcgcagtcgccctacgaaggtggagtcttcaagcttgaacttttcttacccgaggaatatccgatggctgctcctaaagttaggtttctgacaaaaatataccaccccaacattgacaagcttggtagaatatgcctcgacatcctgaaggacaagtggagtccagctcttcagatacgcactgttcttttgagcattcaggcactgctgagcgctccaaacccagatgatcctctctcagagaatgtcgcaaaacactggaaatccaatgaagctgaagctgttgagacagcgaaggaatggactcgtatgtacgccagtggtgcatgatga

SEQ ID NO: 127 - DNA, 458 bp, Hordeum vulgare
ccaccatggcagccgttctcactcgcccgacgcctggcaccgtccagtgcttcggccggaagaagaccgctgtcgccgtggcctactgcaagcccggtcgcggcctcatcaaggtcaacggcgcgcccatcgagctcatccgccccgagatgctccgcctcaaggccttcgagcctatcctgctcgccgggaggtcgcgcttcaaggacatcgacatgcgcatccgcgtccgcggcggcgggaagacgagccagatctactccatccgtcaggccatcgccaagtcgctcgtcgcctactaccagaagtacgtcgatgaggccgccaagaaggaggtgaaggagatcttcggccgctacgaccggacgcttctcgtcgccgacccccgccgctgcgagcccaagaagttcggcggtcgtggcgcccgtgctcgtttccagaagtcttaccgttgatga

SEQ ID NO: 128 - DNA, 2673 bp, Hordeum vulgare
caaggaactatattcccagcttgacattcaaaaccagccaagatggtgaagtttaccgcggaggagctccgcggaattatggacaagaaaaataatattcgtaacatgtctgttattgctcatgtcgaccacggcaagtctacgcttacggattcccttgtggcagctgctgggattatcgcccaggaagttgctggggatgttcgcatgaccgatacccgtgcagatgaggcagagcgtggtattacaatcaaatccacgggtatctctcttttctatcagatgactcctgaatcacttgagatgtacaagggtgaccgggatggggatgaatacctgatcaaccttattgattcacctggccacgttgacttttcttcggaagtcacagctgctcttcgtatcactgatggtgccttggttgttgttgactgtattgagggtgtctgtgtgcagaccgaaactgtgctgcgccaagctcttggtgagaggattaggcctgttcttactgtgaacaagatggacagatgctttctcgagcttcagtttgaaggtgaggaagcataccagactttctcccgtgtcattgaaaatgccaatgtcatcatggcaacatatgaagatgtgctccttggtgatgtccaagtgtacccagagaaggggactgttgcattctctgctggtttgcatgggtgggctttcacccttacaaactttgctaagatgtatgcctccaagtttggagttgatgaggtgaagatgatggagaggctgtggggtgagaacttctttgacccagccacaaagaaatggacctccaagaacactgggacagctacctgcaagagaggatttgttcagttctgctacgagccaatcaagcaaatcatagccacctgcatgaatgaccagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatctttcatctcccctctccttcaaaggcacagaggtaccgtgtggagaacttatacgagggtccccttgatgacatatatgcaaatgctatcagaaactgtgaccctgatggtcctcttatgctgtatgtctccaagatgattccagcatctgacaagggtagattctttgcctttggacgtgtctttgctgggagggtcgcaactggcatgaaggtccgtatcatgggtcccaactttgttcctggccagaagaaggatctatatgtgaagagtgtccagcggactgttatctggatgggaaagaagcaagagtctgttgaggatgttccctgtggtaacactgttgctttggttggtttggatcagttcatcacgaagaatgcaaccctgacaaacgagaaggaagttgatgcctgcccaatcagggcaatgaagttctccgtgtcccctgttgtgcgtgttgctgtccagtgcaagacggcttctgatcttcctaagcttgtagagggtttgaagcgtctggcaaagtctgatcctatggttctctgtaccattgaagagtctggtgagcatatcattgctggagctggagagcttcaccttgaaatctgcttgaaggatctgcaggatgacttcatgggtggtgctgaaattattgtttcccctcctgtcgtctccttccgtgagactgttcttgagaagtcctgccgtacagttatgagcaagtcccccaacaagcacaaccgtctttacatggaagctcgcccattggaggagggattggctgaggctatcgatgatggccgcattggcccacgtgatgatcccaaggtgcgctccaagatcctatctgaggagtttggttgggacaaggatctcgccaagaagatttggtgctttggacctgagacgactggcccgaacatggttgttgacatgtgtaagggagtgcagtacctgaatgaaatcaaggactctgttgtggctgggttccagtgggcgtcaaaggaaggagcattatgtgaggagaacatgcgtggcatttgctacgaggtctgtgatgtggttctccacaccgatgctattcacaggggtggtggtcaggtcatcccaacggcgagaagggtcatttacgcttctcagctcactgccaagccaaggctgctggagcctgtgtacctggttgagatccaggcgccggagaatgcgcttggtggtatctatggtgtgctgaatcagaagagaggacacgtgtttgaggagatgcagaggcaaggtaccccactctacaacatcaaggcctacctgcctgtcatcgagtccttcgggttctcgagcaccctcagggctgcgacgtccggccaggccttcccccagtgtgtgtttgatcactgggacatcatggcttctgatcctttggaccccggcacccagtctgcgacgcttgtgacggagatccgcaagaggaagggtctcaaggagcagatgactcccctatccgatttcgaggacaagctctaaattttgggtaatgttttgctacttgcccttgctgtgaagggagccgcattattttctcccgatgtgtatcttgctgtttgtatgtggtgctacctgtag

SEQ ID NO: 129 - DNA, 1418 bp, Hordeum vulgare
gcgagatggactgcaaggatgtcgggatcctcgccatggacatgtacttccctcccacctgcgtccagcaggaagcgctggaggttcatgacggggccagcaaggggaagtacacaattggtcttgggcaagactgcatggccttctgcagcgaggtagaagatgtcatctcgatgagtttgacagttgtcaaatccctgctggaaaagtaccacatagatccaaagctaattggccgcctggaggtcggtagcgagacagtgatagacaaaagtaaatccatcaaaacgtggctgatgcaaatttttgaggaaagtggtaatactgacattgagggagttgactcgagtaacgcatgttatggtgggacagctgccctgttgaactgtgtgaattgggtcgaaagtcgatgctgggatggacgctacggccttgtggtctgcacagatagcgcggtttatgcagagggaccagctcggcctacgggtggagctgctgcaattgctatgcttattggtccaaatgcacctatttcttttgaaagtaaatatagagcttctcacatggctcatgtttacgatttctataagcctgatcttgcaagtgaatacccggttgttgatgggaaactatctcaaacgtgctaccttatggctctggattcgtgctatagacagtattgtgccaagtatgagaagctagtgggagaacaattctcgatttctgacgcagattattgtgtgtttcattctccatataataagcttgtacagaagagttttgctcgactttactttaacgatttcatgcgcaattgcagttcggttgataatgatgctaaagaaaagcttcagccttttgcaaacctgactagtgaagaaagctaccaaagtcgtgacttggaaaagggctctcaacaactggcaaagcatttgtatgacatcaaagttcaaccgtcaacgttgcttccaaaacaaattggtaacatgtatactgcatctctgtatgctgcattggcatctgtaatctacaacaagcatgctagtctgaatggccaaagaattgtcatgttttcttacggcagtggcttgacatccactatgttttcattcaaactaaatgagggtcagcatccctttagtttaacaaatattgcttctgtgcttgatgtggcggcaaagcttgagtcaagacatgtgacttcacctgagaagttcatcgacacactgaagctgatggagcaccgatatggagcaaaagattttgaaacaagcaaagacataagcttgttgccaccaggaacgttctaccttacaaaagttgattcaatgtacaggaggttctatgaaaagaaaaccgatggcattgttgacggcaaaatcaagtgcagcaatggcattgcaaatggccactagtag

SEQ ID NO: 130 - DNA, 761 bp, Hordeum vulgare
aaaggatccctgggtcgtttcctccatccattccgcctcaacatggctcttcaggtgtggatggtcggggagaacggcgaggacctcaacaaccacagggagctcctgcctctctccaagctccaagagattggcgtgttatattggcatttggacccaaagaagtccgaaagtgaacaagagctagcgaaaatccgcaaagacaggggatacagctacatggattatctggatatatgccctggaaagttggcaaactttgaggagaagctcaagaatttcttcacagagcacatgcatgccgacgaagagatccgctactgcttggaaggcggcgggtattttgatgtgcgcgacaaggatgacaagtgggttcggatctggataaaagaaggggatatgatcgtgctgccggctggaatttatcatcggttcaccctcgacgccgccaaccatgtgaagctcatgaggctcttcctcggagaaccagtgtggaccgcccacaaccggcctcaggaggaccatccggtgcggcaagagtatgtcaagaggctcacggacgacaatgctggtcatgctttggcagcacattgaagttggtttgtgatccctcgtctatgtattataaacgcccatggacatatacatacacttgaacgaaaccatgttgtaatcttgaaaccaaatagatacgctacctacttgttattattcacttgtaattgcccgtgtgttgctacgagggcataagtgaattcttt

SEQ ID NO: 131 - DNA, 1214 bp, Hordeum vulgare
ccgcaatgcagagcgcggcggccatcgggctcatccggccatgcgccgcgcggcccatcctcaagagccccagccccggggccgcccgcctcccggcctcccgcgtggccctccggctctccgccgcggcgccccgcgcgcgcctcgtggccgcggcggggctcggccgcatcgggctcgtgccggcgtcgcccgagcaggagaagaggagcggcggcctcgtggccgccgcggccgccgggaaggcggcgccgggcgaggaggccggggaggaaagcggagcggcgctcgccaagacgctccagctcggcgtcttcttcgggctctggtacctcttcaacatctacttcaacatctacaacaaacaggtcctcaaggtttttccttatcccattaacatcacaactgttcagtttgctgtgggaactacgatttccttgtttatgtgggccacgggtatccttaaaagaccaaagatttccggtgcacagcttcttgctatcctccctctggctattgtgcataccatgggcaatcttttcaccaacatgagccttgggaaggttgcagtgtcattcacacatacaatcaaggccatggagcctttcttctcagttctactttctgcaatgttccttggcgagctgcctactccttgggttgttttgtctcttcttcctattgttggtggtgtggcattggcatctatttctgaagcttcttttaactgggctggatttttgagtgcaatggcttcaaatgtgaccttccagtcaaggaatgtcctcagcaagaagcttatgctgaagaaagaggcatctctggacaacatcaatctcttctcgattattacagtcatgtcattcttcctcttagcccctgtaaccttgttgacagaaggtgtcaaggtcactcctacttttctgcagtctgctggtctgaacctacagcaagtgtacacaaggtctttgattgcggcattctgtttccatgcataccaacaggtgtcatacatgatcctcgcaagggtgtcaccagttacccactcggtaggtaactgtgtcaagcgtgtggtggtcattgttacatccgttctgttcttcaagacccccgtgtctccaatcaactctatcggaaccgcgatcgctcttgcgggagttttcctgtactcacaactgaagagacttcagcccaagcccaaggctgcttgatga

SEQ ID NO: 132 - DNA, 423 bp, Hordeum vulgare
cgcagcaagatggtgaagggacgcaccggccagcgcgtgaggctctacgtccgcggcaccatcctcggatacaagaggtccaagtcgaaccagtacgagacggcgtcgctggtgcagatcgagggggtgaacaccagggaggacgtggcctggtacggcggcaagaggatggcctacgtctacaaggccaagaccaagagcaacggcacccactaccgctgcatctggggcaaagtctcccgcccccacggcaacaccggcgtcgtccgcgccaagttcacctccaacctgcccgccgaggccatggggaaaaaggtcagggtcttcatgtacccgagcagcatctaaaaggttattttcaagtgtggaggatttcactcgtcccttaggttttcatttcgagtcttgtaagatggattcagg

SEQ ID NO: 133 - DNA, 389 bp, Hordeum vulgare
cggagatgcagcagggcgatggcacggaggcgcaggtgacgtgggatgaccagcagaacatcaaccggttcggccgcctcaacaaccgcctccacgagctcgccgacgagatcaggctcgccaaggaagcaaatgaaaaccttgaggatgcggggaatgaactcatcttgtctgatgaagatgtggtgcgtttccaaattggggaagtgtttgcccacatgccagtggacgatgtggaaactaggctagagcagatgaaagaggatgcggctaagaagttagagaagctggaggaagagaaggaatccatccttgcccagatggccgaactgaagaagatcctctacgggaaatttggagaggccatcaacctggaggaagattgatga

SEQ ID NO: 134 - DNA, 1945 bp, Hordeum vulgare
gatctgaaggccgtcacccgccgcccgcccgccggaaagctcgacgggaatggagcggatcctcaagtccgccagggagtccggctccctcaacctctccaaccgcgccctcagcgatgtgcctggggaggtgtacaacaacttggacactggcagcttggacgacaaatggtgggagggagtggaccttcagaagctcatactggcccataacaacctcgaagtcttgagagaagacctgagaaatctctcttctctcgtcgtgttaaacataagccacaaccagatatcttccctccccgcagccattggagaccttcctttgttgaaatcgctggatgcctcgttcaatcaaataaaacttatacctgaagaagttggcttggctagtgctttagtcaaggctgacttctcaaataattgcctcactgagctgccagctagccttggcagatgcttgaacttgtcagaactcaaggcatcgaacaacaacatatccagattgccagatgagcttgctggctgttgcaagctaagtaaatttgatatggagggaaacaagcttgtgctacttccagaaaatatgttcacatcatggacactgctcacagagctgaatgccgcaaaaaatcaacttacgaccattccggctagtatcggagcactttcaaagttagttcgaatggatctgcaccagaacaagataacttcgattccttcttccataaagggctgctcttctctagctgagttctacatgggaaataattcgttgtcgacaataccagctgatattggcatgctatcaaaattaggaacacttgatcttcactccaatcagctgaaggagtatcctgtgggagcttgcaaactcaagctcagttttcttgatctgtcaaacaacgcattatccggcctgccacccgaactaggtacaatgacaaccctaagaaagcttctgcttagcggaaatcctatgagagcacttcgtagttctttggtttctggaccaacgtcaacattgatgaagtatctgcgaagccgcctttcgtctgatgaagaagcatcagggtctagaaccaccccaacaaaagatgaccagatttctgcagcaagacgattatctgcatcttcaaaggagttgaatttgagtggtcttggtgtgcccaatgtaccccctgcagcttgggagacaagtgatgtggtgaaacttgatctttctaagaacttgatagaagatctgccaaatgagttgtccctgtgctcatcacttcaagctttgattctgtctaataacaagataaaaaagtggcctagcatggttgtttcctcccttcccagtctcacttccttgaagctggacaataatcctctagcagcgatatcgtccactgatctcgagtctctatcaaaacttgaagttcttgatttaagtggcaatgcatcctcattgactgaaccttctgtgatttcttcattaccacaactgcatgaactctatcttaggcgaatgaaactccaggaatttcctattgggctcttccagttaaaacatctacggattcttagcctcagtcagaatcatctcacaaccatacctgagggtatcaaagattttagtgctctcgtcgagcttgatctttcagacaacaatataacagcgctcccagccgagctgggtctgcttgagcctagcctgcaagtgctcaaacttgacggaaatccccttaggagcataaggcggactgttctggagcgaggaacgaaagctgttctcagctatctcaaagaaaagcttccatccaactgaataatatcatcatatattctggctggagttattcccttggtttcccccctgccgtgttgaataagtttcctgtggttgaagtgtactgaattgtcttgtgtgtgcgcacgcaagagaaagatgggttgccatatg

SEQ ID NO: 135 - DNA, 558 bp, Hordeum vulgare
aaaggatccctgctcaaatcctccacaaatccattaaccatgggctccctgacaagcagcagcaccggccggaaaagcaccgtggagagtgtcgacccggaggcggcgtgcgcgctgctggcctcggagcagtatgggtacgtggacgtgcgcatgtgggaggacttcgacaagggacacgtcgccggcgcacgcaacgtaccatactacctctccgtcacccctaacggcaaggagcgcaaccctcactttgttgaccaggttgccgcgctccactccaagcaggatcggttactcgtcggctgccgctccggggtccggtcaaggctcgccactacagacctcgtcgccgccgggttcactaatgtgaagaacctggagggcggctacctctccttgctcaagagcgcaagctacccgcagccgacaaccagccacccctgatccatcaattctatatctagaaaaaatactacggtgtattatccatagtattatgaagaagacgacgaagaagcgtcttcagagccgaggaggaattattactaggaattcttt

SEQ ID NO: 136 - DNA, 997 bp, Hordeum vulgare
agtcgcagagaaggcaagcgtccgtcgggctcgagcgagcgagagagagagagagagagggcagcatgagcgagcagggggcggggcagggcagcaaggaggagtcgctgatggacaagatcacggagaagttccacgggtcgtcctcctcctcctcgtcgtcggacgacgaggcggggagggccgccgggtcgtcgtcgtcgtccgtcaaggccaagatctaccgcctcttcggccgcgagaagcccgtccactccgtcctcggcggcggcaagcccgccgacctcttgctgtggaggaacaagaagatctccggcggggtgctcgcgggcgccaccgccatctggctgctgtttgaggtcctggagtaccatctcctcaccctcctctgccacggcttcatcctcaccctgggcatcctcttcctctggtccaacgcctctgccttcgtcaacaagtgccctcccaacattccagaggtgaagatccctgaggacctggcggtcaatgttgcccgctcgctgcgctatgagatcaacaggggctttgctagcctgagggccattggccaaggccgcgacctgaagaaattcctgattgtggttgcaggcctgtggatcctctctgctcttggcagctcctgcaatttcctcaccttgttctacatagtcttcatggtactctacaccgtgcctgtcctgtacgagaagtatgaggacaagattgatgcttttggagagaaggccatggtcgaactgaagaagtactacgccatcttcgatgagaagtgcctgtccaagattcccaagggtccgtccaaggacaagaagcagcattagaacagtagagagtaccctgcgcagatttatcttcaaagttgatcactactcgtcggttttcaaggatggttgtgaacttgtgattccatgtccgtaggtgatagtagataccactatctggtcaaaatcctggcacggtcattagtgtgacgtgcaac

SEQ ID NO: 137 - DNA, 1256 bp, Hordeum vulgare
gatcgatggagggttgtcgtggccggccatggaccaggctaccggcgctgctgctggtggcgctggcctgcgccgccgccgccgccgtgggagagtgtagggtggtgcacgtgggagaggcgcaccggcggagcatgttggctaatggcctcggcgcgacgccccccatggggtggaacagctggaatcacttcgcctgcgacggcaacggcgaggttgtcatcagggagaccgccgatgcgcttgtctccaccgggctcgcagctgccggctacaaatacgtcaatcttgatgattgctgggcagaacctgaacgtgatgcaaagggcaatcttgcggcgaacaagaatacgttcccccacgggatagaggcactcgcggactacgtccacagcaaggggctcaagctcggcatctactccgatgctggatacaagacctgcgccaaggctcaacccggatccctcggctacgaggagcaggacgccaaaacctttgcttcctggggagtggactacctcaagtacgacaactgcaacaacggcgacacgaagccgctggagaggtaccctgagatgagcaaggctctgatgcaggccggccgccccatcttcttcaacctctgcgaatggggcgacatgcacccggcgcggtggggcgcggcgtacggcaacagctggagaaccaccaacgacatcgaggacacctgggacagcatggtgtccagggcggaccagaacgaggtgtgggccgagtacgcgcgccccggcggctggaacgaccccgacatgctggaggtgggcaacggagggatgaccaacgacgagtacatcgtgcacttcagcatctgggcgatctcaaaggcgcctctgatcatcgggtgcgacgtgaggcacatgtcgcaggacacgtacgacatccttgccaacaaggaggtgatcgccgtcaaccaagatcctctcggcgtccaggggaagaaagtgaggatggaggggagcagcgagatctgggctgcgcctctgacggggtacaggacggcggtgctgctgctgaaccggcacgccaaggacgaggcccagatcacggcgcactgggacgacatcggcctccccgccggcaccgccgtcgaggccagggacctctggctgcacaagacgctcgagccaaagttcacagacaagatgagcttcaacgtgacgccgcacgcggccaggatgttcgtgctcacgcctctcaagtctcagctggattaataa

SEQ ID NO: 138 - DNA, 1191 bp, Hordeum vulgare
aaaggatccagccttggaggggatggaacgcttccggttcaggtcacctcccctctcgctcaagctggccttcgccgccgtctccttcgccgccgtctcctgctcctcctcctcccccctcccttcctcggccgcctcctcctctccgcgtccgtctccccgggccgtagccgccgacctcctcgccgtcctcgccggcccgcgcgccgcggcgcgggtgccggccggcgaggcctctcgcctgaactcctgcctccggttcctctccccggtaaatcctgccgccacatctgcggcatacccatggaggggctctcgaaaggtcctactggaaggctgcgatgctgccgaggcggatgcgatggtgatgtggccgccggcgccggtcttggagctggcgcgcatcgccgtcgactccggaggcgaccccggggccatccaccgcttgctcgaccccaccatgctgccggtgcctgatgtcgagggaacgaagaagagcaaatgccacctcacaagaacaccgtatggaagacgctttgctgacgaggacatcaattcatactttgcatttttgtttgaattgattgctgcgcgaggaccatcagttggattaaatgtatcgctgaatcggtatgatttgttccatgggcatcttttcctggcatctggtacaggaagacttgggattctattccatgcgaaagaatatccagcattcgacaagaaatcattcccttacaatttgggatattgccaggctgaatctgatgtaccgtatgatgattccatgaatttacgtaatatcctttggttagctccattgccgtccagcgagacgaaagcttgggcagcaccaggagtgttagtcgtcttggatgcacatccagatggaattatttatcaagatctgatacgcgactatgttcagattgtgcgaacaatatacgaagatgatttcggaaagcatgccgttgatgtcaactatctgaatgttgccaacgcagcagctccagcggatagaattttcatttgctgacatgttttctccaccgtgtggtcaaacaccagtaccaattcttacaggatgtaatcaaggtctgcagtgatttgcgagcaagtctcctgtatagttccgagtgtttatttctgagacggtttcagatgtttatttgattgagggcggaattcttt

SEQ ID NO: 139 - DNA, 608 bp, Hordeum vulgare
cggacatggcggcgaggaacgacaacgagtcggacggcgacgtggggaccaaccccgccgaggggggctcctccctatccctcccgcctcttgccgccggtccagccgtatgcgtcctcaggtccgccggggacttcgccggcggcgccttcgtcggatctatctttggatatggacaaggtttgctaactaagaagggcttcaagggctcactcggcaatgcagggtcttctgccaaaagttttgcggttctatctggtgtccagagtttggttttgtgcttgttgaggaagctgcgtgggaaagatgatattatcaattccggcattgctggttgttgcacaggtcttgctttgagttttccaggtacaccacaagcgctgcttcagaattgcgccaccttcgcagcattctcgtgcatcatggaggggttgaacaagcagcagaccgcgatggcgcacaccctcgctgggaatgccttgacaacctttgcgcacgacaagggcggcgtcctccctcctttcactctccccccgatcctcgacgtgtcagatgctttctcttcgtgctgccaggccttggtcgttaatcctaagaagcactagtag

SEQ ID NO: 140 - DNA, 218 bp, Hordeum vulgare
gccgtatgaagttcgcggggtggtacatgaagatcgccgtcggcggcgcggccataggcgccgccatggagcttttcatgatccacaccggcttctatgagaaggtaacggtactggagtcagagaaacgagcttgggaaagcagtccagaagcacaagctatgagagaagccttgaatccatggcacaagcgtgatgaggaagagaaaaaatagtag

SEQ ID NO: 141 - DNA, 1667 bp, Hordeum vulgare
catagagacgcccaaaccctaccgcgcgcctcgcagctccccgacgccgacacccagcagcagccgccggcgccccccgcccgacgccgacgaggacttctccgcctccgccgccccctcttcgcgtctcgtggtgcccacgctttactgctgatttgttctcagcatgggcaagtccaaagacaagaaggcttcgcgggaggccaaggtcgataagaagctggcgcttgggcttggagtgaagaggaagcagctgaagaagaagaaggacagagttttagatgctgccgttgagagcgagggcgctgccggacatgctatcgtggaagacaaaggaagcaagaaaactgtattgatgaagcaaaagaagaaaactaagcatgccagagtaataagcagtcgttccaaggcggataatttggtgactctcaatgaggatgaggcaacgcctaagctgaagaagaagaacaaaaagcagttaaaggaaagcaaaagtcctatcgaggtacaaagtccgttggatagtaatgatgctggaacaatgaagctgaagaagaagaaaaagaaggcgaaggaagggaagagctctgttgagcccaatgatgcagatgctatccttcatgaaaacctagataaagaaactctaaacactgacgtcaaccaacttgcggcagggagtgaagttagggatattgggaaaccagaaaaggcaaagaaacgaaagaaaaataagacaactgatgtccaccaagttgcggcagagagtgaagttatggatattggggaaccagaaaaggcaaagaaacgaaagaaaaataagacaaagaaagtaaagcaatctggggaagtcaacaagatagatacgcaggtatcagttagagaggacaatttggagatgcatgaagttgacaccgcaaatgttgatgagattgcatcagtcgatgaagactgttccagaggaatgcaaaaatggatcttggagtacagacagaagcggccaggcttgaaagtcttgcagcaaaatatagatgtgtttataactgcacatgaggaacaacaagagcaggagaagaaggaaagagaggcagcagctgcagaagatgggtggacagtggtgatgcatcataaaggtaggaagaagactacagatgctgaaactggaacagcggttggctctgtatctctggctgcaatgcaagagaaaatggctaagaagaaacccaaggaagttggtcggaacttctacagacatcagaaacgagaagctcaaatgagtgagctggcgatgctgcagagcaagttcgagcaggacaagaagaggatacagcagctgcgggcgcaaaggaaattcaagccttacggattctgaaggggttcctccacagaaacgcagcgttcgttcgacattactcgagagcggccagcagctggcgccgaaaggctttgcttggttgcactgtattccttttttgacaggaaatgttgcattgttggacaaatgtactatgcttcttgactgggaatggtgccagtcgtgtacaatggcgtgaacatttgcagcatttcctgtcaaatttttgtgtaccaattcatgtgcggttctttgccgccttgtagaggcgccgaggaagtgaaggtggtcggtgagacagacgcttaggttcctg

SEQ ID NO: 142 - DNA, 1501 bp, Hordeum vulgare
aaaggatcccattctgaattgcacatgaaccagagttttgctacagcttttgttggtaactggtaacaaattacttctatagtaatgtggcgaatataggattaaacattaacacataatatttgtgagagaattgttcctcaatgccaaggcatctttttcttcttcttcttcttgataacacttataattgactgttactgttttcagtatttttcttttagcaggtgattgatttatgttacttatggacatttcctacaggatattcagagcacgacagagttgcagatgtcaccccaaggtactaatgaagtgcaaagtaaccaaccaaacacaatgggcagtgatgctcctgcaggagattctggttctttggtagtcgctaacagtgataacagaaaagtctcccgcgaagacattgaacttgtccaaaatttgatagagcgctgtctgcagctgtacatgaccaaaggagaggttgttaggacactttctactcgtgcgagaatagaacctggctttacaactttagtatggcagaaactcgaagaagagaactctgaattctttcgggcttactatataagattgaaattgaaaagacagattgtgttgttcaaccatttattgcagcaccagtataatttgatgaaatatccagcacctccgaatgttccgctggctcccatgcaaaatggaatgcatcctatgccagttaacaatctaccgatggggtatccagtacttcagcaacctctgatgcctgctcccggccagcctcacattgatccgatggtttgtggtctatccagtggtcatgtagtgaatggaatccctgcaccaggtggttatcatccaatgcgcatgaactctggaaatgacatggttgtggacaacggtgcacctgaagctgcacatgctggtgctatgtcatctgatatggctgtgagtccctcatcagcagcatcaaccaaccatgctcctttcactccatctgagataccagggatggacatggatacatcagccctggattcaccatttggatctgacatggggaacacaggacctctgcaattaggggcagatgggtcgtcaagggattccatccgatccttagggcagctctggaatttcagcctctctgatcttacagcagatttgacaagtttaggagacttggaggctcttgagaattacgcgggtacccctttcctgccttcggactcggatctcttacttgattccccagaccatgatgacataggcaaccatgatgacatagttgagtactttgccgacgccatcaacgggtctcagtcggatgaagagaagccatagagagcagactcaagtagtcccattgagacttgcacctggttagagcgtctatctcatgtagtgtgatcttggagccgcggcataccgcggtgatatcagactgggtattcgcacagaggtgtggtagttcggtgcgtcactaaagaataggcctttt

SEQ ID NO: 143 - DNA, 2398 bp, Hordeum vulgare
gcaagatgtaatctgggtctcgtctcacaccctgtggccatctcagtacactctccgactccttcgtgtttccgaggggaagtgaagtgaagtgaatccctttttcggggtcccgaggaaatggaggagagcttcgtgcccctccgaggcatcaagaacgacctccgtgggcggctcacctgctacaagcaggactggaccggaggcttcagtgccggtataaggatcctagcgccaaccacctacatattcttcgcgtccgcgatacccgtgatatcgttcggggagcaattggagaggagcaccgatggagtgctcacagcagtgcagacactggcatccaccgccctgtgcggcataatccactccgttgtaggagggcagcccctgctgatcctcggcgttgccgagccgacggtgatcatgtacacattcatgttcagctttgccaaggacagggccgacctcggtcccaacctcttcctcgcctgggccggttgggtctgcgtctggactgccgtcttgctgttcttgctggcggtgctaggcgcgtgctccataataaaccggttcacccgcatcgccggcgagctgttcgggctcctcatcgcaatgctcttcatgcagcaagctatcaaggggcttgttgacgagttccgcattcctgagagggagaacataaaagcactacagtttgttccatcatggaggtttgccaacggaatgttcgctatcgtgttgtcatttggccttttgctcaccgcgctgcggagcaggaaagcgcgatcctggcgctatggggcaggttggctgcgtggcttcatcgctgactacggcgttccactgatggtgctggtgtggactggagtttcctacataccacatgatagtgtgccgaaaggaatcccgcggcgcctcttcagtcctaatccatggtcccctggtgcatatgacaattggacagtcatccaggatatgcccaatgtgccactcatgtacatcattggtgccttcatgcctgcaacaatgattgctgtcctgtactactttgatcacagcgtagcgtcccagcttgcccagcaggcagagttcaacttgaggaaacctccatctttccactatgatttgcttctcctaggcttcctgacattgctatgtggcctaattggtatccctccatccaatggcgtcattccacagtcgccgatgcatacaaagagcttggctactctaaagcatcagatactccgtaaccgactagtggccacggcacggcaaagcatgcgccagaatgctagcttgagccaactgtacaacagcatgcaggacgcttatcatcagattcagacaccgctgatccaccagcaacagtccgtcaaaggcttaaacgagcttaaggactccactgtccagttagcatcaagcatgggtaacttcgatgcaccggttgacgagacaatctttgacatagagaaagagattgatgatctgctgcctatggaggtcaaggagcaaaggttgagcaactttctacaggctgtgatggttgggggctgtattgccgctatgccgctgcttaagaagatccccacggctgtcctctggggctattttgccttcatggcaattgagagcttgccaggtaaccagttctgggaacggatattgctgctcttcactgctcccagcagaagatacaaggtgctagaagagtaccacacaacatttgtcgagaccgtgccattcaagacgatagccatgttcacacttttccagacaacatatctgcttgtttgctttgggatcacatggatcccgatagctggggttcttttccccctcatgatcatgctcctggttccagtcaggcagtatatcctcccaaagctcttcaaaggtgcacatctcaatgacctggacgcagcggagtatgaggaatcaccggctataccattcaaccttgctacgcaagatattgatgttgcattgggacacacccagagcgcagagatccttgatgacatggtcaccagaagtcgcggtgagatcaagcgcctgaatagtccgaagatcaccagctcaggtggcactcctgtcacagaactgaaaggcatccgcagtccttgtatttctgagaaggcctacagccctcgcatcaccgagctgaggcatgaacgcagccctctaggggggcgagacagtccacggacgggagaggcccgaccatccaagctcggtgaaggctcaacaccaaagtgaagcagtgatgctgcattgcacatataagctatggcgctgctggaaataaattatatcgataactcgagcatcagtctaatataagatgtctactgatgcggtatgatgccactatatgatggccagtgatgaagtatga

SEQ ID NO: 144 - DNA, 2576 bp, Hordeum vulgare
ccagactcctcacagcttctccccgtgcccgagcggagatcccgagttccggacgccgacgtcgggtggtaggattcggcggccatgtcgtcgggcgccgtgctggtcgccatagcggcgtccatcgggaacctgctgcaggggtgggataatgcgaccattgcaggtgccgtcctgtacataaagaaggagttcagcctggagacccagcccttgatcgagggcctcatcgtggccatgtcgctcatcggagcgacggttatcacgacgttctccggggcggtggctgacgctgttggtaggcggcccctgctgatcgcctcgtctgtcctctactttgtcagtggcctggtgatgctctgggcgcccaacgtctatgtgttgctcttggccaggctcatcgacgggttcggtatcggtttggcagtcacccttgtccctctgtacatttcggagaccgccccgactgacattagagggctgctgaacacgctgccgcagttcagtgggtcaggagggatgttcctttcttactgcatggtgtttaccatgtccctcatgccgcagcctgactggagaatcatgcttggggttttgtcgatcccgtcgcttatgtattttgcattgactgtcttttatttgcccgagtcgcccagatggcttgtgagcaagggaagaatggctgaggccaagcgagtattgcaaagactgcggggaagggaagatgtctcaggagagatggcccttcttgttgaaggattgggtgttggaaaagacacacattttgaggaatacataattggacctgatgatgagctggctgatgacgggctggctccagatcaagagaagttgaaactctatggagctgaagaaggggtatcttggatcgcccgtcctgttaggggtggcggccaaagtgcacttggaagcgctttgggcctcatgtctcgtcatgggagtatggttagtcagggtaaatctcttgttgacccccttgtcactctcttcggaagtgtccatgagaagatgcctgaggtaatggggagcatgcggagcaccttgtttcctaactttggcagcatgtttagtgtggctgaacagcagcaggctaaagctgactgggatgctgagagtcatagggatgatgaagattatgcatcggatcatggtgctgatgacattgaggataacctcaatagcccgcttatttctcgtcaagcgacaagcgtggagggtaaggagattgctgcacctcatggaagcataatgggtggtgtggaaagaagtagtagcatgcagggaggggacgcagtaagcagcatgggcattggtggggggtggcagttagcttggaagtggactgagagagaaggtgcagatgggcaaaaagaaggtggcttccagcgtatttacttgcatgaggagggtgtgtcaggtgatcggagaggctctatattgtctatgccaggaggtgatattcctcctggtggtgagtatatccaggcagccgctctagtgagccaacctgctctttactcgaaggacctgatagagcagcagcttgctggtccagccatggtacatccatccgaggcagttgccaagggtacaaagtgggcagaactatttgaacctggagtgaagcatgcactgtttgttggcattggattacagatcctgcagcagtttgcgggtatcaacggagtcctgtattacacgcctcagatacttgagcaagcaggtgttgggattcttctatcaaacattggactaagctcttcctctgcatctattcttattagtgccttgacaaccttgctgatgcttcccagcattggcatcgccatgagactcatggatatgtcaggaagaaggtttcttctcctctcaacaatccctgtcttgatagtggcactagctatcttggttttggtgaatgttctggatgtgggaaccatggtgcacgccgctctctcaacgatcagtgtcatagtctacttctgcttcttcgtcatgggttttggacctatcccgaatattctctgcgcggagattttccccacctccgtccgtggcatctgcattgccatctgcgcactaaccttctggattggtgacatcatcgtgacatacactcttcccgtgatgctcaacgccatcggactcgctggagttttcggaatatatgctgtcgtttgcatgatagccttcgtattcgtctacatgaaggtccctgagacaaagggcatgcccctggaggtcatcaccgagttcttctcggtcggggcgaagcagggcaaggaagccacagactagttgctctgatccggtgatccgcgtcgctggtggtaattttgtgttgtcataactactactacactggttaacctgcgatgctttggttaagaaacttcaaagggagcagatacgaaagactttacatcgtgaggctgaatcgtgtcgtcgtaggccggcttttggaagtaggatatgtacttagatcatctgttcttttcgccttggaactttgtatttgtgttattcagaatttcttgcccatgtaactagtgctg

SEQ ID NO: 145 - DNA, 2184 bp, Hordeum vulgare
cagttcgacgctctctttctctaacaatggcatccgccgcgacggcgccgccggcggggaagcggccggcgacgggcggccgggagggcgaccagatggtggtcacgccgctcggcgccggcagcgaggtcggccgctcctgcgtccacatgaccttcaagggccgcaccgtcctcttcgactgcggcatccacccggcctactccggcatggcggcgctgccctatttcgacgagatcgacccctccgccatcgacgtcctgctcgtcacccacttccacctggaccacgccgcctcgctgccctacttcctggagaagacaacgtttaagggccgcgtgttcatgacccacgccaccaaggctatttacaggttgctgctgtcggattacgtcaaagtgagcaaggtttccgtcgaggacatgctgtttgacgagcaggacatcatccgttcaatggacaaaatcgaggtcatagacttccaccagacattggaagttaatggcatacgcttctggtgctatactgctggccatgtgcttggtgctgccatgttcatggtggatattgctggtgttcgcattctttacactggtgactactcccgtgaagaagaccgacaccttaaagctgctgagataccccagttctcccctgatatttgcatcatcgaatcaacttatggtgtgcagcaacaccaaccccgccatgtcagagagaagcgcttcactgatgccattcacaacactgtttctcaagggggtcgtgttcttatcccagcgtttgctcttggtagagcacaggagctgttgcttatcctggatgagtattggtctaaccacccagagcttcacaagattccaatctattatgcctcccctcttgccaagaagtgcatggctgtgtaccagacatacataaactccatgaatgaaagaatccgaaaccagtttgcgcagtccaatcccttccatttcaagcatattgaccctttgaatagcatagacaacttccatgatgtgggtccgtcagtggtgatggcaagtccaggtagcctccaaagtggcctctccagacagctctttgacaagtggtgcacagataagaagaacacatgtgttattccaggttatgctgtcgaaggctcgcttgcaaagacaatcatcaatgagccaagagaagtgacactagcaaacgggctcactgctcctcttaacatgcagatcttctacatctccttctcagctcacgctgatttcccacagacgagcggcttcttgggtgagctttgtccacccaacattattcttgtacacggggaagcaaatgagatgggtaggcttaagcagaaacttatcactcagtttgatgggacaaacacaaaaatcgtgtctccgaagaactgccaatcagtggagatgtattttagttctgagaaaatggccaagacaattggcagactggccgagaaggtaccggaagtgggcgactcagtcagtggcttgctcgtgaagaagggcttcacttaccagatcatggcccctgaagatctccgggtgtacacacaactttctactgccaacataactcagcggattgctgtcccatattctggttcttttgaggtgatcaagtacaggctgaagcaaatatacgagagcgtggaatcatcaaccgaagaagatgttccaacactcactgttcacgagagagtggccatccgcctggattcagagagctacgtgacactgcagtggtcctctgatcccataagcgacatggtgtccgactcggtggtggccatgatcttgaacattgggcgtgagggtccaaaggttgttccaattgaagaagcagtgaagacggaagaagaaacggagagggtggggcggaaggtcgtgtatgccctcatggtgtcgctcttcggcgacgttaaagttgcagaggaagggaagctcatcataactgtggatggagacgccgcacacttggatgggaggagcggtgatgtcgagtgcgcgaacgccgggctgaaagaaaggatcaagaccgcgtttcgtcgcatacagggtgcggtgagaccgatcctgctctcggcctcctgagctgaagccatgagagtgcctttaactttccctagggctcgcgattaagcaaagtaggagtttgtgttaggcgcgttat

SEQ ID NO: 146 - DNA, 2033 bp, Hordeum vulgare
acggcatggctcggcatgccgtcctgctcgtggtcaccgtcgccgtgctcctcgcgcgccgagccgccgccgagtacccgtggccagtctgcggcagcaccggcagcttcgccgccaacgacagcacgtacctggcgagcatcggcgccatcgccgccaccctcccgagcaacgcctcggcgtccccgggcggcctctacgccacggcgcgggccggccaggtccgcgccctcgggctctgccgcggcgacgccaacgccaccgcctgctccggctgcctcgcccagggattccaggacctgcccagcgcctgcgcctacagcaaggaggccaccatgtactacgacccctgcttcctccactactccagcctcgactcgcgcgcctccgacgacaccgcgtcgggctcggccttcagcaccgcctacagcgacaacgccacggcggagccggcccggttcgaccgcgtcgtggcggcgctcctcaacgccaccgcggactacgccgcgcacaactcctcggcgacgcggctgtatgcgtccggtgtggtcgccttcgaccgggagatccccgaggtgtacagctgggcgcagtgcacgccggacctcacgccggcgcggtgccgggattgcctcgccaacatgatccagcagttggggacgccgttgtacagcgtcggggcgagggttcttgggatcaggtgcagcgtccggtacgagaacaggcccttccttgatggcccggtaatgctgcgcctaccagcaactggagatcccgcgccgtcgcctaccacagcaccggcgccggcgccggatgtggtgcccaatgttgtgacgccggtggcggcggtcggaagagggagaaagtacagtgttcctggtatggtccttatggttgtgctgccaagtctagcagccgcaaactttatcgccggcttatttatctggaggaggaggcggcggtcaccagcacaagcaaatcaaccatatcccagttactccacggaaggtaaggacactgagagtgtagactcgatgctgatggacatttcaactctgcgagctgccactggggacttcgcggaaagcaacaagcttggccaaggaggctttggtgcggtgtacaagggtactctaccagatggcgaagagatagcggtgaagagattatccaagagctcgacgcagggggtggaggagctcaagaacgagctcgccctcgtcgcaaagctcaagcacaagaatctcgtcaggcttgtcggtgtgtgcctggagcagcaggagcgactgctcgtctacgagttcgtccccaaccggagcctcgaccagatcctattcgacactgagaaaggggagcagcttgactggggaatgaggcacaggatcatacgcgggatcgctcgaggcctgcagtacctccacgaagactcccagctcaaggtcgtccatcgtgatctcaaagccagcaacgtccttcttgacgcggacatgaacccgaagatctcggactttggcctcgcgaggctcttcgggagaggccagacgcagggcgtcaccaaccgtgtcattggcacatacggatacatggcgccggagtacttgatgcgcgggaactactccgtgaaatcggatgtgttcagcttcggggtaatggttctggagatcgttacaggaaggaagaacagtgacactttgcaatctcaagatctcttgaccatggtctgggagcattggtcggaccgaacggtgttggagatgatggacccgtgtatgaacaatggcttcttagagagcgacgcgaggaggtgcgtccagatagggctgttgtgcgtccaggagaacccggtggataggccgatgatgtctgcggtgggcatgatgcttggaagcgacacggtgtctctcggtgccccgtcaaagccaacgtctacattttacactaggaacgctagtgccgactctggaaatgggttcaatgtctcgactatttcagtgaatgatggccccaaggatcattctactacgacttaataa

SEQ ID NO: 147 - DNA, 903 bp, Hordeum vulgare
gctggcctatccatggcgggggcggaggcggtggagcgggcgcacgagctctaccggggcggccgccaccgggaggcgctggagctctactcggcggcgctggcggccgcccggggccacgcgcagcgcatcgccctgcacagcaaccgcgccgcctgctacctcaagctccacgacttctacaaggccgcagaagagtgcacatctgtcctcgagttggacaccgagcatgctggagctctcatgctacgtgcccagactcttgtcactctaaaggattaccagtccgctctatttgatgtaaaccggctaattgagataaatccatcctctgaagtatatcggaaccttcatgcgcgactgaagacacagctgtcactagccccgatcccagagtctgatgaggagtccctgtatactgaagaagacaaagaagatctgccaccaaaagacaatacgaagaatgagactgcccttgttaagtctgatcaaccttctgcaaaactgattcctgaaaataaacctgtaacaaaagctctgaaggttgaagtccttcccaatctacattcaaaacctgagggtaccatacaaaaaccaaagggccattcagagcttgattacaaggaacctttaacggaagctccgaaggttcaagtgtctcccagtctgtacaaggaacctttaacagaagctcggaaggttcaagtgtctcccagtttgccttcaaaatctgagtgttgggggaccatccaaaaaccaaagggccattcagggcttgattactcgaaatgggacaaagttgagaatgattcgagtgaagatgacgatgatgatgaagaagatgacttgcctcgatataaattcaaagtcagaaccatcggtgtgcgtaccgtgaagtgatga

SEQ ID NO: 148 - DNA, 2484 bp, Hordeum vulgare
tcgtaccagggacagggtagcggtgccgttcttggagcgctgttcccgggcagctgcttgaggccagccgtcccgtcagggtgctgttcgccggcggcgaggcaatggggagcggccgcgtctgctacgttgtcgcgtccgtcgtgttgctctggctgggcgtggccactgcgcagggtgactctccttggaagacgctcagcggcaatgctccggcgatcatagccaagggtggattttcaggcttattccccgactctagcgaattcgcttaccagttcgcgatgattgcgagctcgcccgatacagtcctgtactgtgatgtccggctcacaaaggatggccttggcgtctgcctaccagacattaagatggacaactgcaccaacattccagatttctatcctaagggtaagaagagctaccttgtcaatggcgtatcgacaacggggtggttctccgtggactacaacggcaccgagctatcgcaagtgtctttgaagcaagcaatcttctctcgcacgcctaggtttgatccaagcttctttccattgctcgctgtcgaagatgtggcgtccaagtttaagcctcctggaatgtggctcaatatccagcatgacgatttctacagccagttcaatatgagcatgaggaaatacatcctttctgtgtctagacgtgtcatcgttgactacatctcatcgcctgaagcaagcttcctcaccagcattagtggaaggattagcaacaacacaaagctcgtgttccgctttcttgacgaggccactcttgaaccatctaccaaagacacatatggttccatgttgaaaaatcttacatttatcaagacatttgcatctgggatacttgtcccgaagaagtacgtctggcctgtttcaccagataattatctgcaaatgtacacttcgatcgtcgatgatgctcataaagtggggctggaaatttatgctgctgattttgccaacgactttgcgctcagttacaaccatagctacgatccgttagctgaatctctatcgttcattgataatggtgcattttctgttgatggcatattgactgatttccctgtcacgccttcagaagccattggctgttttgcgaatttgaacaaaagcaacacagctcatgggaaacctctaattatttctcacaatggtgctagtggagattacccaggctgcactgatctagcttatcagaaagcagtcgatgatggtgcagatgtcattgattgccctgtgcaagtaaccaaagacggcataccagtatgcatgggatccattaacttgatggatggtactactgttgcaaaatcaccatttgcgtcccagacagcagtaatgaaagatattgagagtgtcctaggagtctttactttcaacctcacttgggatgacatcgtgaagaatctaaaacccaagatatctaccccacttagcaccttcagtttggacagaaatccaaggtacaggaatgcaggaaatttcatgaggttatcagactttctggacttctcaaaagataaggatttatcaggaatcatgattagcatagagcatgctgcttttctggcagcggaactcggatttgacatggtagatgcagttatcaaagcgcttgacgattcgggctacaacaaacaaactgctcagaaagttatgattcagtcaaccaacagctcggtactggtgaagttcaagcagcaaacgaagtacgaccttgtgtacatgatcaatgaagatgtcagcgatgccgcgccttcctccctcgcgggcattaaaaagtttgccgatgccgtttctgtcgaaaccagctctgttttccccgaaaaccgccatttcacttcgcaccagacagaccttgtcgagtccttgcagaccgccgggctctcggtctacgcctacaatctcatgaatgagtttgtttctcagccgtacgacttcttctcggatgcgaccgcgcagatcattgcctatgttcagggtgccggagtggatgggctgatcaccgacttcccggcgaccgcccggagatacaaatcgaacacttgcatgaacatggggaacaaaaccccaagcttcatggcccctcctcgtcctggtgatctgctgcagctcatcagtaagccggcacaaccaccggcgctagccccgatgccgcttctattggattctgacgtgtcggagccgcccctaccgcctgcaagatcgaacactgctactacagctccagcaccttcgtctgcacgcaggacgcagactggtatcccattcctcgtcaccttggcaatgctttgcgcctgggccgcgatctgaggtggcaatgccacatgtcagtatggcacgctagaggtctgccggtctactaatccaatgttgtcttctccttcggtgattcatttgttcttgtaacttttgcgttgcggggttatatccgggatgcccctataacactccctag

SEQ ID NO: 149 - DNA, 665 bp, Hordeum vulgare
gactgatggagtgggcgtgctgcggcagcggctactcgtcgtcgggaacgcagtccccggcggccggcgacggggaggagggctcgtacatgacggtgtcgtcggcgccgcccaagcggcgggccgggaggaccaaggtcagggagacgaggcacccggtgtacaagggggtgcgcagcaggaaccccgggcggtgggtctgcgaggtgcgcgagccgcaagggaagcagaggctatggctcggcaccttcgacaccgccgagatggcggcgcgcgcgcacgacgtcgccgccatggcgctccgcggccgcgccgcgtgcctcaacttcgcggactcgccgcggaggctccccgtgccaccgcagggggcgggccacgacgagatacgacgagccgctgtcgaagcggccgaactgttccgcccggcgcctgggcagcgcaatgcagctaccgtggcggcagcgactgctccgccggtggccttgggaaacgccgagctcgtcgcagactctccttactaccccatggacgggttagaatccgaaatgcagggctatcttgacatggcgcacggcatgctcatcgagccaccaccaatggcgtggccgtcgacgtggatcgaggaggactacgactgcgagatcagcctgtggaactactgatga

SEQ ID NO: 150 - DNA, 1121 bp, Hordeum vulgare
tcttggatttcgattcgtttgttgggccggccgagatggacgacgacggcagcttgagcattcggaattggggcttctacgagacgatgaaaggaaacctcggcctgcagctgatgccatctgtgaccggcggccaccgggacacgaagccgctgctccccaacggtaccttcttgcagcaccacacccccccgcaccacccgccacattcgcaccacccccgcgactatggtaacggcgaaccctctggtggcatgcccgccgagccgccggctattcacatggactttgtgcgcaatgaggcctggatgcacccctcgcagcatcaacatcagcatcagcatcagcaccagcatcaacatcagcaccagcatcaacttcagcaccagcatcaacatcaacattcccgtgagttgaaggtccttaatgctgttcctgttgggcctgctccacacattggacatcctggacatgctgtgcatcaccaccctacaggttttgggatgatgccagatgcgcgtggtgcgcacactctccagatgatgcagccacaggagcctcctgtgcctgatgaggaaaaaattaccccaccgctggttgaagatcattctgtggtcggaagcaagcctcctgtgaagaagaggcagcagggtcgtcagcctaaggttccgaagccgaagaagcccaagaaggatgctaccccaggggaagatggggcacccaaggcccgtgcaccccgaagcaggggtccccttaagcctgtggaaatggtaattaatggtattgattttgacatttcaaggataccaacacctgtgtgctcatgcactggagctccccagcaatgctaccggtggggtgcaggtggctggcagtctgcatgctgcacaacttctatttcgacatatccgctgccaatgaacacaaagcgccggggtgcacgtattgctgggaggaaaatgagccaaggtgcattcaagaaggttcttgagaagctagctggtgaagggtacaaccttaataatccaattgacttgaagaccttctgggcaaagcatggcacgaacaagtttgtaacaatcaggtaaaagccatgctatgttgatcgccttgtagggtag

SEQ ID NO: 151 - DNA, 1525 bp, Brachypodium distachyon
aaaggatccgagagaatggcgagcaaggcggtgaccatcggcgatctgatccagcgggtcacctcctcctgcctctccaaccgcttccccggcaactacgccctcaacgactccggcgccgacaccgacctcgacgaggaggacgacgaccccttcgcggatttcggggacgccgccgacgaatgccggccttcgcccggcgaggtaacggcggcggccgcggcgggtggggagcaggaggaggaagagcggaagctgaagatctgggaggaggaggagaagcggaaggtggcggagacggcggcggagacgaaggggggcgagcgggcgcgggaggcggacgcgctgatggcggaggtgttcgacgcggtgtccggcgtgcggcgcgcgtacgcggcgctccagggcgcgcactgcccctgggacccggaccggatgcgcgcggccgacgcgggcgtcgtcgccgagctccgccacctcgcgcgcctccgcgaccgcttccgccgctcagcggcctcccccgacggccgcataccgcaagccaacccttccccgccgccgctccgcgaggcgttagccccgtacgaggccgcgctcgaggacctccagcgccagctccagagcaagcaggccgaggtcgacggccttaaagagaagctcgcctcgaacaccagcagcagccgccgccgcctccacccctccaagaagcagcagcaccccaatggtgcagaagccgttgtcggcgcgccgacggcggagctgttcgcggcgtgcgcggagcaggcgcgggcggcgacgcgggcgttcgcggcgcacctgctgaaccttatccgcgcggcggggctggacccggcggcggccacccggtcgctcaccaagatcccggtggcgtcatcttccccgaaggtggccaagcacgcgatggaggcgcacgtgacacgggtgctgctgggcgggttcgagcacgagtccttctacctggacggctccctctcttccctcctcgacccggccgcgtcgcgccgggaccggcacgcgcagttccgcgacatgcgcggcatggaccccgccgagctcctgggcgtgctcccggactgcgccttcggccgctacgccgccgccaagttcgcgtcgctcctgccgccgcgcgtcgaggaggccgtcctcggcgcgggccacaggggcggcggcgggggcaagcacccgaggacgccgttctacggggagttcctgcgggccgccaaggccgtgtggctgctgcacctgctggcgttcgcgctcgagccgccgcccagccacttcgaggccggccgcggcgccgagttccacccggagtacatggagagcgtggccggcccgccgccgccccgcgccggggccggcatggtcgtcgggttcgccgtcgcgcccgggttcaagctctgcaacgccgccgtcgtgcgcgcccgggtctacctcgtgccccgcggcaccacgggccaccaccctcctccctgctagtgctacctcgttgcttaggaattca

SEQ ID NO: 152 - DNA, 884 bp, Brachypodium distachyon
ccgagatgagggagctggtggtctcctccttctcttccacggcggcggctaacgcggcgctggtgcggggatggtgggaggaagtcaacgagtcgccggagtggcaggacggcgccttcttctccctcgccgccgcctacgccctcgtctccgccgtcgcgctgattcagctcgtcaggatccagcacagggtgccggagttcggatggacgactcagaaggtcttccacctcatgaacttcgtcgtcaatggggttcgtgctgttgtattcggattccatgcctgcgtcttctctctccagattaaagtatataagttggtgttactagacctccccggattgctcttcttctcagcatacaccttacttgttcttttctgggcagaaatataccatcaggctaggagtctccccacagataagttgaggatcatatacctggcagtcaatagcatcgtatatgtaattcagatctgtatctgggtgtacctcggaataaacgataacaagttggtggagctggtgagcaaaatcttcatagtagctgtctctgctgtggctcttcttggttttgcagtatatggtggaaggctatttgtcttgctgagacgtttccccatcgaatcaaaggggcggaaaaagaagctttatgaggttgggactgtgacgacaatctgctgcacctgtttcctgataagatgcgttgtggtggcactatccgcattcgatgctgatgtttctctagaggttatggatcacccaatcctagacttcttttattacatgttgacagagatactgccttctgcactggtcctttacatcctccggaagcttccacctaagcgggtatcggctcaataccatcctattaactagtag

SEQ ID NO: 153 - DNA, 950 bp, Brachypodium distachyon
ttaactctgacgcctgcactacccctaaacccatcccgtgcccgccgccgccgcagcctaattcctccccctccaaacccccgtgcacctccgctgccatggacaccgccgcctccgacggcagcagcagcgagcagcggcgtctcctcaccatccccaaggaaggcgagcgcatcatcgcgccgacgcgccgcccggacggatcgctccgcaaggagatccgcatccgcgccggctacgtcccgcaggacgaggttgccatctaccagtccaagggcgccctcatgaggaagtcagggcccgacgtgacaccggggtacgatcctgcgctcgatgccaagcccaagacgaaggcagcaaagcgcaatgagcggcgtaaggagaaacggcaccagggtagttcaacaaatgataaaggaaagagcttggatatagaggaggctgatgcccgagaaactcacacggttctttcttcgactaataagcagagtgatatggtggacagtgtagcagagcagctaagtggggttgctatttctgaatctcctcttgtagcaaccccttccacaaatgctactgacaacttgcaatcagagtcatctgctcccgagatagataagaaaatccgagcactgaagaaaaagatacgcttagctgaggcacaagtgcaaggggagccagaaaaattgaaacctgatcaactggagaaaacgaaaaagatcgagggttggcgtgaagagctgaagcttttggagtccaggagggttcaatctgcttcctagacaaagttggccaaagctctgatgtaaactcgaaccatcagtcccgtgcgcctgctgtggcgttattgctgacccagaaaattcagtcgaccatgctattcttgtccagcacctatgggtctggaaaagcattcccgtagatgtggggtttgcacagaatggaagttt

SEQ ID NO: 154 - DNA, 372 bp, Brachypodium distachyon
aaaggatcctgtaagcccgcatggtacagaagagaggagaccggcttctcccttcgtcacagaccacgcccctacacgcagccatcccgcgccgagggtttctctgctcgagcttcggaggcgaggaagagaagagaggggaagcggcgaggcgggagatggcggtgatggacacggcgttcaaggcgctgacggcggggttgggcgtggcgacgctctacctggccgccaccttctccgtcaacgtctaccgcggcctcgcatggcactccgaacaatcgaagttagaaaaggagaaatctgaaggctgaactggatcgacaagttagtgtagacgtcagacattatcggccaaaagaacctgaattcttt

SEQ ID NO: 155 - DNA, 1424 bp, Brachypodium distachyon
aggccgtggatttgatagagagtgctttacaatggagaagaagttcacggtgactaggactagcaagtccctggtgcccccatcttcgtcttccccaacaccggcggcgacagaggacgatgcaccagtgccggtgatcatgcgcctgtcgacgatcgaccgtgttcccgggctgcgccacctggtgctctccctccacgccttcgacggccatggcgtcgttgccggagaaggcgacgaagagcgaattagggggccggcgagggtggtgagggaggcgctggggaaggcgctggtggactactacccgtttgccgggaggttcgtggtggacgaggaaggggaggtgggcgtgaagtgcagcggcgagggggcgtggttcgtggaggccaaggcggagtgctcgttggaggaggcgaggcaccttgatgggaaccccatggagatggtgatccccaaggaggaccttctcccagagcccattcccggggtcgaccccctcgacatccccctcatcatgcaggtgacagagttcacatgcggcggcttcgtggtgggcctgatctcggtgcacaccatcgccgacgggctaggcgccggccagttcatcaacgcggtggcggactacgcgcggggcctcccgaagcctcgtgtgtctccggtgtgggcccgggacctcatcccggaccctccgaagatgccggcgccaccgccgaagctggagctcctggacctccgccacttcaccgtggacctgagcccggaccacatcgccaaggtcaagtcccagtacttcgcctccacgggccaccgctgctccgccttcgacgtcgtcgtcgccgtcacctggcagtcccgcacccgtgccctccgcctcgccggtgccggctacgacgacgtccacgtctgcttcttcgccaacacccgccacctcatgctccacggtggcgccggcgcggcggggttctacggcaactgcttctacccggtgagagccacgtgcgggagcgctgaggtggcgtctgctgacgtggcgggggtggtgaaggtggtgagggacgccaaggccaggctggcgggggacgtggcgaggtgggccgtgggcgggttcgagcaggacccctacgagctgaccttcacctacgactccctcttcgtgtcggactggaccaggctgggctttctagaggccgactacgggtgggggcccccggcccacgtggtgcccttctcgtatcaccccttcatggctgttgccgtcatcggcgcaccgcccaagcccaagctcggctcccgcgtcatgaccatgtgtgtggaggaagaccacctcccggagttccgggaccagatgaacgccttcgccttcaccgccgggaagtgagtaagcaacgatccataatcgtccatgtatgaaacccaattga

SEQ ID NO: 156 - DNA, 1988 bp, Brachypodium distachyon
ctacaacgatctccatcccacggaaccgaacccgcatgcctctcgcggcggccgccaccgtcgccgctgcgcgcccgtccccgattggcctgccccgcccgttatgccgcgcttccgcccatccacgccgccggttccggctgcaggcgacctcgcccgcctccacgccggcacctgcgcccgcgccggcgacagcggacgagggacccggtgcggggccgtgccccgtggttaggttcgacatggctgacttcactgtcgccgaccgcgtcagcgtcgggctccacggacggtcggatgagatgatcttcgaggccacggtgcgcgatccgagcagtgagctatacgggtcaacggtggtgttgaggcagctgacgagctcgcaggccaagcgcaggggccggcgcgcgctagaggtgctgaagaagctggctcgccgccagatcatgtaccactcgtacgcgatgcaggtccatggctatgtcactccaagcaatgtcatggaggagggcgatggaccattcattttggtgcacgggtaccatgggagttactccttgcgtcactggttgcaactctcggattggcttccaaccttagaagcaacattggcattggatgaagaacaagtaaggagggtaggagatgattcgattggaggacctgctgttactcggcagctacgtctaatcaggatattgatgagagaccttctgataggtgtaaattatctacatagccatggaatggcacatactgagcttagactggagaatgttcatgtaagcccagtagacaagcatgtcaaagttggtattcttgggaatgctgttgattttcatgacagtgatcctaacaatagttcagtaccaagtaacaatgacagacgaaaaatgatgatagcatttgacatgagatgcgttggtttcattatggcaaagatggttctgaaagagctcatggattcttcaacattcctaaaattcaagtcattcttgaataagggaaatgatccatcatgtttgcgcgagttccttgtacctattcttagccaaaattctccaactgggaatattggtctgcagatgctcgatagacactggggtgctggttggaaccttttggccttattgctcgcaacaaaatctgacaataggataagttgcctcaatgcactgcggcaccccttcctttgtggacctaaatggagaataagtccatcagtgaatgttgtacgttggggcttgggatctactgctgtccgcctggctgaagattatatttatgggcatcaccagcgtagacggttagcatattttattgagttgatggaagtgctaaaccctaattcaagaacagagagttggcttcacctcctacctggtcgctggtgcctcttatactgtacaggaaggcacatcggtctaacacttcgtcagcctacccccagaatcctcatgagtgacgtgttcctcacatttgcacaaactccagagtctgttgaccccgttttatctctggcctcagatattggtttcaaaattatgccagaatctgactggcctcatgacaaatctggcaccgaaggaaatttgtctgttacaacatcagcaaggatagctcctgggaggatctatattaatgcagaagatagtaaagacagtaggatcacatcttcaaggagatatcttcacggcaaatggggaaaagcttcgaaaatgaaggagctgcctgctagcctccccaccgcaagcattaatgtcgatgaagacgaagttgatgtgtcaatgacttgtggctcgactttgaatgtcaattctgcacgtaaagtgctgcaagaggtccgtactcagaccccaccggaaatgttcgatttgtcaaagattgtttgtggtacatacatcgattcaaggttgatgattcttcgtggtgtaaatgggtcggctttacttttcattagatcgaattgtacgtcagactcctgatga

SEQ ID NO: 157 - DNA, 305 bp, Brachypodium distachyon
cggccatggccgatgactcgccgtcgtccccggcttcttacatccgattggtgcagcacctgatcgagaagtgcatctgctacaacatggacagggaggaatgcgtgaagacgctggagaagcaagccaacatcatgcccaccgtcacctcaaccgtgtggaaggagctggagaaggagaacagggagttcttcgagacgtacaagaaggagcgaggcgatcaggagccgttgcagaagagcagctgtactccttcggagcaggcgtctgcttccaagagctcagacgacaacgacaactagtag

SEQ ID NO: 158 - DNA, 1379 bp, Setaria italica
gtgctttggtgaattggtgaggtagtatgggtaccatcgggttcccggtgacgaggacgagcaggtccctggtggcgccgtcgtcggcgacgccgcaggagacgctgcgcctgtcggtgatcgaccgcgtggcggggctgcgccaccttgtgcggtcgctgcacgtgttcgacggccgcagcggcggcggcgccggaggcgacgaggcgttgctggcgacgccggcgaggacgctgcgggaggcgctggggaaggcgctggtggactactacccgtttgcggggcggttcgtgacggaggaggacggcgaggtccgggtggcgtgcacggcggagggcgcgtggttcgtggaggcgtcggcggcgtgctccctggaggaggtgaagcacctggaccaccccatgctcatccccaaggaggagctgctgccggagccggcgccggacgtcaacccactcgacatgccgctcatgatgcaggtgacggagttcacgtgcggcggcttcgttgtcggcctcatctccgtgcacaccatcgccgacggcctcggcgccgggcagttcatcaacgcggtggcggactacgcgcgcggcctccccaagccccgcgtggcccccgtctgggcgcgcgacatcatcccggcgccgtcgaagattgtgtcgcggccgccgcgcttcgagctcttcgacctccgctacttcaccgtggacctcggcccggaccacatcgccaaggtcaagtccagcttcttcgaggcgacggggcagcgctgctccgccttcgacgtgtgcgtcgccaagacgtggcagtcccgcgtccgcgcgctccggctcgacgccgacgacccgtcccgcccagtccacgtctgcttcttcgccaacacccgccacctcctgccgccggcaccggggttctacggcaactgcttctacacggtgaaggcgacgcgtccctgcggcgagatcgccgccgccggcgtggtggaggtggtgcgcgcgatccgggacgccaaggcgcggctggccgcggacttcgcgcggtgggcgggcggagggttcgagcgcgacccctacgagctcaccttcacctacgactcgctcttcgtctccgactggacgcggctcgggttcctggaggcggactacgggtggggcacgccggcgcacgtcctgcccttctcgtaccaccccttcatggccgtcgccgtcatcggagcgccgccggcgcccaagcccggagcgcgcgtcatgaccatgtgcgtcacggagaagcacctgccggagttccgggagcagatgaacgccttcgccgccgggaactaaaccatgcttacctatcgtcgtcgtgtatcgccgtttcctcatcaaagcgtgtcttag

SEQ ID NO: 159 - DNA, 1059 bp, Setaria italica
aaaggatccgccactcccttctcctcatccccaccgtaccggaaggcgaaggcccgccgtggatcgagcgatggcggcgacacctcctcctcccgcggcggcgctggagcagctcagcagcaacaagatgttcggcggtcgcaacctccggttccgccaccagagcgccaccctcggctgccccatgaccttctccgtctacctgcccccgtccccggcgtccaaaattcccgtgctgtactggctctcgggcctcacctgcactgacgagaacttcatcattaaggccggcgctcagcgcgccgccgccgcccacggaatcgccctcgtcgcgcccgacacctccccacgcgggttgaatattgagggagagtcagacagctatgattttggtgttggtgctgggttttatttgaacgccacaaatgaaaagtggaaaaattggcgcatgtatgactatgttgtgaaagaacttccaaaagttctgagcgatcactttgaacagctcaacactacacaggcatccatttttgggcactcaatgggaggccatggtgcactgacaatttacttgaaaaacactgataaatacaagtcagtatcggcatttgctccaatcgtcaatccgataaactgcccgtggggtcagaaagcattctcaaattacctgggctcaactaaatcagattgggaggaatatgacgctacctgcctgattaaaaagaagaacaaagtttcagctcctatcctaattgaccagggggaggatgacaagttcctggctgagcagctgctacctcgcaactttgaggaggcgtgcaaggctgtcggggttcctttgatcctgcgcatgcagcctggatatgaccattcgtactttttcatcgctacatttgttgatgatcacattgcacaccatgctcagtttctgaagagcgcctgacttcaaagtctcctgtaatgtgaggaagccatcaagagagatggggaggcagctgtggttgcgaggcgtctgcttagcagtgtgtgtcactatatcctgctgccgacgaattcttt

SEQ ID NO: 160 - DNA, 967 bp, Setaria italica
aaaggatccgcatcctcctcaggaatggagcccggcgctggcactgccctgtaccctctgcaccgctgcaaaaccatttacctggtcaggcacgcccagggcattcacaatgtcgcaggcgagaaggatttcaacgcctacaagtcgcatgacctcttcgatgcgcagctcactcctctgggttggagccaagttgatggtctgcgggagcacgtgaagaaaagtggacttgcaaaaaaaatcgagctcgttatcacttcccctttgctgaggactatgcaaactgcagtgggggtctttggtggtgaaaactatactgatggtgtaaatgcaccaccactaatggttgaaaatgctggacacagtggacgtcgggcgatttcaagtttgaactgcccaccatttcttgctgttgaaacctgtagagagcacttgggtgtccatccctgtgacaagaggaggagcataacagaataccggcctctctttcctgctattgacttttcattgatagaaaacgatgaagatgttctttgggaaccagatgttagagaagcaaatgagtctgtggggctgaggggtatgaagttcattgactggttatggacaagagaagagaaggagatagctattgtcagtcatagtggcttcttgtatcataccttgaacatgtacagcaaggagtgtcatccaaccataagagacgaagttggcaagcactttgcaaactgtgagctccggtcgatggtgttggttgacaggagtatgcttgggtcggattccccgagtttcaactaccctggcaagattccagccggactcgatcttcctagcgacgttgcagacgagaagcatcttgaggaagctcagaagaactgatgagcctgtctgaggctgttgagcattgatgccttgattcttttatcaactcattctgaccctgttcaagtttgtgttggaattcttt

SEQ ID NO: 161 - DNA, 1469 bp, Setaria italica
gccctgtctcagctctcaactagtagaagcgagttgctagcacacaccggcggcggccaagcacaagcagaggaggagcagcaatggcggaggcgaggcagctgcggtcgttcgtggaggtgccggcgggttcgcacttccccatccagaacctgcccttcggggtcttccgccggcggcaggcgcaggagccgccgcgccccgcggtggcaatcggggacttcgcgctcgacctcgccgccgtcagcgacgccgggctcttcgacgggcccgcgctcgccggctccccgtgcttccaccaggagacgctcaacatgttcttggggatgggacggccggcgtggaaggaggcgcgcgccacgctccagagaatcctctcggctgatgaaccagtcttgcgtgacaacgaagccctcaggaagaagtgtcttgtaccaatgagtgatatagagatggttatgccaatcactgttggaggctacacagacttcttttgttctgttcaccatgccaggaattgcggatttatcttccgcgggccgcagactccagtcaatccaaattggtttcatcttccaataggttacaatggacgggcatcatctgtagttgtgtctggaacagatgtcattcgacccaggggacaaggacatccaacaggaaactccactccttatttcggtccctctcggaagcttgattttgaacttgagatggctgccattgttggtccagggaatgagttgggcaaacctattgatgttaatgatgctgaagaaaatatttttggcctagctttgatgaatgattggagtgccagagatatccaggcttgggagactatacctcttggacctttccttgggaaaagcttcagtactacaatatcgccatggattgtcactctggatgctttaaagcctttcacctgtgaggctcctaagcaggaacctgagcctttgccttacttagctgaaaagaatcacataaactatgatattcctcttgaagtctggattaagcccaaagaccaaagtgatgcctcaattgttgcaaagactaatttcaaacatttgtattggacggtgacgcagcagctagcacaccacactatcaatggatgcaacatgaggccaggggatatatttgcaaccggcacactcagtggacctgaacctgaatctctggggtgtctgctggagctaacatggaacgggcagaaggagatagcagttggaaattcgacccgcaagtttctagaagatggggatgaagtcatcttgaccggctgttgcaagggtgaaggctacaacattggattcggaacctgcacagggaaggttctgccggcgcttccttgagccaacatatcttcacttaataaggtctccggagtctcaataatcacaaagggttcatccggcgaatctagcaagctgcttagtctgtttcaggcctagtgatggtga

SEQ ID NO: 162 - DNA, 871 bp, Setaria italica
caggcaggaagacgatgggggcgtcgccgtcgcggcatgaggcgtcgtccgactcgtcgcgcgccggcaacggccgcgccgtggcggtggcgacgagcagcgccgcttctggcaccggtagcaacagcaaccaggcccagtcgaagcgggcgccggctcctcacatgttccatgagatcgtcgcgcaggagaagactgccactactgcagccgagctggaggatcaggtgcatggcgcagggatctacctggctggaaaaacaaagaagtactgggtgcacgagaaaaccaggtgcaactgcttcatgctgttccccagagggctgtccgtcacttggagtgaggaccccaactactggagctggcatcccctgaaagagacaagcgactccgagatcgaggcggtgtcgctgcagaacgtgtgctggctggagatccacgggaagctggagctgtcccacctcacgccaggagtcacctacgacgtcgtcttcgaggcgatgcttacagagccaacgtacgggtggaccgcgccggtgaacctccggctgaagctccccgacggggcggtgcaggagcggaaggagaagctgcaggagaagcccaggaaccagtggctggagctcaaggccggggagctgacggcgcagccggggcagaagggggaggtggagatctccttgttcgagtacgatggcgggcagtggaagagggggctcctcgtcaagggcatcaagattgtgccaaaggagtgaatgagtgattagcatttgtttgagggtgatcattagccttttgcctgtcaggtgtgctaagatcaatgggatacgtggaataatgatgtgtgtggcaccacatatttcaagcattg

SEQ ID NO: 163 - DNA, 2088 bp, Setaria italica
gactctgaagattgcttccgtcgagttctgaatctgggattgtggcggcttcgtaggcagccgccggaatccgcaaagagcggcagctcgtcggtgtcggcgggaaggtcctaacatgatggctgcggagttagttaagcagtactcaaacatcactttgggagaagacagtgagatatgtgatattaaacatgcgcttaaggcattgagaaagaagatccttagtttggattttgacaactctatgcatgtccatgatccacaggactcatttgagtacttggaagtgctgtacaaaatcagacgactgtctgaaaggttaaggaacctagacccttgtggagaagccaaacagctggatgaactcactgtgtatgccgatgacctttctgaaatggcaatggcaaggcttgaagaggaatttgtttatcttctgacacattacaaacagccattagaacaggaagttctctcttttcgctctacagaggatggcagtgtggaagacttttcaagcagctcattcagcgaggaacaatcagaagggaaggcaacaccaaatgatgtcgctggaggaccggagtatcttgttcctgatttgattcaacccggtgcactctctgctgtcaagtccattgctaaatttatgttcctgaatggctatgataaggagtgttgccaagcttatataaactcacggcagaatgcaatagatgagtactttgcatctcttcgtctggacaagctcagtatagaagagcttatgaacacaagttggaccaaactgaatattttaataaggagatggaaccgagcaatgagggtttttatccgagtctaccttgcaagtgagaagcgccttagcaatcatatctttggtgaacttacagattcaactgctgacttgtgcttctatgagatttcatttaactcagtaatacaacttctgagcttttatgtatctgtagctattggtcctccaaaaacggaaaagctttttcgtttgcttgatatgtatgaggtcctgaatgatcttctccctgaagctgaatccctgtttgaatcaggatatgatgatatgatcttgaatgagtatcatgaagcactactgcagctgggagaatctgcaagaaagacatttgcagaattcaagtatgccatccaatcatacacttcatcaaatgcagtggctcgtggagaagtgcatccacttacaaagtatgttatgaactacataagggctctcacagcatacagcaaaactcttgattcaattctcaaggacacagatcgaagacacctgcatcttgcttctgacattcagttgatggcgaatgcatatcctaatttcacagcaacagctttgcatctacagtctgttgccgcaattttggaggcaaatcttgaagctggttctagactgtacagagatgatcgattgcagaacatctttatgatgaacaacatccactacatggtccagaaagtgaagaactcggatctcaaaagctttcttggcgatgactggatccgggttcacaacagaaagtttcagcagcatgctataagatatgagagggcgtcatggaacagtgtcctctcttacctgagtgatgatggcttgtgcgctgctggtgatgctgcttctcgcaaaaccatcagggagaagataaaaaatttcaacctatcctttgaagaggtttatcgagttcagacagcatggtctgtcccagatgaccaacttcgtgatgatgtccggatttcaatatcactgaaagttatacaggcctataggacattcgtgggaagatatggaagcgtccttgatggctcaaggcatcgagatcgttacataaagtatagacccgaggatttggagacacttttgctagatctttttgaaggagctcaaaagtcactgctgcattcttgtcgagcgtgaagcttaaaccagttcgtcgaagagatgcatcagccccctccaccttatttttggttttcttctttggtttgtattatagaatcatagaatgtatagttgaattattatagtgatgtgttgttctgtctgcccaacttgcataattt

SEQ ID NO: 164 - DNA, 1118 bp, Setaria italica
tccccaatccatttgaaaccgcgccgcgtcggcgtgaatcgtcggcggcggcgatggaggtgggcgacctgcacaaggtctgggatgtccgggaactcaagaggaagcccgacgcggccgccgcccgcgcgctcctcgaccgcgtcgccaagcaggtccagcccatcatgcgccgccacaagtggcgggtcaaggtcctctccgagttctcgccacggaacgccaggctgctggggctcaacgtcggcgcgggcgttgaggtcaagctgcgcctgcggcgcgccggccgcgactacgatttcatcccctacgaggaggtgctcgacaccatgctccatgagctctgccacaacgaccgcgggccccacgacgcgcagttctacaagctctgggacgaactccgcaaggaatgcgaggaacttgtttcgaagggtatcactggaacaggacaagggtttgatggtacgggaaggcgggtgggtggatttacaatacatccgccaccaccatctctccgacaagctacattggctgctgcacagaagcgagcaaggaatggagctctattgccttctggaccaagaaagttgggtggaaacaacgatattatgagtgcgcttagtccagcgcaagctgctgcaatggcagctgaatggagaatgcatgatgatttgtggtgtggatcccacaatcaatctggtattgatgattcggatgacgttattattcttgaggaaccacctaataacatgacaataaaggatggaaaaaccacaaagggtagctgttccaacacttctgcagagtccagcacttcgtctggaattcacacagcagcacgagatggtccctcatctttttggacaacaggtgatgcagttgatgattcaaagtgggaatgtggtgcttgcactcttctaaatcagcctttggcaccaatctgtgaagtttgtggcactgcaaaacctaaaattgcaaaggcgaagtacatgacttggtcttgtaaattttgtactctagaaaacagcactaagcttgacaaatgctcggcgtgcgaccattggagatactcatatgggccacctgtagccacttatggcccaagctatgattgatga

SEQ ID NO: 165 - DNA, 1067 bp, Setaria italica
cagcgatcccgattcaactgatattaggatggacgaagtcacgcaagctgttgagaatctgaagaaagaatggaaccaagcggtttcacagcttgaggagagcattgctgcaatcagatcatgtggaaaaacagggaaagggacagaggaagcaaattctcttccaaggttgaatggttctgcacaggatgctctgcaattgctcaagtcactgcagtttcgtcttgatcttctagcacagcagcttcccacttttgaagaagtgcagtctggccaagcaaccttagagtcatgggatgaacaatacaagaagctgcgtgctagcctgaggaatgctaacttacaagcgaaagagaacattagaaaagctgctcaagaggagagggagcttcttctcgggggtggagaagagtctaccatccgcaggcgtaatctccagacaaagactgggatgacatctgctgctgaaagtatcactgagagcctccgacggtctcgccagatgatggttcaggaagtggaaagaagtgcaagtaccttggcaacatttgatgaatcaacaagtgttcttcggaaggctgaaggtgaatatcaaggacaccgctctttgctgtcgcggacccgtggtttgctctccacgatgcaacggcaagatgttcttgatagggtcatcctaacagccggctttatcattttctccttggcggttctctacgttgtctcaagacgcattggtctgctgactctgcaaaggaaactggctgatgccatcagatcaggttcgctgtcagccgaggacatcgtagcgaaagcccagcagcatggacctgccgcagctgatgctgcaggccccgctcctcccatttacgatgaactgtgactcgcatctgcccatgagtttttttttttttttgagagggcatttgcccgtggtttcttatacatgtgtacccagattcccagaagcaattgtaaggcaatagttccacgaataagctattgttgagatatatatctacagtgcagtgatctgtgatcaactgatcatcaaatcatgcaccgacctg

SEQ ID NO: 166 - DNA, 1603 bp, Setaria italica
actgaccagttgagtcccaaactcccaagcgagagctgccgagcttgctgcagacgctcccggccggccagatcaaccgaagctagccgccgagcggcacctgcgatggccgtgcgccactccctcgaggtggccgacgaccgctgcgacgacgacgggcaccgcccgcgccgtgccggcacggcgtggacgtgcgcggcgcacatcatcacggcggtgatcggctccggggtgctgtctctggcgtggagcgtggcgcagctgggctgggtcgtcggccccgcctgcatgttctgcttcgcgctcgtcacctacgtctccgctgcgctgctcgccgactgctaccgccgcggcgacccggagaagggccccaggaaccgctcctacgtggacgccgtccgcgcctacctcggcaagaagcacacctgggcttgcggctcgctgcagtacgtgagcctgtacggctgcggcgtcgcctataccatcaccaccgccactagcataagggcgatcctcaaggccaactgctaccacgaccacggccacgacgcgccctgcgactatggcggcagctactacatgctcgtcttcggcgccgcgcagctcttcctctccttcataccggacttccacgacatggcgtggctctccgtcgtcgctgccgtcatgtccttctcctacgccttcatcggcctcggcctcggcatggccaccaccatctctaacgggagaatcaaaggaagcgtaacaggtgttccgatgaggacgcctatgcagaagatttggcgcgtctcgcaggccatcggcgacatagcgttcgcatacccatactccttgatcctactggaaatacaggacaccctgaagtccccgccggccgagaacaagacgatgaagagggcgtcgatgatctcgatcctcgtcacgacgttcttctacctctgctgcggctgcttcggctacgccgccttcgggagcgacgcgccgggcaacctcctcaccggcttcggcttctacgagccctactggctcatcgacttcgccaacgcctgcatcatactccacctgctgggcgggtaccaggtgtacagccagcccatcttccagttcgcggacaggttcttcgcggagcggttcccggacagcgggttcgtgaacgatttccacacgatgcgggtgccgtgcctgccgccgtggcgggtgaacctgctgcgggtgtgcttccggacggtgtacgtggcgtccacgacggcggtggccgtggcgttcccctacttcaacgaggtgctggccctgctgggcgcgctcaacttctggccgctggccatctacttccccgtcgagatgtacttcatccagcggaacgtgccccggtggtccgcgcggtgggtcgtcctgcagaccttcagcgtcgtctgcctcctcgtcagcgccttcgccctcgtcggctccatcgaggggctcgtcacccagaagctgggataggactggtcactggtgtcctccatctctgttttggattggattgtgtttcttcttccggttgtgatggtaatggagaatgcagcgaatggggaggtggtgtttgtctccttgggatgat

SEQ ID NO: 167 - DNA, 1985 bp, Setaria italica
atatgctgttgcactgctgaagaggaggatgatgatggaacggttgcttctttgagcagcaggcctcctacccacgctaccctggcaagtaaagtcagggggtgtgggaataacccggtgaataatcatggacagaagagctggagcaatcctagtgtgcctgctcttcgtcctagtccgggacgtgtcggccgtcgctgagaccgaggccggcaatgtgcgtttagtgcaggaggcgcccaataggaagatcgagggcacagggaggcaggatgatggtaaggtgggggggagggtgtcggtctcaacagttgcttggtctacgctcatcatggctgcggcaactggattgggagcagtgcccttcttcttcatggagctggaagctcagtgggcaggcctttgcaatgggctagcagctggggtgatgctggctgcaagctttgaccttgtgcaggaagggcaggtgtatggcagtgggagctgggttgttttcggaattttgagcggaggaatatttatttggctttgcaagaagtttcttgagcaatatggagaagtaagcatgctggatataaaaggtgcagatgcaagtaaagttatccttgttgtcggaataatgactctccattcttttggggaaggctctggtgtgggtgtttcctttgctggctcgaaaggattttctcagggtcttctagttactatagctatagcagtgcacaacataccggaaggcttagctgtaagcatggtactgtcatctaggggtgtaaccccacaaaaggcaatgatatggagtatcataacatctctaccacagccaattgttgctgttcctgctttcctttgtgccgacgcattccagaaggtgctacccttctgtactggttttgctgcaggatgcatgatatggattgttatagcagaggttcttcctgatgcttttaaggaagcgactccatcacaagttgcttctgctggaacacttgctgttgctttcatggaaacattaagtactgtgcttctgggatttactgatggcaacaactcagaagatgcatcaggtttcttggtatcacttgtatttggactcggtccacttattggaggaattatacttgtcacattctctcttgccttcagcatgccacaccctcttcttactggtgtggcatctggcattgctttccgtcttgcggcatggagacccgtacagcttctaatgtcctcaaaaatgggtctatttaccaccctctttctcctcattgttggttgccttgtctaccatgctgccacatcaagcatccttagggtggttaatcgcaaaaggtcttctgttaacgtcattacatcatcctctggtttctctcttagtgtcctcacactgcaatctctccttgcctgtggttctgtattccttcatgcatacgccgaaggacttgtgcttggtgtcgcggcacgcaaggcttatggccttggccgttacatggttctcccagcttccctccatggtctgccacgaggtgctgctgtcgcaagctgtgtatatggtgccacagatagctggcgcggggcccttgcagctgctgctctgaccgggcttgcaggacctagcgccgccatcagtgcgatccttgcgaggatcgactacgatggactcgactactggatggtgatcgcgtgtggggctctgatccccagctttggccgtgttttcaggcggtctttgcgattggacatgcggaagagcattgtggggctgctgataggtatcgccttcgcctccgtgtgcttgatgtcgactagattcatttgcttgcacaccccttactgcaactcggctccagaagcggtcacatgacttgtgtaactgtgttgtatacggtgatgttgtaaaacacatgtaataccagtgtaatgacttttgactatacaaagaatggaaggttatattgcacttgcaatgaggaggccatagttaa

SEQ ID NO: 168 - DNA, 1669 bp, Setaria italica
ccactcgcctccctctcctcctcccccctcccacgccgcggaacgaatccggcgccgcgctcgcgctcgctgcccccggccggacccgcgccgcggctcctgcacgccccgcgatggcggcgtccatggcgtcgccgcgggggcggtcgatccgggagacggtgctggagaccgtcgcggcgtaccacaaccagcagcggatgaggcgcaagctgcgcaagagcctcacctacgcgggggagctctcctccgcgggccgggcacgcggggacggcgcgtcatcgtccgcctcggtatcctcgctctgcgggcccgaggacgacgacgagcccttctgggaggaggaggagggcaccgtcgagctcgtccagctcggggccaaccgcgccaagaacgtcctcatcctcatgagcgacaccggcggcggccaccgagcctccgcggaggccatcaaggacgccttccggatcgagttcggcgacgagtacagggtcttcgtcaaggatctgtgcaaggatcacgccggctggccactcaacaacatggagagctcatacaagttcatggtgaagcatgtgcagctctggaaagtggctttccacagcacctcgcctagatgggtccattgcttctacctagctgctctcgcctcattctacgccaagaaggtggaggctggactgaagaagtacaagccagacatcataattagtgtccacccccttatgcaacacattcctctgtgggtgctcaaatggcaaggcctgcaaaacagagttgtctttgttactgtcatcacagacctcaacacttgccaccctacatggttccatgccaatgtgaatagatgttactgcccctcagaagaagttgccaagagggcagcattggatgacctacaaccttctcaaatccgcgtgttcggtcttccgattcgaccatcattctgccgtgcagttcttgttaaggatgaattgagaaaggaacttgaattggatccagagcttcctgcagtgctgctcatgggaggtggagagggcatgggtcctgtcaagaagactgcaaaagcccttggagaatcattgtttggcagagaacatggaaaaccaattgggcaacttattgtcatttgcggtcggaacaaaacactgagctcctccttgcaggcacttgaatggaaaataccagtaaagattagaggatttgagacccaaatggagaagtggatgggtgcttgtgattgtattataacaaaggctggaccaggtaccattgctgaagccttgataaggggtcttcctataatccttaatgatttcatacctggacaggaagttggcaatgtcccttatgttgtggacaatggtgcaggcgtgttctccaaaagccccaaggagactgctagtcttgttgcccgttggtttggtccagactcagaggaattgaaaaggatgtcagaaaatgcactgaaattggctcagccggaagctgtctttgacattgtcagagacatccatgagctctctcgggagcaaggcgtgatttcacagatatctagttccttgacgtcatccttctttataccatcacctgaaaccacacctctccaacttatctgaaaccttggagctgtgcatagctagaattgcaatctctgaccttgtggact

SEQ ID NO: 169 - DNA, 751 bp, Setaria italica
aagctcagtcacccagtcgctccaaaacctgatcggattcgcatccatggccaagttcgccgtcctcctcctcctcgccgtggcggcctccgccaccgtgctggcgcacggccgcgagctcccgactcaaatcaagctggtgagaggcgcggtcgccgccgccggcggaggcgtgtccggcgacagcatggagtgcgtgtacacggtgttcatccggacggggtcgatctggaaggccggcacggactcgaacatcacactggagctggcggcggcggacggcaacggcgtggggatcacggacctgccgtcctggggcgggctgatggggcagggccactcctacttcgagcgcggcaacctggacatcttcagcggccgcggaccctgcatggcgaggccgccgtgctggatgcgggtggcctccgacggcacggggccccaccacgggtggtactgcaactacgtcgaggtcaccgtcacgggcccgcacaaggggtgcgcgcaggagctcttcaccgtcgagcagtggctagccaccgacgcgccaccgtacaagctcgaggccgtcgtcgaccattgcgcccgcgccggcgctggcgccgccgccgcgtgacgtggcctgggggtgacgagtcggagctgctgcagttcgtgcagcgagtcgaataatcgagagcctttgtcgcgtgggatgatgcatgcgtagtgagtaggtttggtggttttgtagatgccctgtgttggatct

SEQ ID NO: 170 - DNA, 4322 bp, Setaria italica
ctctgatgcgtcccgccccatggcatcccacattccccttccctgccaccggcgtcctccccctcctcctcctcggcctcttcgccgtcgcatccggggggacgggccctagcccaggggctttcaatcggggggaggcgggcggcgcggaggcgtactcgatcctcacgttccacgactacacgccgcccccgccccccgcgttgccgccgccgccggccgccccggcggcgacctgcgccggggacctccgcggcgtgggcgacctcgacacccagtgcgtggtccagaagtcggtgaggctgggcggcggggtgtacatcagcggcaacggcagcctcgtaatcctcggcggcgttgcggtcacctgcgagaggcccgggtgcgtcctctccgccaacctctcaggcggcatcctcctcgggcacagggcccgtgttgtggccgggtgggtttcccttgcggcggccaacatcacgctcggcgtcgacgccgtcgtcaacaccaccgccctcgccggcgacccgccggaccagaccagcggagtgcccaccgggacgtatggggatggcggtggacacggcggccgtggcgccagctgcttcgttaagaaggggcaggcgcaggaggactcatggggtggtgatacctacgcgtggtctgcactgaagaccccaaatagctacggcagcaaagggggatcgactactgtcgagaaggactatggtggtggaggtggtggtgtagtgtggttgttcgctaaagaaattgtgttgaatggaacagttcttgctgatggtggaaatggtggcaccaagggtgggggtggctctgggggcagcatctatctgaaggccgcaacaatgcgagggggtggcaaaataagtgcttgtggaggcaatggtttggctggcggaggtggaggacgtgtttccatcgatgttttcagcaggcatgatgatgcccaaatctttgttcatgggggaaagagttcaggatgcttggacaatgcaggagcagctggaactctttatgaagaagtgcctaagagtattactgttagcaatgataacttgagcacacaaactgatacagtttttctagatcccccatatgagccactctggacaaatgttcttataaaaaatcatgccaaagtttctcttcccttacgctggagtcgtattcaggctcaaggacagattcttttagctggtgctactctaacttttggcctgacacattatccgtattcagaatttgagctgttggctgaggaacttcttatgagtgattccacaatcaaggtctttggtgctttacgaatgtcagtaaaaatgctccttatgtggaactcgagaatgactattgatggtgacagagaatcaggagtagcaacttcactactagaaggtagcaatttgatagtcctgaaggaatcatctgtgatacattcaaatgctaatcttgggattcatggtcaaggcgttctaaatttatctggtcaaggagatacaatagaggcacaacgccttatattatcactgttttacaacatagtggttggacctggagctgttctaaggggccctcttataaatggaagtattggcgagatggcaccaaagctgaactgtgaagatgagagttgccctatggaaatttttcatccacctgaggattgcaacttgaactcttcattgtcttttactttacagatatgccgcgttgaagatattgatgtttccggccttgtgcaaggaactgttattaattttaacagagcaagaagtgtcactgtgcagacatctgggaccataagtgcaacaggattaggctgccagggtggaattggacaagggaaaatgttaagcagtgggattagtggtgggggtgggcatggtggtaaaggcggtgatggcatttacagtggtgatcatgcagagggtggacctgcatatggtcatgctgatttaccttgtgaacttggcagcggcagcggcaatgtcagtgcatcttcaacggctggtggtggtataatagtgatgggttctctggagcaatctctgccaaacctctccctttctggctcaattgaggcaaatggtggtagttttactggcttggcatctcatgccacaattggaggacctggtggtggttctggtggtacaattcttctttttgtgcggactttactcctaaaggaggactctgtactctcaagtgtcggtgggattggaaacaatggcagtggtggaggtggagggggtcggattcactttcactggtccgatattcccactggagatgattatgttccttttgcaactgttaagggaacaatacttacaagaggaggagtcagtgaaggccatggttttcctggtgagaatggaacagtcacaggaaaggattgcccaaaaggtctttatggaacattttgcaaggaatgtccttcaggaacatacaagaatattactggatcatctaagtccttgtgctcaccatgccctccaaatgagctacctcgccgtgctgtatacataagcgtccgaggaggtgttgctgaaaccccatgcccatacaaatgtgtgtctgatagatatcgcatgcctcactgttttactgctcttgaagagctgatatatacgtttggtggaccttggttgtttggcctgcttctttctggccttcttgtcttattagctcttgttttgagtattgctcggatgaagtttgttggtactgatgagttgcctgggccagcaccgactcagcacagttcccaaattgatcactcttttcccttccttgaatcactgaacgaggtattggaaacaaacagggcagaagaatctcactgtcatgtgcacaggatgtatttcatgggcccaaacaccttcagtgagccttggcatctcccacacaccccaccagagcaaatttcagagattgtgtatgaggatgcatttaacaaatttgttgatgagataaatgctcttgcagcctatcaatggtgggagggttcagtttatagtattctctgtatactttcatatcccctggcatggtcctggcaacagtggcgcaggagaaagaaattacagaaactatgtgaatttgttcgatccgaatatgatcattcatgcttacggtcctgccgttcacgtgcactttatgaagggctgaaggtagctgctactccagatttaatgctgggttatttagatttcttccttggtggcgatgagaaaaggactgatcttccccctcgacttcatcaaaggtttccaatgtccctcatctttggaggtgatggaagttatatggctccattttcacttcatagtgacagagtggttacaagtcttataagtcaggctgtaccatcgtcaatatggcatcgtcttgtagctggattgaatgcccagttgcgtttggttcgtcgtggaaatctaaacacaacatttcttcctgtgctcaaatggcttgaaactcacgcaaatcctgcattgaacacgtaccatgtgcgtgttgaccttgcatggttccaaactacagcattaggttactgtcagtttggtcttgttcttcatgctgtggggggaccggtggctgctgaacttcaaggtgactctgtaattataaccgagcagcattcagtaaaccagaatacatatgctgattctcagttgagccactcaaggatcaacgatgctcttttgtgtaaaaggataactggcaccgttctcaatgttgaaaacttaaagatgctcaaagacaggagagatttgttttaccctctctctcttatcttgcacaatacaaaaccagttggacatcaggacctcgttggcctagtcatctcaatattgcttcttgcagatttcagcttagtcttgcttactttcctccaactatattcatattccatggtcgatgttttattagtcttgttcattcttcctcttgggatactggcaccgtttcccgctgggataaatgctctttttagtcatggaccgcggcggtcagctggccttgctcgtgtgtatgccttatggaatattacatcactggtcaatgttgctgtggcttttgtatgtggttttctgcattataagtcatcaaacaagaaacattcaagcatgcagccatggaatttgggcggggatgaaaccagctggtggctattcccaacaggacttgtgctatgcaaatgcattcaagcaaggcttgttgattggcatgtatcaatcttagagatccaggaccgcgcagtttatagcaatgacccaacaatattttggcagtgatga

SEQ ID NO: 171 - DNA, 3910 bp, Setaria italica
agctgcgagtaaggttggtcggagccgttgcggattttgcggatggctggttctgcagttacggatgattctgcggcaagcacagctgggatgagggatgacgaacgcagcctgtccggcgagtccttgtccgagtggagatcctgtgagcgggcagatagcgacagcccttcgacgtccccgcccttctgggacacggacggcgaggatgatgaccctggccccaagccttcggaattattcggacgttacacctggaaaattgaaaacttctcaaaggagaaaaagagagaaatgaaaagtgagccgtttgaagctggtggttacaaatggtatattcttgtgtatcctcagggatgtgatgtctctaatcatctttcgttgttcctttgcgttgctaatcatgacaaacttctcccaggatggagccattttgcacagttcactatagctgtaggcaatgtagatcctaaaaagatgaaatactcagatactttgcataggttctggaagaaggagcatgattggggatggaaaaagtttatggagttgtcaaagattcaggatggttttcttgttgatgatgttcttgaaatcatagctcaagttcaggttatcagggagaaagtggatagaccttttcgttgccttgatcgtccttatcggagagaattgcttcgtgtctatatgacacaagtggagcaaatataccggcgttttgttgaggagcgacggagtaaacttagcaaactcattgaggacaagacgagatggcccagcttttgtggattctggtcagcaattgacccaagcaccaggcgtcgcatgtccagggaaaagactgacactatattgaaagtcttggtgaagcatttctttgtagagaaagaagttacttctacattagtgatggactctttgtatacgagtctgaaggcacttgaataccaggtgaatggaaagaaaggcagtacaaaagtatcagacttggaagaactacctgcacctatggtccatattgacatggacatgtttgttttggctggtgatgttatacctttgattaaaagagcagcctcagagcccttgccttgtcaacctttagctcccaaggatgacaaaacttcccaaagccgcatgaaggatggaactgctggcgaggtttacaaagtttctatggagcgtgaggaaagacgcctaactgaacttggcctgaagatacttgaaacatttgtgctatctcatatatttagtggaattgaagttgcataccaagaagctgttgctttgaaaagacaagaggagcttattcgtgaggaggaggaggaggcagggcttctcgaaaatcatatgaaggggaagcgtggtggtggagcaaatgaaaaggacaagcgtgcgaagaaaaagcaggccaaacaaaagaagaacaatcgtaaggttaaagacagggaaagagatgagaaatgtgaagtgaaaattctggaaagatttcacgatgaaattgcaatcgataatagtgatggtttaccagtggtggaagtgacagcaaaggttgatgccttggaagaaggttcttcagatggatcagacatgccaaatagagggaaaaatcagcataacaagggcttaagcattgttggttttgccgaagaaggtgatggtcttccctccacctctagtgttgctggtggtttaggccgcaatagttctggcttctgcaccgttccaaaattggatcaggatactgttctacttaccttgagggataaacttcgtaagctagggcagcgtctgcacgagaagaacattgaggggcaaaaacttcttaaagctcattttgaagctagggatgcgaaagcaaaggaagcagagtcttccaactcatccagttctttggagaagccacctgatgttccagagagcccaaagcattcctcagaagttgcagttgatctaaaagctaatggaatgccaactaaggatgtctctgtggtcaattgcatgccagaggaagctgtttcaggcataccaccccctacaaatactgaagctgtgactgctcctgccacagcaaaaattgatctagtttcaaacaaagttaatggatcgagttcaaaaatgaaaggcaacacagcatctaaaccaccagcagttgatgtggataaagatgcccctcttccttcaaaatcaccgcgaatcaatagagctgcttcagttcccccaaaactgcctttggttgataaagtgactccagttcctcccaaatctccacccataaacaaagcaccggcagttcgccccaaatctccagcaattgacaaaacaactcaagttcgtccaaaatctccagctgtagacaaagcagctccagttcgttcccaatctccagcagttgacaaagcaacacccattcgccccaaatctccagcagttgacaaagcacctccagtttgccccaaatctccagccagtgacaaagcaacgccagttcttcccaagtctacaccagttgacaaagcttctccagctctggtgaaatcaccaacaggtggtaaagatgcttctggtccttcaagatcatcagtgcatgagaaatctattccagctcccccaagactaccacaagttgataaagcagccctgccatcctcagaattgccacaaacttcttcagacgctaactctgaagctccagaagcagctactttcaggaaggtcacagccaacttagtttccgaggttacagcatcgaggccttcaagtgcacctgtgttccccacaccaagatcaactgcaccaactacttcacatgttcacatttcttcattgctttcttgctctatgagtgaagcagctggacgatcagtaaatggtccctccccttctgccccaccttatactcctcagacataccgtaatgccattgttggtaaggctggcctgtgcacaacatctgcaagcctttcatatcactcaacttctctgagccaagataccaccctttcgcagcctttgtcggcatatgcatcaagtacagcagttatgatgcctcctgctggaagacctgatcagttgtcaactaggcatgtgttgaagtctgggctgggcaaattagaagcacatgacagctggcagcagtggaaaggtgatagtaacattaataagcatctctggagggatcaggctccttaccaacaaatgaccaatggtcaagcatatgaacaaccacggagggatgatagttatcagcaagcaagtagcagaggaacagaaaagctcagcaggtatggaggactgcaatctaggcagttccaatctgggacaagcgatagccatgtctggcaccaacagcagggaccagtaccagaagaatttccacaccttgacatcataaatgatttgcttgaggaggatcatatcaacagcaatatgccagattcattccgtcaagattaccatgcttttggccggccgttttcgtcgagaggcaacttggcagatatggagatggcttctgttagtagccctggtcggttcaattcaaccgaccattactacgatgatggattctcaaggtcctatgacatgagtgccctccatgggctgagggaaaggcaatttccctcgatgggtacttattctaatggcctgtccgacataagtgtttcaaagccttggctgaatggctctcctaatccagcggtgagtcttggagctaacacaaatggataccaccaccaggttggtgactacactaacctggggggcggggtgaacggagtctccgtgtggcgccgccatgccaacggtcgctggtaatgggaggtcctgtatacagtcttacagtcggaataatgcttgttgtaacagatgatgggttccgggcctgagctggtgtgccatgtaattt

SEQ ID NO: 172 - DNA, 1412 bp, Setaria italica
ctccctcaggtcagtccaatccggaggagttgggagagtggccatccgcgagaggaggatggcgagcagcaacggcaagccggcgcagggggaggaggggagggcggcggcggaggggtcgatcggcgggtacgagtccctgcacaggctcctggaggccaacctctcccccgagctcttccaggaagcaagccgattgttgttgggtctgaattgtgcacgacctcttgaggctatctcactgcctgaagccacaaccactcttgcggaaacgcacaattttgatgtgcaggccttccgttttagtgcagacaaagagtttctgaggcaaccacgagttgttcgagttggtctaattcaaaactcaattgctgttcccactacttatcattttgctgaccaaaagaaggctatcatggacaaaattagacacatcgttgatgctgctggtgcttctggtgtcaatattttgtgcttacaggaagcctggacaatgccttttgccttctgcactcgtgagaaaagatggtgtgagtttgctgaaccagttgatggagaatctactcagttccttcaagaacttgcacaaaagtataacatggtaattgtgagcccaatccttgaaagggatgtaaaccatggggagactatttggaatactgctgttgtaattggaaataatggaaacataattggcattcatcggaagaatcacatcccaagagttggtgatttcaatgagagtacatactacatggagggtaacactgggcatccagtgtttgaaacagcttatggtaaaataggagtgaacatttgttatggaagacatcatccccttaattggcttgcatttggcctcaacggagctgaaatagtgttcaacccatctgcaactgttggtgaactcagcgaaccaatgtggccaattgaggcaaggaacgctgcaattgcaaacagctactttgttggatcaattaatcgggttggcacagaagtgttcccaaatccattcacatctggtgatgggaaacctcagcatgcagacttcggccatttctatggatctagccatttctcagcacctgacgcttcttgcaccccatcactatcacgctaccgagatggcttgatcatctctgatatggacctcaacctatgccgccagatcaaagacaagtgggccttccgcatgactgctcgttatgagatgtatgcttccttgctatcagagtacttgaaaccagattttaaacctcaagtcattgttgatcccttgattaacaagagggcataaaactgaggttgcatggatttaaaaggaggccatttgtgctgggacttcaacagcacgtgtttacagtttagcagaataatctctttgaaggtgcagacggaaggaagtctctgtt

SEQ ID NO: 173 - DNA, 1610 bp, Setaria italica
tagggtttcctccttctgagctagcggatagcggattcgatctcctcccctcccgctgctctgtctctcccccgcccgcccgccggccatgttctcgcacggcgctgattccgcacacgacgccgggggcgtcggcgtcagcaccgccggagccaccgtccccgcccgctttgtttggccctacggtggcaagagggtcttcgtatcaggctcctttaccaggtggtcagagcatttgcaaatgtctcctgttgaaggctgcccctccgtatttcaggctacttgcagcctgtctccgggaatgtaccagtacaagttctttgtggacggggagtggcggcacgacgagcgccaacctactgtatcaggagagtatggcatagttaacactctatacttgacaagggaaattaatcaaataaactcagtattgagcccaagcacacctggaaccaggatgaacatggatgtggataatgaaacttttcaacgtacggttacggtgtcggatggtaataatcaagaaggtcctcttagagtttcagaggctgctatacaaatctctaggtgccgtgttattgaatatctgagtttgcatacaggctatgatttgcttccagattcgggcaaggttattgctctggacattaatttacctgtgaaacaatctttccatatcctgcatgaacagggaattcctgtagctcctctgtgggattcgttcagaagtcagtttgttggccttctgagcccattggatttcatactcatattgaaagagctagaaactcatggctcgaacttgacagaggaacagcttgaaacacacactatatctgcatggaaagaggctaagcggcaaacttacggaagatacgaggggcgaccgcatcagcctctagtgcatgccaccccttatgagtccttgagggacattgctctgaagatattgcaaaatggcatttctacagtgccaattatttattcatcatcgtcagatgggtcattcccacagctgttgcatcttgcatccctttccggaattttgaaatgtatctgtagatatttcaaaaactcaactggcaatttgcctattctaaaccaaccggtgtgcacgattccactgggttcctgggttccaaaaattggtgatccaaacagtcgtccattggctatgttgcggcgtactgcatcacttagctctgcccttaacatgttgattcaagctggagtcagctcaataccaattgtggatgataatgattcgctggttgacacttattccagaagtgacatcacagctctagcaaaagacaaggtctacacacatgttcgcctggaggagatggccattcagcaggctttgcaacttggacaagatgccaatacaccttttggttatttcaacgggcagaggtgccagatgtgcctccggtctgatcctttgctgaaagtgatggagcgactgtctaatcctggggtgcggcgggtgttcattgtggaagctgggagcaagcgtgtggaaggcataatatcgctgagtgatattttcaagttcttgctgagcttgtgagaagagcatggcatagatggtttgttgtgacaagtgc

SEQ ID NO: 174 - DNA, 1472 bp, Setaria italica
tacaaagtagccgatagccacccattccatccaggccgcctccaccccgtatccaccccgtctcgcggcctccctgccgctcctgccccccggcaatggctcggctcgtgctatccgagtgctgcggcctcgcgccgctccgcctgcgcgcgggccggggcgccattgcggcgccgtcggcccccgcatcgctctccgccgcggcgctgccgcggcgcgggcccgcggccgcggccatccaccgcgactgggcgctccgcgtatccgcgcccacgcgcctcacctcgacggtcgagggggaggacagggggagctccccgctgggggaggaggccgcgggcggggagttcgaccccggggcgccgccgccgttcgggctggcggagatccgcgcggccatccccaagcactgctgggtcaaggacccctggcgctccatgagctacgtgctgcgcgatgttgtcatcgtcctggggctggccgccgccgccgcgcgcctcgacagctggctcgtctggccgctctactgggccgcgcagggaaccatgttctgggcgctcttcgtcctcggccacgactgtggacacgggagcttctcaaacaaccccaagctgaacagcgtggtcggccacattctccattcctccattcttgtcccataccatggatggaggattagccacaggacgcaccatcagaaccacgggcacgttgaaaaggacgagtcctggcacccgctaccagagagcctgtacaaaagcctggacttcatgactcggaagctgcggtttaccatgccattccccttgctcgcattcccgttatacttgtttaaaaggagtccagggaagaaaggatcacacttcaacccaagcagtgacctgttccaacctaatgaaaagaaggatatcataacatcaaccgcttcctggctggctatggttggtgttttggctggtctcacctttgtgatgggacctattcagatgctaaagctctacgctgtcccatacttggtatttgttgcttggctggatatggtcacatacttgcaccatcatggccatgaagacaagattccttggtaccgtggaaaggaatggagttatctgcgtggaggactgacaacgctcgatcgggattatggattgatcaacaatatccatcatgacattggaactcatgtcatccatcaccttttccctcaaatcccgcattaccatctcattgaggcgactgaggcagcaaagccagtgcttggcaaatactacaaagaaccaaagaagtcgggtcctctcccgttgcatctatttggggtgctagcggaaagcttaaagcaagatcactatgttagcgataccggagatgtactctactatcaaactgacaagaaaatgacataaaccatagcaagtagcgaattcttcattcttctcaggggggctgtgcctgaagacttgaccaccttctag

SEQ ID NO: 175 - DNA, 1112 bp, Setaria italica
tattgctgtccctgcttggttgggttcaggaggaagaggagggagtgggagatgatgttctggagggacggcggcgggagcgggagcgggagcgggagcgggcgggactccctcagcggcgggccgccctgcggccaggtgcgcgtcctcgtcgtcggcgactcaggtgtgggcaaatcttcattggtgcatctcttattaaatggttctgcagttgctcgaccagcccaaacaattggatgtgcagttggtgttaaacatattacttacagtagcccagggagttcatctaatagcatcaaggctgatgctgaaagaaacttctttgttgagctttgggatgtttcaggacatgagcgctacaaagagtgccgttcactcttttattcacaaataaatggtgtcatctttgtttatgacctctctcagaggaagacaaaaacaaatttgaacaaatgggcagtggaggttgctgaatctgggaccttttcagctcctcttgggtctggtggtccaggtggccttccggttccttacctagtgattgctaacaaagtggatattgctccaagagacggtagaagagtgagcagtgggaatcttgttgatgttgctcgtcaatgggttgaaaaacaaggcctacttccaccaagtgatgaacttcctctcgctgatagcttccctggcaattctggtctgctcacggctgcaaaagaggcaagatatgataaagaagctctgatcaagtttttccgcatgttgataaggagaaggtatttttcgaatgagcttcctgccccgagcccatggtcactcacttccagagaggataccatccttcctgtagaaactgtgaatgatgatgacctgttccaaagaaaaagctacgggagtcagagctacaaatacaatggggttgctccactgcctgcacagcgaaacctaactccaccccccacactctatccacagcagccaatgtcatcttcatcagagaactacagatatcacagattctcctcttcatcaattcctgattcaggcggtggtagaccaagccgagcagacatcaatatatgatgacctgggtctttagccattaccacctggaa

SEQ ID NO: 176 - DNA, 894 bp, Zea mays
acgggaagacaagggtgaggaattatgagtgaaacagggcacactgtacaagtcactaacctctcgagcagagtatctgaaagtgatcttcatgagttcttttcgttctctggtcctattgagcatatagaacttatcagatcagaaggatacggtgccactgcttatgtgacattcaaggaacgctttgccttggaaactgcagtattgctcagtggggctactattgtggatcagccagtatgcataacctattggggacaacctgagggaacttttaatttctgggacaggccaacttgggaggttgaagaggaaatcgaatacaggaactaccaaacatgccagtacaacactactccgcaggaagcttttacagtggctcaagatatcatgaagacgatgctagaaaaggggtacgtgctcagcaaggatgctttggctaaggctagagcctttgatgagtcctatggattaacagctgcagcagcagccagggctgcagagctgagcaagagaattggtttaactgatagggtcaatgctggtgttggtgcaatgcgatcagtcgatgagacatatcgcgtaagagagacaaccaagacggttgctactgccactggaagaacggcagcaaaggtggtaaatggcatcgtcaccagcagctacttctctgcaggagccatgatcttgtctgatgctcttactagggctgccaaggccgcggcagatctggccgctcatggtaggcagaattaagtgaaaaatagacataaagttcatccttgcagttactaaacatgaggacgaacaccttcaagtgatgttgcttgatgtatatttatgacacaacagtgtcgtaaattaaaaggagacgatcactgcgtttggaac

SEQ ID NO: 177 - DNA, 2687 bp, Zea mays
tccaagtctctcttcttgctgcaggctgccccaagcccaggctcaatccggctggacgaggagacggcattgctcgcatcgcctgccctgccctgccccccatgcgtgttgtgcgcatgaacagaggctaggctaccaacaacgcatagcatagccatggatcccgagttcggcgtcggcacggcgccacaaaaggggcggcgggcgtggcggacgacgctgctgctggcgtaccagagcctcggggtggtgtacggcgacctcagcatctcgccgctgtacgtgtacaagagcaccttcgccgaggacatcacgcactcggagaccaaccaggagatcttcggcgcgctctccttcgtcttctggacgctcaccctcgtcccgctcctcaagtacgccaccatcgtcctgcgcgccgacgacagcggcgagggcggcacgttcgcgctctactccctcatctgccgccacgccaatgtcagcctcctccccaaccgccaggtcgccgacgaggagctctccacctacaggctggagcgcccgcgcgaggccgccgggaggtccggcctgctcagggcgtggctggagaagcacacgaggctgcacaccgcgctgctcgtcatggtcatgatcggcacctgcatggtcatcggcgacggcgtcctcacgcccgccatctccgtcttctccgccgtctcagggctcgagctctccctgtccaaggatcagcatgaatatgccgtcatcccgataacctgcgccatcctggtgttcctgttcgcgctgcagcactacggcacccaccgcgtggggttcctcttcgcgcccatcatcctcgcctggctgctctgcatgagcgccatcggcctgtacaacatcgtccgctggaacccccagatctaccaggcactcaaccccatctacatgatcaggttcctcaggaagaccaagaagtccggctggatgtcactgggaggaattctgctgtgcatgacagggtcagaagcaatgttcgcggatcttggacacttctcctacagcgccatccagcttgctttcacttctctagtgtacccttcactgatcctgggttacatgggccaagctgcttatctgtcccagcaccataaccttgacgcaagctaccagatcgggttctacattgcagttcctgagtgtgtacggtggcctgtgctggtgctggccatcttggcgtccgtggtgggcagccaggccatcatcagcgggaccttctccatcatcaaccagagccagtctctgagctgcttccctagggtgaaagtcgtgcacacgtctgacaaagttcatggccagatatacatccctgaggtcaactggatcctcatgatcctctgcgttgctgtcactgttggtttccgtaacaccaagcacatggggaacgcgtctggcttggccgtgatcacggtgatgctggtgaccacgtgcctcatgcccctggtgatcatgctgtgctgggaccgctccccctggctggccctcgccttcttcctcttcttcggctccatcgaggcgctctacttctcggcgtcgctgatcaagttcctggacggcgcgtgggtgcccatcctcctggccctcatcctgctcgccgtcatgttcgtgtggcaccacaccaccatcaggaagtacgagtacgacatgcacaacaaggtgaccctggagtggctgctggcgctgggcgacaagctgggcatggtgcgcgtcccaggcatcggcctcgtctacaccgacctcacctccggcgtgcccgccaacttctcccgcttcgtcaccaacctgccggcgttccaccgggtgctggtcttcgtctgcgtcaagtcagtgccggtgccgcacgtgctccccgccgagcgctacctcgtcggccgcgtcggcccgccgggacaccgctcctaccgctgcatcgtgcgctacggctaccgcgacgtgcaccaggacgtggactccttcgagacggagctcgtcgagagcctcgccacgttcatcaagctggacgcgctgttccgctgcagcgacgccgccggcgaccagcagcgggacagcagctactacgagcgcgagaacgcgctcacggtcatcgggagcaacccgctgcggcgccacctggccctgggctacgacgactcccactcccacgacgacggcgcgtcgtcagctggctctgaccgcgtggacggcatagagctcgccgcggcggcgccggcgccggcggtcgttaagaagcaggtgaggttcgcggtggctccgcccaggagccccggtgtggacgagaccgtgctggaggagctgcacgagctgtgcgaggcgcgcgaggccggcacggcgttcatcctgggccactcgcacgtgaagaccaagcccgggtcgtcgatactcaagaggctggccgtcggcgtcggctacaacttcttgcgacggaactgccgcggcccggacgtggtgctgcgcgtgccaccggcgtcgctgctcgaggtgggaatggtgtacgtgctgtaaccagaacgtggcggtgatgggtgactgcgatctctgcgtccggttttcgctgcgtgaactgcggatctctctgctctgcgatgtgctattcctattatgcacatctcgacttgcccatgtataaattgtaacgagatgcgatggtaaca

SEQ ID NO: 178 - DNA, 1772 bp, Zea mays
agggagagagatttggtcttggataagagtggagagactggagacgggtgggtggagtgagagaagtcactcggggagcctccagattctgaatctcccgcaacccgtctcatcgccggagtggagttccaggcgagtgattatcgagccagtaagccatttgcaagcactgaactgaaccctcagagcgttgttgcgatggaccaaatcgctacccccgacgaaacagcacatgcctctgcaccttcagttcataagctgtttgatgctaaattaggccaccatagcgtgatggatggcaccttggcatccacgagtcagtcatcaaacatcaagacccagctgatccggtcatcaagcttgtcaaggagcatatcagttaaccttgagaagaggagccctgaatctgatcctgaaagcccacagtctcacgtctcgcatcctaaatttgcagaacccatgttctcgaattcttcgacgttctgcacaagcttgttttcgtcatcttcgacaacagagccatgccgtcaaatgggcactttacctttcctgcctcacccccctaagtgtgagcagcaggtttcagctggtcactcatcgagctcctctctgcttttaagtggtgataccggtttagatgtggctgaacagtcagatgatctgaacgacttgctcaatctttcgggagatgcttctgatggcagcttccatggagaaaacaatgccttagcttttgacgaacagatggaatttcagttcctgtctgagcagctagaaattgccatcactgacaatgagaagaatcctcatttagatgacatatacggcacaccaccacagctgtcatcacttccagtatcatcttgctccaatcagaatctagggtcaccagttaaagtccagcttagctcatctcagtcatcttctagctctgcaacagctaacaagtcaagattgaggtggacacttgagcttcatgagcgttttgtggaggccgtgaaaaagcttgaaggtcctgaaaaagcaactcccaaaggtgtgctgaaactaatgaaggtagaaggtctaacaatttatcatgtgaagagccatctgcagaagtatcggcttgcaaaatatattcctgagcctaaagacgataagaaggcttcctcggaggataaaaaagcacaattaggaaagggcagcattgattcaagcaaaaacaagaatttacaagtggcagaagctctaaggatgcaaatagaggttcagaaacagcttcatgaacaattagaggtgcaaaggcagttgcagctacggatagaggaacatgcaagatacttgcagaaaatactagaagagcagcagaaggccggcaatgtgccactaaaagctccaaccaaagcacaagcaacaaagtcgtcacctgaatcgacgtcagacgagagaactgaatccgaggtagacaccatttctccgcggccacccaagaacaggaacccgggtgtagacgcagaatgcaaatcgccgggaaggatcaagcgaacgaaggttcaggctgatcttgaaaacgagggcctgtgttcatagcgagggctcatgttcgtagctgtgcgggctcgccagtgattttctgaacatttgcacttcccgttttagttcaggagctatttgttactgtttgtaacttgaacagccgtagtatctccagcgatctgttgatatcttggcgtgaattggacttgacatcttagccattgtattatatagtaattcgcctttggaatgga

SEQ ID NO: 179 - DNA, 1129 bp, Zea mays
catattcgccaaacgcatcgcatcggcctcggccaccggcgcggctgccctcctcctcctcttgtccgtcgatccggagaggactttctctcgcctgctcgtcccttccgcccccgccggccggccggtcctcttcccggcccactccgttccgatcgaccatggcggctaccgcccccaatggcaatcccactgtcagctccctcgcggcaaccgttccggtccaggcggttctgttcgacatcgacgggaccctgtgcgactcggatcccctccaccacgtcgctttccaagagatgcttctcgagatcgggtacaacaatggcgtgccgatagacgaggagttcttcatcaagaacatcgctgggaggagtgacgtcgaagctgcccagaacctgttcccggactgggagcttgagaaggggctcaaattcctagaggacaaggaagcaaaatacaggagtctggcaaaagagcgcttggtgcctgtgaaaggcctcgcgaaggtggtccagtgggtgaaagaccacgggtacaagcgcgcggcggtgaccaacgcccccaggatcaacgcggagctgatgatctcgctcctgggcctctcggacttcttccaggccgtcatcgtcggaggcgagtgcgagcagccaaagcccgcgccgtacccttatctcagggccctcaaggagctccaggtgtccgcagagcacagcttcgtcttcgaggattcgcctgccggtatccgggctggcgtcgcggcagggatgcctgtcgtcggtgtggcgacgaggaacccggagaagtccttggtggaagcaggagccgcgttgctcgtcaaggactacgaagatcctaagctctgggcagcgcttgaggagatcgacggagaggaagctaagctgaagaaggccagcgaatgatctgatatgacgatgagccattgattagatttattgcagattaaatctgcctccagcatgattctgttcctagttatgcgctgcggagagagctcatctcatcagggtatttatgagattctagcttcgtatattgtttttcttcttcttgattgaactgagatcaaataagacaaagctgctgtgccttgttgtgtgccatctgtgta

SEQ ID NO: 180 - DNA, 1238 bp, Zea mays
aaaggatcccacagtcggcatcacagaccagatccctgcgggtgcggcggccatggccgagaacttccaactccagggccggcacggcaagtcccgcgtccgcgtctcccgcgtctggcgccgcccggccgcggcggggggcgacgtcatcgttgagtggaacgtcgccgtcagtatcgtctccgactgcctcccctcctacacctccagcgacaactccgccatcgtcgccacagattccatcaagaacaccgtgtatgtcaaggcgaaagagtgcacggaagtggtgtccatggaggaattcgccgtgattcttggaaggcatttcacctcgctgtaccctcaggtttcagaggccacggtgactatcgtggagcgcccatgggagcgtgtgactgtcgacggaaagcctcattcgcatgggttcaaagttggtgttgagaagcacagcacagaggtcattgtaaaaaaatctggaagcctgcttataaattctggaattcaaggatactcgctgctaaagacaactcagtctgggtttgaagggttcgtgacggatcgctataggcttcttcctgatacaagggaaaggatagtagcaacagaagtaactgcttggtggaggtatccctttgaacatgtttcgcagctcccatcgaagccattctgcttcacgcagagatatcaggatgtaaagaaagtccttgcagagacgttctttggtcctccggatgttggtgtgtatagtccatccgtacaaaatacgctatacctcatggccaaggaagtccttacaaggttcccagatatatcgtcagtccagcttagaatgccgaaccttcactttctgcctgtcaacttggggagcaaagaagctccgctggtgaagtttgctgatgatgtgtacctgccgacggatgaaccacacgggacgattgaagcaaccttaataagccgtcccatgtcaaagctgtaaaaaaaatgtagtcgtcaggctggtattagactcctgcttcgtctccccagcatccccaggcttaaaatggacagtaagctgtaagggaaagataaactgtcataaatcgtagcccctatgctttatgtgtggtggtggtaataagtgcacagacttgtattggatgttgtcagctgtagcctgtaggcgtccagcttgtgacgtttcgccactgtaatcgtgtacattgctcgtcttgtgtggaaaccagttaggtaccttt

SEQ ID NO: 181 - DNA, 2980 bp, Zea mays
ctcgctttcgttgtcatgaggagcctcaccgtggcaagccgccacccgggcgccgctttctctacccgccgccgcccccttcttcaccccgccgcagccggaagggactcgaccttccagcggtgctggcgatgggaaaaaactcaggacagctccttcgggagctcactaaggaccagccgccttccaagaactgtgcacggagatattttgaagaatttgctcgcaccaactgctggtgctgtttcagttgagcaagctgaagctattgctgacctcccaaaaggtgacatgtggtcggtgcacaagtttggtggcacatgcatggggacctctgagagaattcacaatgttgctgatatagtccttcgtgatccttctgagaggaaactggtagttgtatctgcaatgtctaaggttaccgacatgatgtataatctcgtaaacaaggctcaatcaagggatgattcttacattgctgtactggatgaagtttttgataagcatatgacaacagcaaaggatttgcttgctggagaagaccttgcaagattcctgtctcagttacatgcagacatcagtaacctaaaagcaatgcttcgggccatatatatagctgggcatgcaacagagtctttctctgattttgttgttggtcatggagagttatggtctgctcaaatgttatcatatgcaatacagaagtctggaacaccatgcagttggatggatacaagggaagttctagttgtgaatccgtcaggagccaaccaggtagatcctgactatttggaatctgaaaaacgacttgaaaaatggttttctcgatgtccggctgagacaataattgctactgggtttattgcgagtacacctgaaaacatcccaacaaccttaaaaagagatggaagtgatttctctgcagccataattggttcccttgttaaggctcgccaggtgaccatctggactgatgttgatggggtatttagtgcagatcccagaaaagttagtgaggctgtaatcttaagcacattgtcgtatcaggaggcctgggaaatgtcatattttggggcaaatgtcttgcatccacgtactattatacctgtgatgaaatataatatccctattgttataaggaacatattcaatacttctgcccctggaactatgatctgtcaacagcctgctaatgaaaacggtgatttggaggcttgtgtcaaagcttttgcaactatagataaattggctttggttaatgtcgaagggactggaatggctggtgtcccaggtacagcaaatgccatatttggtgctgtgaaggatgttggagcaaatgttatcatgatatcacaggctagcagtgaacactctgtatgctttgctgttccagaaaaggaagttgcattggtttctgcagccttgcatgctaggtttcgtgaagcattggcagcagggaggttatctaaggttgaagtcattcataattgtagcatccttgctactgtcggcctgaggatggcaagtacacctggagtcagcgcgaccctttttgatgcactagctaaggcaaatattaatgtaagggcgatagctcaaggttgcagtgagtacaacattactattgtactgaagcaagaagactgcgtgcgggctctgagagctgcccactcaaggttcttcctctccaaaaccacactggctgttggcatcattggacctgggttgattggtcgcacactacttaatcagctgaaggatcaggctgctgtcctcaaggaaaatatgaacattgatttgcgtgtcatgggaatagctggttctaggacaatgcttttaagtgatataggagtagatttgacccagtggaaagagaagctacaaactgaagcagaacctgccaatcttgataagtttgttcatcatttgtctgagaatcactttttccctaacagagttttggtagattgcacagcagatacaagtgttgcatctcactattatgattggctaaagaaaggaatccatgtcatcactccaaacaagaaagcaaattcagggccacttgacaggtatcttaaacttagaactcttcagcgtgcatcatatactcattacttctatgaagcaactgttggtgctggcctccctatcattagcactctgcgtggtctcctagagacaggtgacaagatattgcgcattgaagggattttcagtggaacgttaagttatatttttaacaacttcgaaggagcaagaacctttagtgatgttgttgctgaagcaaaaaaagcaggatacacagaaccagatccaagagatgatctgtctggtactgatgttgccaggaaggtcataattcttgcaagggaatctggtttggggcttgaactttctgatattcctgtacgaagtcttgtgccggaggcacttaagtcatgtacctcagccgatgaatacatgcagaagttaccatcttttgacgaggattgggcaagagagaggaaaaatgctgaagctgcgggagaagttctgcggtatgttggagtggtggatgtggtcagcaagaaggggcaggtggagctgcgagcctacaagagggaccacccgttcgcgcagctatctggttccgacaacatcatagccttcaccacctcgaggtacaaggatcagccactgatcgtgcgaggtccgggggctggtgcagaagtgactgcaggaggcgtcttctgcgacatactgcgcctgtcttcctaccttggtgccccctcgtagtctgtcaaggttttgcggtgccgtggtgttgtgttgctgctctactactggttttttttgttgttgttagtgcttggaatagctggagtaagtatggattaagtgagttctggggtgttaagggttgggtgtcttagttagaaggtcgtattggagggaatggaatccgttcaccgtgttcttgcgtgttgcaataatcttg

SEQ ID NO: 182 - DNA, 642 bp, Zea mays
aaaggatccccaactcgaacctgagtacctgagaaatggcggccgtctcctccacctcaaccgccgcctcctacttctccccgcagccgcagctgccgatctccaccgccgaccctgccgccagcaaaagtaggttgatgcggcagccacggcggagcagcagcttcgtgatggtggaggcgtcctctgccagcggcagcgacggcggggtggccaggacgaagagcctcacggaggacgacctggaggagctcaagggctgcctcgacctcggcttcggattcgcgtacagcgagatacccgagctctgcgggacgctgcccgcgctcgaactctgctactccatgacccggaggttcctcgacgagcagaaggcgccggggcaggaggaggagttggagcctgcgtcgccgccgctccccaattggaggatctctggcccgggtgacgatccagaagaagtgaaggcgaggttgaagtattgggctcaagctgttgcatgcactgtcaagctctgcagctaaactaaaggtcggatagaggctgaagaatctggttatatggttttgggatacagggagcggaagggggtgcttctgctctctggcatggaagcgacatgagtgatctcatgaattcttt

SEQ ID NO: 183 - DNA, 842 bp, Zea mays
aaaggatccctctagagtaaatcccggtgctaccgacggcggcggcgacgaatcgagcaggcgcggcggccatggcggcggcggttgagagcgtggtggtggtccataacgtggcgaagcggcacaacgtggggacgctggcgcggagcgcgacggcgttcggcgtcgcggaggtggtcgtcgtcggccgccgcgatgtcagcgcctttggcagccatggcgccacctcgcaccttcgcttccgtcacttcgtctctctcgcgctcgcccgcgcctacctcaaggatgagagaggatgtgacatttgcggcgtggaaatcaccgacgacgcgcagccggtgaccgcccacccgttccgtcggagcactgcgttcctcttcggcaatgagggtactggactttcacaaaaagagtgcgagatctgtgacttctttgtctacatccctcagtatggtggtggaactgcatctctcaacgttactgttgcagcttcaattgttctccaccactttggggtctgggctggctttactgaacgaggccgagagggcaacaaattcgtggtggctgaaagaccacaggggcactcgaggggactttactgtacagactcggttgaagcagtggttgaagagcggaaaatgcgaaaagaaaatgcctgcgatgtactcgaggaaaatgggagcagccatcctcaggaatcaaacggtctagacttgatgtttgcagactagagtatgacaacatgttatcccatctctgatgttaaatctactccctgcatccgcattgatggcacgaagttgcaatacagaacatgacagggcttatgagaattcttt

SEQ ID NO: 184 - DNA, 1168 bp, Oryza sativa
aaagaattccgtctcctcaactcagatctcccccatttcaactccctcctcctccactttcccccccgcatcgagcagcgaagcggcgatggcggaggagcagccgcgcgcggcggcggagggcggcggcgagacgctgatggagaagatcgccgacaagctccacatcggtggggacgggtcgtcgtccgactccgacgccgacgagcgcaagcagccgaagccctcggcgccgccggccccggccgaggtcgcaacggagtcgtttgttgattcggctgctgctgccgcggccgaggccaaggccaaggtgttccgcctcttcgggcgcgaggagcccatccacaaggtcctcggtggaggcaaacccgctgatgtgttcctatggaggaacaggaacatctctgccggtgtactaggcggtgccactgcgatctggatcctttttgaattgcttggctaccacctcctgactttcgtttgccatgggctcatattctctttgggtcttctctttctctggtctaacgcctcatcatttattaacaagtctcccccgcggatcccagaggtgattattccagaagatttggttgtcaacattgctctatctacacgttatgagatcaacagggcctttgccaattttcgtcagattgctcttggccgggacatcaagaagttccttattgtgattgctggcctttggttgctttctgttcttggaagctgctgcaacttcttgaccttggtttatattgtgtttgtggtgctgcacacagtcccaattctgtatgagaagtatgaagatcagattgactcatatggtgagaaggggtgggttgagattaagaaacagtatgctgtgttcgatgctaaggtcctgagtaaagtaccaaggggccccttgaaagacaagaagcactaggaagaggtgatgcagtgcctcgtggcaggtgatagtagtggttgggttgtggttcttgagatgcactgctgtcacctattgccttgtgttgtgcatggctcttttgttgtctgatcttgatgggagtagctgagtagcttgcgctacaacagtatgcagctgcagcgcatgctttgctccatcgctgtttgatttttgatctgtaagatgtcgcatgcatattgtttatgcaggcctttt

SEQ ID NO: 185 - DNA, 392 bp, Oryza sativa
gagctcaatcagcaacaacatctatctccttcttgcttagttaagtccttcgccctcccaagaagaagaagatgtcttgctgcggcggcaactgcggctgcggcagcggctgccagtgcggcggcggctgcggcggatgcaagatgttccctgatgtggaggccacagccaccaccaagaccttcgtcctcgctgctccatccaacaaggcgagctctggaggaatggagatggcggtggagagcggcgagaacggcggctgcggctgcaacacctgcaagtgtggcaccagctgcagcggctgctcctgctgctcctgcaactgaatctatcgtcgtcgtcgcccggctgcatgaggatttatcgtatggatgctgctactgtcgatcaga

SEQ ID NO: 186 - DNA, 2099 bp, Sorghum bicolor
actccatgttttttcgcgcgcggcgcgcggccgcacgacgaagccacacccacacgcccaccacacgcgcggccggccggacgcagtcggtcgcgatgggtttcttccagcaatgctccagctccagcagctccccgctgctccccgtgctgctcgcgctcatcggcctgtactgcgccgccgccgtctcgtgctcggcggccgccgcgcctctgccggcgccggagacgacgacgacgatgcacgagagctacgcgggcaagtcggagttcaggacggtgaaccggaaggagctcgactcgtgcctcaacccgagcccctacctggccatcaatgtcagcatcaccggcggggccggggccggggccggggccggggcggcgatccccgacgaggcgttcctccaggtcaccgtctccggcgtcctcaagcccgacgcctccgactgggtcgccatgatcacgccttccaactccagcgttgctggatgtcctctgagtggagtgaactacgtggagaccggcgacctggcgaatctcccgcttctctgccactaccctgtaaagtcccagtacctgacaagcgaccccgggtacatgggctgcaagaacgcggggtgcgggaagcgcgacgcgtccggcgcctgcaaggcccgcacctgcgccgccacgctcaccttccacgtcgtcaacttccgtaccgatgtcgagttcgtgctcttctccggcggcttcaagacgccatgcctcctcaagcggtccggcgcgctccggttcgccaacccggccagcccgctctacggccacctctccagcaccgactccaaggcgacctcgatgaagcttacctgggtgagtggagacgggaatccgcagcaagtgcagtatggagacggaaagtcatctacttctgaagtcgcaacgttcacgcaggatgatatgtgcagcgtccccgtgctgccgagccctgccaaggatttcggctggcatgaccccggctacatccactcggctgtcatgactgggctccagccatctcagtcctacacttaccgctacggaagtgattctgtgggctggagtgacagagttaagttcaaaactccaccagctgctggttcagatgagctatcctttgtgatctatggtgatatggggaaggctccactggacccgtcagttgaacactacattcagcctggatcaatttctgtgaccaaggcagtggctaaagagatccaaacaggaaacgtggactccattttccatataggagacatcagttacgccacaggcttcctggtcgagtgggacttcttccttcacctcatcacgccactcgcttctcaagtgtcctacatgacagctattggtaatcacgaaagggattatgcgaactctgcatccgtgtatgtgactcctgattcagggggtgaatgtggagtcgcctacgaatcatacttccccatgcctgctgtcagtaaggataagccatggtattctatagagcaagggaccgttcacttccttgtgatgtccaccgagcatgagtggtcggagaagtcagagcagtataattggatggacgaagatttgtcatcggttgatagatcaagaacaccatgggtgatcttcattgggcatagaccgatgtattcctcccatggtggtatactgcccaacgtggattccaactttgttgcctctgttgagccactcctgttcaactaccaggtggatttggttttcttcggccatgtacacaactatgagaggacctgtgcggtataccagggcgattgcaaaggcatgccaacgaaggacaaaaacggaattgacgtctatgacaacagcaactataccgcacctgttcatgtcattgctggagcaggagggttcaccttggacagcttccctaacaatggggaggcctggagcttatcaagggtttcggagtttggctatggcaaggtgcatgctacaagaaccgatatgctggttcagtttgtaaactcaagttcgatggaggtacgagaccaatttaggattgtgaagggagcttcggtaaacaagacaccgagcctgatacttcaataataa

SEQ ID NO: 187 - DNA, 1294 bp, Sorghum bicolor
aaagatatcgtagaggccgagagggagacgcggggaagctagctgctagcgtagccgggcgcggcgggcgtgggggctcgcgctgcgctgtcgctccatgtcggccaacggcgagagcggcggggatccggcggcggcgcgccgccggtgggatctcaccaacaaggggcccgagagcactccaatgttgaaagaggctgtggaaatgtctacagatgaagaatcagatggtgttgttatatgccatctgaatggtaacaccgatggatgcgacgaaaccattagtggtagtcgtgatgatgatagcccagaaggccaggaaactaattccattaaggaccctgatgtacaaggtgacacacaggaagacaagtgtgtaaatcaagattcactgaagttgattgatcaagagaagtctgctccccccaagtccccagcaaagtctgcgactgccagttctggatcggagaggcctaaacgtgttgttccccaaccattctctctttctacgcaaagaaggtcatcgggagtaaatggtggtgtgaccaatccatcggcaaataaggataaatctggtgataaaagtagcatatctccagcaagcatgacaaagaagagtacgccggtggcacctaagaagactttgcagcctgagcaggcatttcaccctgtggaagaggactcttgttctgtgacttcctcaactacaacatcaacaagagctggcagaactaagacaactgttcccgttgccccttcatttgtgtgtgctaaccgtgctgacaagaggaaggagttctacacaaaattagaggagaaacataaagctttggaagcagagaaggacgaggctgaggccaggaaaaaggaagagcaagacgttgctttaaaacaactaaggaagtcattggtgattaaagcaaaacccatgccaagcttctatcaagaagggcccccaccaaaggctgaacttaagaaggtgcctactactcgtgccaaatcaccaaaatttacaagttcaaggagaaagagctgcagtgatacaacacaaacacctgaggggaaaaataccaattcaacatctacccggtcacatcgtcacagcattgggacttctaaagacgctaacagagtacaatgctcgccgaagagtggtgtggcgaccaaaactagatccgtcaagcctgagctgaaggccctctgaagagcatggagcagccaagcgctgcgattgtctttgtacaaaccgaattgcctaactcttagccgtttccatttccattaggaattcttt

SEQ ID NO: 188 - DNA, 1127 bp, Sorghum bicolor
gagctcaggagagacccaaatcccttttccgctccgccggactccgagagagggcggcgggtgcgggacgcgaaggcgaagccctagctcccctccctgccgcggacgccgatggacccacctcgcgccgtcgccgttcttctcctcgtactccttcccgtgctcgccccggtggcctccggcgtgcccttcgtcgtcctgcacgggattggcgacgagtgcggcaacgatgggctggcatccttcaccgagatgcttggggagtggtccggctccaaaggttactgcattgaaattggaagaggagcatgggactcttggttgatgccacttcaagagcaggcaaatacggtttgcaagaaggtcaagaaaatgaaagagctcagtgaaggttacaatatagttggcctgtctcaggggaacttaattggcagggctgtaattgagtactgtgatggtggacctctggtcaagaatttcatatcaattgggggtcctcatgctggtacagcttcagtgccactttgtggttctgggtttgtctgtattcttattgatgatctgattaaatcagagatatattcagattatgtgcaggcacatcttgcccctagtggctacctaaagatacccactgatatggaagattatttaaagggttgcagatttcttccaaagcttaacaatgagatcccaagtgcaagaaatactacctataaagaaagattcagcagcttggaaaacttggtactgatcatgtttgaggatgatgcagtattaatacctcgggaaacagcatggtttggttattaccctgatggagcctttagcccagttctgccccctcaagagacgaagctgtatacggaagattggattggcttgaggaccctggacgaggctgggcgcgttaaattcgtgtctgtgcctggaggtcacctgcgtatctccagaagcgacatgaagaagtacatcgtgccttacttgacgccggaggcgtcatccaagcagagcgtacaccggatgctgtcgctttgagcgagccacgtgcgtatctagcaaggtctgtatcgatggccactctgccctgacacgtggaccctgtgttgacgccttgtaaatacgct

SEQ ID NO: 189 - DNA, 2006 bp, Sorghum bicolor
cttcaatgattagctctcatgcatttcttctctccctgcatggattagccatggtttccacacttataacaaacactgaagggcaagctttttgcccttctttctcctgtgggcatcttcaagacatacgatctcctttccgtatgcaaggtgatccacaaggttgtggttttccagagtatgagctggtttgcattgatagcaaggctataattcacatcaacagtggaagatactttgtgactaacatctcctacactgactctactttctgggttgttgatgccaatttggataatagcagctgtcccattcctgcgagcaaccaacatccctatataaatggtttgcaatccgaaggcagcaccttgctggatcctgatacagtaacttgggctgcctttatcacttgttcagagatgctaagtgatgttacttccttgttcagcagttgctgtagtggtatttacaggcctgtcaattgccgaagtacgaagaattcttttgtttatgtcttcactaccacattcttcccaatggttggatacatcaagccgtcatgtagatacttgtccatgattcctttgggcagtcgacatgtcaagcgaccagataatgcaagttatgaagatattgtaaaatttatgaggaatggcttttctgttgattttccttatagcagtggatggacatatcattggatcattaacttatgcctgaaagaggcaaagggttactacaatgataaaatatctaactcaagcattgtggatcagacttttgccaccgcttttgggatcgaccttcatttcttaagatgtgtaaatgattattcataccgaactaaattattttgggctgtggtcgccatgatatctgctgtggacattgtgaagttcgtgatagtgtttggaatgctatcgaggtttgtgtttgcaccattagctgtattgaccttcctcgcctacaaatactggaaaacaaggatatctattgatgcagttgagaagtttctccaaatgcaacaagctcttagcccaacaaggtatgcctataccgacatcactgcaatcacagggcacttcagagagaagcttggccaaggaggctatggatccgtgtacaaaggcatgcttccaggtgatgtcaatgttgctgtcaaaatgttgggcaattcattgtgcaatggagacgaatttatcagtgaagtgtccaccatcggaagtatccaccatgtcaatgtagtgcgtctcgtgggattttgttcagaagaaatgaagagggctctcgtctatgagtacatgcctcgtggatctcttgataagtacatcttttcttctgagcaaagattttcctgggataagctcaatgaaatagctttaggcattgccagaggaatcaactacttgcaccaaggatgtgaaatgcagatactgcactttgacatcaaaccacacaacatccttttagacaataacttcactcctaaagttgccgacttcgggctagccaaattgtacccgagggacaacagctttgtgccggtgagcgctgcatggggaactatcgggtacatagctcccgagatgatatcccgtaatttcggtgttgtttcatgcaagtcagatgtttacagcttcgggatgctattgctggagatggctggggggcgaagaaacttagaccaacatgcagaaaggagaagccagatgtactacccagcttgggtgtataatcatctaactcggcaagaggtaggcgagatttgcgaagcttttgatatccatgaggtggagaggaagctgtgtgttgttgggttatggtgcattcagatgaaatcacatgatcgaccaacgatgagtgaggtcattgggatgcttgaagctggcgttgatggtcttcagatgcctcccgagccattcttctgtggggatgagcagaattccgtaactggtactttccgtttgtcctcggagttgagtgcaatctcagagaatgaatgatga

SEQ ID NO: 190 - DNA, 2364 bp, Sorghum bicolor
agcgccgagggaggtatagccgtacagggggagagggtgggagatggctgccatggttggagcgcgcagggcgctcttagccgcccggttctcccctcgcggcgccatagcggcgtcggccaagcctgcgcccctctaccggcgcgtggattcgccgcccagacttccagctgaaagtgtttgtctccagtcttgggttccacatcgagcggctggcagctttgcatctgaaaggactgatgaagactatcagcgtgagtggggacaaaacaaagcaggtagctatgctgactcccgttcaaacggctctagcctccatattcagagagatgtcccttcagctggttccacaacaggtattcacacaaatagggctgtggatggtggtggcagttctgagcaacattacagaagtggtggatcatatggcttccgaaacagtcatcagccgtatactggtgcaagagcgaataatgagacatctggatataatgcatcacaaccttacagaggtggtggtgcatacagccagcaaggccttgatgggtactttccaaatgatcgccaacagtataatggcacagaagctaatagtacatatagctctggatacaacacccaaagtaaccagaaggtttatgaaagagagggagttaattatgggcagtacggatatggtccttcaggacaagcatgtccaaacccgattggaaataaccatcacattcagaaacagcaatatgttgatcatagatctggggaaagttatccggatagatcgcggaatcatccctctcagtatgtaaatccaactcatttccataaggagcatgttgcagggtttcagcaaggcaacaatagtaattttggatataatgcttcgcagtcgtatcaaagccctcatttcaataggcaagctgatatgcatagtactcctcaaggatattccatgtacctaaatacagatgtgcaacgcccctctcatggagttcatcaagaaaaacattcacatgcgcaatctgctggatcatttgggaaccacttaaacaatgcacctcatgaagatggcaaatatcaccagtcactgcagggcaacttttcaaatgttggattgccttatgaagtacctaaagccgtcggcaaacacaaaggtactgttgaagaactggagaagttttgtgaagatggcaatgtaaaagaagctttggaagttctggctatgctaaaggaaaacagaattgtgctacatcctcctcagtacttcagattgatgcaagcatgtggtgatgcagctgcactctcagaagcaagattaatacatagtcaaatatctgaatcatcaactgttgttgacacagattttcaaaacgaaattctaaagatgtatgctaagtgtggttcaatggaagatgcaaagaagcttttcagttctatggatcatcataatttgacttcttggagcactatgatctcaggttttgtgcataatactcttggtgaagaagcaatagattttttcgatcggtttaagcagacaggggataagccagatcttggtatgttcagacatgttttcctggcctgtggaattttgggatctgttaatgaaggaatgttgcattttgaatccatgcagaaagattttggcatacatcccactatggaacattatgcaagcattattagtatgcttggacagtctggctacattgccgaagcctatgaatttgtggaacagatgcctgtggaaccaagcattgaggtatgggaaaatttgatgaacatgtgtcgacttaatggctttttagagcttggagatcgttgcgctcaaatcatagagcgcttggattcttctaggctgaatgaacagtctaaaatgggtcttttccctgtcgatgcttcagaccttgcaaaggaaaaggaaagaaaaaaggcaagtgttgctgaagctcggagcaaggtccatgaatacagagctggagaccgatcccaccctgacactcctaagatctatgaagagctgaggtacttgttggctcacatgaaggaagctgggtatattgctgacactcgatttgttcttcacgatgttgatcaagaaaccaaagaggatgctttactggctcacagtgagaggctggctatcagttatggtcttataacaagtgctccccgctcacctattcgagttataaagaatctccggtcctgtggagactgtcacacggctttcaagataatctcgaaacttgtcggccgtcagatcattgcaagggatgcaaagaggttccaccactttgaaaatggtgtgtgctcttgcaaagactactggtaaacaagatgatagaagcccacatcttggtc

SEQ ID NO: 191 - DNA, 644 bp, Sorghum bicolor
aaaggatccagggtttcctcccaccactccttcccctccaaccccaacacccggcggcgtcgagcggcggcgatgacgacgagcctgaagaagaaccggaagaagcgcggtcacgtgtcggcggggcacggccgcatcggcaagcaccggaagcaccctggaggtcgcggtaacgccggaggcatgcaccaccaccgcatcctcttcgacaagtaccacccgggctacttcggcaaggtcggcatgcgctacttccacaagctccgcaacaagttctactgcccctcggtcaacgtcgagcggctctggtcgatggtgcccgccgacaaggtcgccgaggcggccggtggcgacaaggccccgctcctggacgtgacgcagttcggctacttcaaggtgctcggcaaggggatgctgccgcccaagcccatcgtcgtcaaggccaagctcatctccaaggtcgccgagaagaagatcaaggctgctggaggcgctgtcctgctcaccgcataggtcttctttttttgtatcttgtttcacctatctgtgctaagaaaatttctaaatttttcgtggatcatgtgttgtgagttatgagaccccaatttttgtgctcttggtaacgaatgcgaattgaattcttt

SEQ ID NO: 192 - DNA, 1700 bp, Sorghum bicolor
cagctctcaagttctctgcctctcttttttttttcagtttttcaagtaatccgattgttgtagttgcatcttcaatttaccattttaattaatttgcgtttgatctgttagttccattgcttcttctttgattgcggttagtatagtttcgctgtttgttgctccgtgcttcttgttgttctgttgcttctaaccatggacgcaggcacctactccatctcatcagagaagagccacaaggcggcgaaggcagcggcggcgccacggccgcctctccaggaggccggctctcagccctacatgccgtcgctgagcacggggtcgcgcaacccgtcggccaagtgctacggcgataggttcatcccagacaggtcggcgatggatatggacgtggcgcagtacctgctcacggagcccaggaaggacaaggagaacgcggcagcggcggcatccccatccaaggagatgtaccggaggctgctcgccgagaagctgctcaacaaccggacgcggatcctcgccttcaggaacaagccgcctgagcctgaaaacgtctcagcaaccatcgcggcttccgcccaccacgccaagccggccaagcagcggcgacacattccccagtctgctgagaggactctggacgcaccagagctcgttgatgactactacctcaacctccttgactgggggagcaacaacgtgctgtccattgctctgggcgacacggtgtacctgtgggatgcctccactggatccacgtctgagcttgtgaccatcgacgaggacagcggtcccatcaccagcgttagctgggctccagacggcaagcatatcgctgttgggctcaactcgtctgatgtccagctctgggacaccagctccaaccgactgttgagaactctcagaggtgtgcatgaggcaagagttggctcactggcatggaacaacagcatcctcaccactggcggcatggatggcaagatcgtgaacaacgacgtgaggattaggaaccatgtcgtgcagacgtacgaggggcacagtcaggaggtgtgtgggctcaagtggtctggatcagggcagcagctggccagcgggggtaatgacaaccttctgcacatttgggacgtgtcgatggcatcctccatgccatccgctggccgcaaccagtggctgcacaggcttgaggaccacacagctgctgttaaggcactcgcatggtgtccgttccagagcaacttgctggcaaccggtggtggtggtagtgatagatgcatcaagttttggaacacgcacaccggtgcatgtctgaactctgttgacaccggatcacaggtctgtgcccttctctggaacaagaatgagagagagctgctgagttcacacggatttacacagaaccagctaacattgtggaagtacccatcaatggtaaagatggctgaactcactggccatacttctcgtgtccttttcatggctcagagccctgatggttgcacagtagcatcagccgctgcagatgagacccttcggttctggaacgtgtttggagcccctgaagcgcccaagccggtcaaggcttcccacactgggatgttcaacagcttcaaccatatccgataggatgaatcgtgagaacaatctcctctgataggatgaatcgtgagaacaatctcctctgttagatatggtcgtgcagc

SEQ ID NO: 193 - DNA, 2117 bp, Sorghum bicolor
caggtgtacatcggtacctcgccaggtcttcttcggcccttcgccgccgacaagctctgccaggttgctgtgttaagttgtcacatggatccagcacaatatttccaacccaggacattctcaataaagttgtggccaccaagtgaaagcacacggctcatgcttgttgagaggatgacaaagaatctgtccacagagtcagagtccattttctctcgcaaatacggtactttgggcaaggaagaagctcatgagaatgcaaaaaggattgaagaactttgctttgcctcggctgatgagcatttcaaaagggagccagatggtgatgggagttctgctgtccagctatatgcaaaggaaacgagcaagatgatgttggaagttctgaaaaaaggccctaggactactgcagaactggaagcacctgtagctgatacacctctagtgcctgatacacctcttgtgcctgctgatacacctcttgtgcctgctgatactgtactagatatatctggtggcaagcgtgcttttattgaggcagatgaagcaaaggaactgctgagtccacttacaaaaccaggaaattcatatcaaagaatatgctttagcaacaggagctttggtattggcgctgctaatgttgctgggccaattcttgagtcagttaagaatcagctcacagaggtagatatctcagattttgtggcaggaaggcctgaggatgaagctcttgatgtgatgcgcatattctccaaagcattagagggttctgtcctgagatatctgaacatctctgacaatgctttgggtgagaagggtgtcagggcattcagtgagcttctgaaatcacaggaatccctggaagaactatatgtgatgaatgacggtatatcagaggaagctgcaaaagctctatctgagcttattcctgcaactgagaagctcaaggttcttcacttccacaacaatatgactggagatgaaggtgctatgtatatcgctgagatggttaagcgttctccaaatgtagagagtttcaggtgctcagcaacaaggataggatctgatggtggagtcgcattgtctgaggcattagggacatgcactcgtctgaagaaacttgatctccgggacaacttgtttggtgttgatgcagggttagctctcagcaaaacccttccaaagcttcctgatcttgttgagctttatctcagtgatctcaatcttgagaacgagggcacaatcgcaattgtcaaagccctcaaacagtcagcaccgcagttggaggtccttgaaatggcaggaaatgaaataaatgccaaagcagccccagatttggcagaatgcttaacagcaatgcagtcactgaagaagctgaccttggctgaaaatgaactgaaggatggcggtgctgtgattattgcaaaatcattggaagatggccacacagatctcaaggaacttgatgtgagcacgaacatgctgcagagggttggagctcggtgctttgcgcgggcagtcgcagataaaccagcttttgtgcaactgaacatcaatggaaatttcatctctgatgaagggattgatgaggtgaaggaaattctgaaggctggtaagaaatccctggatgttctgggctcactagatgagaatgaacctgacggggagcctgatgatgaggaagaggacgaggatgctgaggacaatgaggatgagctggattcgaagctgcagagtgtgaaggttgagcaggatgattgaccaagttggttttaagattccaccagttacctgaagttgaccaagggaaacgttagctgccaccgacacctcattggtgacagtgagcgccggaggaagccaccacctggacctctcacttcacgatatggcaggcttgctgcatcttgttttatagagttgtagacccatactcgtaattttcaaatgcattattcatagatttctagatcgggaaaatcatacagattttatgaagccatgtgctatggctcgaatatgccaatccgttgttcctcaaatcattgtttcttcggagcctggtaggtccagaagctccctgctcgactcgattgtttgtttcttcagagcctcga

SEQ ID NO: 194 - DNA, 2463 bp, Sorghum bicolor
acagccaaaccctagcctgaccgccgccgccatgccggacctcccctgcgacggcgatggcgtctgcatggtctgccgcgccgcctccccgccggaggtcgacctcctccgctgctccacctgcgccacgccctggcactccccgtgcctctccaagccccccgccctcgccgacgccgccagctggagctgccccgactgctcccccgaccccgccgccgccgccgctccctccggccccgccaacaccctcgtcgccgccatccgcgccatcgaggccgacaccaccctctccgaccacgagaaggcgcgccgccgccaggccctcctcgccggcgacgcccacgacgacgacgacgatgacgacgccgcggcagacgatgccctcgagatcgtcggcaagaacttcagctgcgtcttctgcatgaagctcccggaccgacccgtcacgacaccatgtggccataacttctgcttgaagtgcttccagaagtggattcagaacaggaagaggacctgtgcgaaatgtagggcacaaatcccggccaaaatggctgagcagccaagaatcaactcagctctagttgaagttatcaggatggctaagatttcaaagaatcctaactctgctggctctgcagttccgtatcactacatacgaaatgatgataggcctgataaggcatttacaactgacagggctaagaagtctggaaaagcaaacgcatcaagtggccagatctttgtgaccattgcacctgatcattttggccccattcttgcagaaaatgacccacgcaggagtattggtgttcgagttggggaaacatgggaggaccgacttgagtgcagacaatggggcgctcactttcctcatgtggctggtattgctggccagtccacgtatggtgctcagtcagtagctctttcaggaggatatgaagatgacgaagatcatggagagtggtttctttacactggaagtggtgggagggatctaagtgggaacaagcggacgaacaaggaacagtcatctgatcaaaaatttgagaagctgaatgctgctttacgcattagttgcttgaagggctacccggtcagggttgtgcggtcgcacaaagagaagcgatcctcatatgctcctgaaagcggtgtaaggtatgatggggtttacagaattgagaagtgctggaggaagattggtattcagggtaagttcaaggtctgcaggtatctctttgtacgctgtgataatgaaccagctccttggaccagtgatgatcacggtgatcgtccaagacccttgccaaagataaaggagctgcaaggtgcaactgatataacagagaggaaagggcgtccttcatgggattatgatgagaaagatggctggaaatggatggtgcctccgccagtcagcaagaagcctgttctctctggggatcctgagactgacaagcaaatccggagagcaacaaagcgtgctcatttgtctgttgctgaaaggctgcttaaagagtttggttgttctatctgccgggcagtgattaaagaaccacttacgactccatgtgctcacaacttttgcaagacttgtttgcttgggaaatatgatagccaatcctctatgagggaaagaagccgtggtggtcggactctaagggcacagaagattgtgaagacgtgcccttcctgcccaactgacatctgtgacttcttagagaatccccagatcaatcgagaaatgatggagctgattgagactttgcaacgcaaggctgttgaagaaggcaaggtggcttcagatgatgctgaggaatgtggtgatggtgactcggaggaaaatgatggtgctttggtgaagggagaggaggatgatagcggcttgaatgaggaagagcaagacagtgcagatgctgatgctaatgctgatggttctgtgaagattgtggttgaaatcaaggagggaggaaaagatgataaaaagtcagagatgggtgcgactgaagtggtggatgtgttagttgatgaagatgctgcgaaacagacgaagaagcgcaaggttgatgaagatgctgtgaaacagacaaagaagcgcaagggtgatgctgagactggcaccaacggtgccaagaggatgaagagcagtgctgctgtggaagaggttgctgtgtgtggcactcctgtgaaacggaccaggaagagtggtgatatggatgctgaaggcaacggcagtcctgctgtgagcagtggccgcagggtgacccgtagcagcagtgtgaatgccactggagctgatgatagtccggcgaggaggaccagaagccgtgctggagctgatgctggttgctgaaggggtagaggaagcgtggagcgtggatgctgatggtctggatggaagcagaagccagccatcgaagcgaggagccgtctttttttggggtggttgtacgtagactggga

SEQ ID NO: 195 - DNA, 1659 bp, Sorghum bicolor
ctagattcacgacggagatggcgtccgagctcacctaccgcggaggcgggccgtccgcggccgccagcgccggtgccgggggatactccccgaagccgtccaagccgctggcctggctgccccgcgccgcccgctacgccgtcgccgagaaccgcccgctcttcgcgctcgccgggatgctcatcgccgccgccgtcatctccatcgcctccccgtccgcctcttccacctccaccaccggctccgccgccgccgtctcgtcctactccaacaacaacaacaacaacccgctcgcccgcttctccgtcgagcccgcccaccaccgcgacgtggccacgcgccacttcgtcggcggcaaggtgccgctcggcctcaagcggaaggcgctccgcgtcctcgtcaccggcggcgccggcttcgtcggcagccacctggtggaccgcctcctcgagcgcggcgacagcgtcatcgtcgtcgacaacttcttcaccggccgcaaggacaacgtcctgcaccacctcaacgacccgaacttcgagatgatccggcacgacgtcgtcgagcccatcctgctcgaggtcgaccagatctaccacctcgcctgcccggcgtcccccgtccactacaaatacaaccccatcaagacaatcaagaccaatgtggttggcactctgaacatgctcggattggcaaagaggatcaacgccaagttcctcctcaccagtaccagtgaggtctatggtgatcccctccagcacccacaggtggagacttactggggcaatgtcaatcccatcggtgtcaggagttgttacgatgagggcaagcgtacagctgaaacgttgaccatggattaccaccgtggtgccaaccttgaggttaggatcgcacgtatcttcaacacatatggccctcgcatgtgcattgacgatggccgtgttgtcagtaactttgttgctcaggctctgaggaaggagcccttgacggtttatggtgatggaaagcaaaccaggagtttccaatatgtttctgatctggttgagggtctgatgaagctgatggaaggcgaccatgtaggaccattcaacctgggtaaccccggcgagttcaccatgcttgagcttgccaaggttgtccaggacaccatcgaccccaatgcacagatcgagttccgtcagaacacccaggacgacccacacaagcgcaagcccgacatcagccgtgccaaggagctccttgggtgggagccgaagatccccctccgcgagggccttcccctcatggtcagtgacttccgcaagcgcatctttggcgaccaagacgccgccgccaccactggaaaccagcaaggttaggatgaagccgcacgatacttgggaaatttttggtggcctgcttctagcctgcttggtcgctctccttatactgacaaaagctatggccacgtagttcgttgggaatgtgttactgaaataccttggttgatgctgtaatgctattctttttcctgtattttttttctcagttctctcagtccttagctatacaaaaaaatttcagttgaaccgttggagataaacccggatgatctaattctttgttgattgagagcatagcatcatatatatggtataaatcacggtttctgcaagtgttatg

SEQ ID NO: 196 - DNA, 568 bp, Sorghum bicolor
aaaggatccggggaagaagaagaagatgtcgtacctgctgccgcatctccactcggggtgggcggtggaccaggccatcctcgccgaggaggagcgcctcgtcatcatccgcttcggccacgactgggacgagacctgcatgcagatggatgaagtgctggcagcagtagctgagaccataaagaactttgcagtcatctaccttgttgacatcacagaggtccctgatttcaacactatgtacgagctgtatgacccttctacggtgatgttcttcttccggaacaagcacatcatgattgatcttgggacaggaaacaacaacaagatcaactgggccctgaaggacaagcaagagttcatcgacatcgtggagactgtttacaggggcgcccggaaaggccgtggtctggtgattgctccaaaggactactccacaaagtaccgttactaagaagtgaagcattcacgcggagcagcagctgctgtttgctagcctagtatgttccccttatgcaatctattaggggatgtttactcagacagtcagttcgactgggaattcttt

SEQ ID NO: 197 - DNA, 368 bp, Triticum aestivum
cgtccatggagaaggacaaccacaaggagggggagggggcgacggcgtggatgacggtgccggcgttcggggactgggacatgaagaacggcgccatgccggactactccatggacttctccaagatccgggagatgcgcaagcagaacaagaaggagctctcccgcgccagcctcggcggcgacgacgacctcctcgcccaccacaagcagcagcaccagcagcaccagcccgccgccaaggctccccagcccaccaagctcggcgctccggccaaagaccacggcccgctccacggccgcgaccactcgcccacgggaaggaagaggttcctgagctatttccagtgctgcatcaaggcctgatga

SEQ ID NO: 198 - DNA, 1229 bp, Zea mays
atttgactgagactggtggtggagctgctagcagcgagcctgctacttcctggtcctgacggtgcgttcagacctcagaccagtgccgacgacgagctgtgaggagagggcaaggaagcaagcctgtgaggaaggcggcgatggagaggtacgaggtgatcaaggacataggatcgggcaacttcggggtggccaagctggtccgggacgtcaggaccaaggagctcttcgccgtcaagttcatcgagcgggggatgaagattgatgagaatgtccaaagggagatcatgaaccacaggtcactgaggcatccaaacatagttaaatttaaggaggttgtgctaactcccacacatttggccatagttatggaatatgctgctggtggtgagctatttgaaaggatctgtaatgctggaagatttagtgaggatgaggcgagatttttcttccaacaactgatttcaggagttagttattgccactcaatgcaaatatgccatagagatttgaaactagaaaacactctcctggatgatagtatagcacctcggctaaagatatgtgattttggttactccaagtcctctgtgttgcactctcaaccaaaatcaactgtcgggacaccagcttacattgctcctgaggtccttgctagaaaggaatatgatggaaaggtcgccgatgtttggtcatgtggagttactctgtatgtgatgcttgttggtgcctatccctttgaggaccccgacgaaccgaagaatttccgcaagacgcttactcggattatcagcgtccagtacgcggttcctgattttgtccgagtttcaatggagtgcaggcatctgctgtctcggatctttgtggcgaaacctgagcaacggataaccatcccagagatcaagaaccacccatggttcttgaagaacctgcccatcgagatgaccgacgagtaccagatgaacctacagctagtcgacatgaatgtcccctcgcaaagcctggaggagatcatgtccatcatactggaggcccggaagcccggcgacgggctgaagcatgcgggacagctccccggccttgggagcatggagctggatgacattgatgttgacgacatagacgttgaggacagtggcgactttgtatgtgccttgtgacgcggttcaggctgtccggcaccgttgctgcggtggactctcccccactctcctggtctttgtgtctag

SEQ ID NO: 199 - DNA, 878 bp, Sorghum bicolor
aaagcatgtcgaaggatgacgtgacggcggaggcggaggccgcggcgaaggcgccgtactgggatccgccgccggcgccgctgctggacacgagcgagctgaagaagtggtccctgtaccgcgcgctcatcgccgagttcatggccaccctcatcttcctctacgtgagcatcgccaccgtcatcgggtacaagaaccagtccaaggccgaatcgtgcaccggcgtcggcgccctcggcatcgcctggtccttcggcgccaccatcttcatcctcgtctactgcaccggcggcatctcaggcgggcacatcaacccggcggtgacgttcggtctgttcgtggggcggaagctgtcgctggtgcgcacgctgctgtacatcgtggcgcagtgcctgggcgccatctgcggcgtgggcatcgtcaaggggatcatgaaggtgccctacaactccctcggcggcggcgccaacgcggtggccacgggcccctccgacggggtgctcacgggttactccgtcggcagcgccctggccgccgagatcgtcggcaccttcatcctcgtgtacaccgtcttctccgccaccgaccccaagcgcacggcgcgcgactccttcatccccgtgctcgtgccgctgccgattgggttcgcggtgttcgtggttcacctggcgaccattcccatcaccggcaccggcatcaacccggccaggagcctcggcgccgccgtcgtgcacgcagcatggaaagaccattggatcttctgggttgggccgctgatcggggcgacggtggcggcgttgtaccacaagctcgtgctgcgcggggaggccgtcaaggcgctcggctccttcaggagcaccagcgccacggtgtgatga

SEQ ID NO: 200 - DNA, 2849 bp, Oryza sativa
gcggcatgctgatcccactcgctcacctcccacgcccaccaccactcaccgcctccgctatatttcgcccccgcgcccctcgcctcctcgcctcgctctcgctcgccacccctcctcctcctctacttgcagcttcagctttcgcttcgctgccgctgcgggcgctgctctccgagtcccagcgggaggtggagatggtgggcgaatcggaggggaggccgctccgggttggcctcgtctgcggcgggccctccccggagaggggcatctccctcaactccgcgcgatccgtcctcgatcacattcagggggaggacttgctggtcacctgctactacatcgactgcggcatgaacgcctacgccatatcacctgcgcagctatattccaacaccccttcagattttgatttcaaacttgaaagtctagcccaaggattccaatccctatttgactttgcacaacatcttgccgcaaatgttgacattgtcttcccggtgatccatggcaaatttggtgaagatggtggtattcaggagcttttggagaaagcaaatgttccatttgttgggacaccctctaaaaattgcctccttgcttttgacaagtataatgcatcgcttgagctcaatgcacaaggctttttaacagtaccaaactttcttgtagagaaggacaaattagctaagtcgaaactggaggaatggtttcaaagcatcaatttggataaagaaaatggcaaagtagtggtcaaacctacaagtgctggatcgagtattggtgtagttgttgcttatggtgctaatgatgcagctgagaaagccgagggaataatttcagagggaattgacgacaaggttatcatagaagtttttcttgaagggggcactgagtttacagccattgttgttgatgttgggacagctaataacagtgagcctgttgttctccttcccacggaagttgagcttcaatcctccagtaatattgatattcaggaggatacaatatttaactaccgtcggaaataccttccaactcgacaggttgcttatcatacacctccacgatttccgtcagaggtgattgattgcatcagacaaggagtgtctattttatttcgttgtcttggcctgcgtgatttcgcgaggatagatggttggtttttacctactcccgttacctctctaccttcagctgaaaatactggtaaatttggaaataccaaatacggtgctgtcctttttactgacattaatttgatgactgggatggagcaaaccagctttttattccaacaatcttctaaggttggattctctcactctcgaatccttcgtacagttgttcagcatgcttgctcgcggtatccgtctcttgtaccatgcagtaatgcatggactgctttgtccagaaaaatacaagcagcaaaacaagcagaagcaatccaaaaaggtacatccaaaaaaaaggtctttgtgatctttggtggtgacacttctgagcggcaagtctctcttatgagtggcacaaatgtctggcttaatttgcaaggttttgatgatcttgacgtgacaccttgtttgcttacatctggaaatggttattcttccttccacaaccaaaatatgaatggaatttcacgtgatgtatggacattgccatattcgttagtgctacgacataccattgaagaagttaatgccgcatgtattgaggcaattgatccagaacggatggaattaacatcccgtttacgtgaccaagtaatgaatgaacttggacagtcattaagcaaatatgattggtttgcgggctttgacattgccgataagcaacctatcaaatactctcttcaacaatggatcaatcatgttaaggaagctcaagccgtagtgtttatagcagtgcatggtggtattggagaagatggtactattcaatcgctgttgggatctgcaggagttccttacacagggcctggacaaatagcttctaggacatgcatggacaaagttgcaacttcacttgccgttagccatctggctagctatggagttcacaccataccaaaggatctgagagcaacagaagagatactaaagtcgtctcctgacgatatctggaatgacctgaaagcaaaactacaaactgaaacggtttgtgtgaaacctgctcgtgatggatgctcaactggtgtggcaagattgtgttgtccgaaggacttggaggtatatgcaaacgcattggagagaaaattacagcgcatgcctgctaactgtttatctagggcacatggtgtcattgagatgccagtctctcctccagagtcactgatatttgaaccttttattgaaaccgatgaaattatcatttcaaccaaatcagtggatgatagcacccgacatctggtatggaagggggaaaataaatggcttgaagtgactgttggtgtagttggcaaacgtggagaaatgctgtcactaaatccaagtatcacagtcaaagaaagtggtgacattttatctcttgaggagaaatttcaaggtggaactggaatcaacttgacaccacctccttcaacaattatgagcgaggaagccctgcagaagtgcaaaagttgtatcgaaactttggcaaacactctcggattggaaggcttttcaagaatagacgcatttgttaatgtccagaatggggagatactgctgatagaggtaaacactgttcctgggatgactccatccactgtactgattcaccaggcactgacggagaaaccacccatctatccccacaagtttttccggacgcttcttgatctggcgtttgcaagggcgaactagtag

SEQ ID NO: 201 - DNA, 1396 bp, Triticum aestivum
cgtcacttgaccagccagccgccccactccaccctccactgcggcacgcgctcccggcgatgtcgtggctcgcgcgctccattgcggccaccctctcctccgcccccgacgacgacgacgacgacgacgaccaccactccgaggcagccaccggcgacgaaaccccggatcacgccgccagcgccgacgccgaggaggacgagcagccggacacccccggccgcggggtcaagggcgacatctccgagctgaccgagtccctcacccgacgcttctggggcgtcgcctccttcctcgcgccgccgccgccgccggccggggccgaggccgagacgtcgacggcggctgctgaggcggaggcggaggcggagggagagtatgggccccagtccccgcgggtcgccgggatccggaacgacctggctgagatcgggggcagggtgaggagcggcatctcgatgctgtccaacgccaacgccgtggcggagatctccaagatcgcctcgtccttcctgcctttcgtgccggaggaagaggaggaggatgtggatgcggtgggcctgacggaggaagtggtggtgttcgtcaggcacatctcgacctctcccgagacgtggctcgattttcccctcttcgtcaacgaccggcacgccgatgattttgaactgtcagatacacaatatgaacatgcattggctatagagcgtatagtaccaagcttatcatatctcagaaccgaactttgttcgaccaatatgagtgaagcatgcttttggaagatctattttgtgcttcttcactcaaagctcaacaaggaagatgctgaacttctttcaacgacacaaatcctggaagcaagagaagagttattgcaaagctccccaaggatgaaaaatgtagcgtctgagggtcctgggggcccatcagaaagcagcaatgttctatctacccaagctgaagataaagagttgtcaccctcaagcatccaagacaagagtggaatggctgaagcaacatctttccaagaaccaactcctgatcctctgccaggggctgaggctgacaagcatcccatttcaaccagcgagccggaaattattgacaagtcagtaattgaagaagagctggtggtgaaaactgaaatcaagaatcagggtgacaaacccaacctgtacaccccggaggacgacgacgacaaagaagtggaggattggctagaggacatggaccatgccgacaacaaaacaggcaatatcacctcggttgggcaggacgaagacgtgtcattcagtgacctggaggatgacgatgatgattaagggttgcctggtggtaaataccaagcccagtgcctgatacatatgctctgcggcttcaagacatacgctcgctgtaa

SEQ ID NO: 202 - protein, 1067 aa, Setaria italica
MEASASAPAVLLPLLAAPPRFLHLPLRRPSTRRHGCGSGFLLQPPPLGPGSRARCRTTCCASGPDHADVLLGGASLVSVAAVTLLAALQLVWLRWRSAMHGDSPEVLHEHGKSIVNKVLGASKTMYDSNCAAQTTHDSGLPELGVSGRMTVDTQACSVISPLAPPVTSADISGPEVICSTATANCSIEKVTSVPVMPDSVSEGQDKTKYLSNSTGRVAGLPYQFLSLSGHQEVMQNSQGHTGKQMDASDANLVGCNQSDQEEHLDFTSLSSFKRIAECHLGFVPLASNRNLFKPRKWIEFTNSNAGSSYSPAGQFSPVACLREDPVSKQEKAVKDHDDSPVTGFSISNILNKENPDNFTQAKRGGLKGTKDTLDYSRIYNSFLIDGRLKDCVDLLESMEQNGLLDMKKIHHASFFSMCKKQKAVLEAVRFCTLIDNPKISTFNMLLSVCANSQDFDGALQVMELLKEAGLKPDCKLYTTLISTCAKCGKVDAMFEVFHEMVSAGIEPNVNTYSALIDGCARAGQVAKAFGAYGIMSSKKVKPDRVVFNALISACGESGAVARAFDVLSEMMAESSESKGSGPILPDHVTVGALMKTCIQAGQADQAREVYKMLQEYNIKGTPEVYTIALRSCSLTGDLGFALKIYEDMNKIGVKPDEMFLSALVDVAGHARRADAAFEIMKDARAKGLHVGTIAYSSLMGACCNAKDWKKALQLYEEIKSIKLTPTVSMMNALITSLCDGDQVLKAVDVLNEMKGIGICPNEITYSVLFVACERNGEAQLGLDLFEQLKIDGIGINPTIIGSLTGLCLQMFDSDLSLGNIIVNFSLGKPQIDNKWTSSAIMVYREAVSTGLVPSSDVLSQVLGCLRLPHDNSLKSSFIENMGISCDIPHNPNINSLFEGFGEYDIRAFSMLEEAASLGAVSSISMKDTRIVIDARKLKIYSAEVSLLTTLRSLKHRLAAGARLPNVTILLPTEKKQVDIDEREKTLKLSGRIGQAIGSLLRRLGISYQGEESHGRMRINGLTLRRWFNPKLNSKSSSAAPADLLPLSSRLAKGIADQQRDIRSLSLE

SEQ ID NO: 203 - protein, 131 aa, Sorghum bicolor
MAVAAAARAGFRRLFSVSAFAAPPPPAARPAAEPCNNLFVSGLNKRTTSNGLKEAFSKFGQVIEARVITDRISGYSRGFGFVKYATVQEAGEAIKGMDGKFLDGWVIFAEYAKQREATQPSQQGAPYEYSS

SEQ ID NO: 204 - protein, 361 aa, Sorghum bicolor
MGKEGASAGGGGGDGGMSESVIRKVLISYMYVAVWIFLSFSVIVYNKYILDPKMYNWPFPISLTMVHMAFCSSLAVALVRVLRVVDLPSSPAMTSQLYVSSVVPIGALYSLSLWFSNSAYIYLSVSFIQMLKALMPVAVYSIGVLFKKETFKSSAMLNMLSISFGVAIAAYGEARFDARGVALQLAAVAFEATRLVLIQILLTSKGISLNPITSLYYVAPCCLAFLVVPWVFVELPKLREVGSFQPDLFVFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDSHGDRKTDTQA

SEQ ID NO: 205 - protein, 390 aa, Unknown
  Sequence found in Organisms: Arabidopsis thaliana, Arabidopsis lyrata
MVKLLELFITSSKPVVEILLITSVGFYMALDGVNLLGHDARKYLNNIVFYVFSPSLIGSRLADSVTYESLVKMWFMPVNVLLTFIIGSLLGWIVIVITKPPSHLRGLILGCCAAGNLGNMPLIIIPAVCKEKGGPFGDPESCQKYGMGYVALSMAMGSIYIWTYVYNLMRVLSNSPVETPPSVESNYDSYKVPLISSKEEENNQKAGRWEKVKRRLVSLSQKVNLKTIFAPSTIAAMIALVIGLITPLRKLIIGTEAPLRVLQDSVTLVGDGAVPAMTMIIGGNLLKGLRSSGMKMSSIIGVLVARYVLLPMSGVLIVRGAYKLDLVTSEPLYQFVLLLQYAVPPAMNLGTITQLFGTGESECSVIMLWTYSLASIALTVWPTFFMWLVA

SEQ ID NO: 206 - protein, 225 aa, Arabidopsis thaliana
MVMETESKFHVLAVDDSLFDRKMIERLLQKSSCQVTTVDSGSKALEFLGLRVDDNDPNALSTSPQIHQEVEINLIITDYCMPGMTGYDLLKKVKESAAFRSIPVVIMSSENVPARISRCLEEGAEEFFLKPVKLADLTKLKPHMMKTKLKKESEKPVAIEEIVVSKPEIEEEEEESSVIEILPLHQEIESEQLEPMLSSNKRKAMEEVVSTDRSRPKYNDITTSV

SEQ ID NO: 207 - protein, 634 aa, Arabidopsis thaliana
MDLNESVVHFSRGNGIAKLDNFGDTALSLKCLGSSAGRLIGSSHHNHKLCSDVSNCPDGGCRLVLGLGPTPPSYYYNVRVNDNNNKGSASSGSVQELSSGGNSILQLGPPAVTMDTFSGLEGSLLTYADTNVSQAAVDEGSTSARRSGGYMPSLLFAPRTENVRKPSRMQECSTNCGTDAYNSQLSHESEFSVSAFSDRSASATSSQQRMSNPKKCKFMGCVKGARGASGLCIGHGGGQRCQKLGCNKGAESKTTFCKAHGGGKRCQHLGCTKSAEGKTDLCISHGGGRRCGFPEGCAKAARGKSGLCIKHGGGKRCRIESCTRSAEGQAGLCISHGGGRRCQSSGCTKGAQGSTNYCKAHGGGKRCIFAGCTKGAEGSTPLCKAHGGGKRCMFDGGGICPKSVHGGTSFCVAHGGGKRCVVAGCTKSARGRTDCCVKHGGGKRCKSDGCEKSAQGSTDFCKAHGGGKRCSWGGDWKCEKFARGKSGLCAAHNSMSQDKAGSKVGLIGPGLFRGLVSTSLQTTTTATTTTTTTDHSQSGVSAVSDCMDSIDRPLPPLHHQPEKRQKLMIPMQVLVPPSMKSLSFSNTERPDIETNNNSSGSNGRNIFDFMIPEERVHGGGLMSLLNGNMKQTLR

SEQ ID NO: 208 - protein, 447 aa, Unknown
  Sequence found in Organisms: Hordeum vulgare, Secale cereale, Triticum aestivum
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 209 - protein, 199 aa, Hordeum vulgare
MSAAAAPAPIGLSWAPQLPSLAAAGGSKKGSAPTPSIDAQDSLWKPRNELVDGLYVPPRDPRKVNKMARKNVKDTAGKGWFDMPAPSITPELKKDLEILQLRHVMDPKRHFKRSGKSKALPKYFQVGTVIEPASEYYSSRLTKHERKQTLVDELLSDQKLKNYRMRKVREIQEARTPGGNQKWKNKGKQTFKRAKDRRK

SEQ ID NO: 210 - protein, 652 aa, Hordeum vulgare
MSAPPSSSSHPAPIPQPAATLAPAGMRDAAAAADSSGSPPSRMSEDDDGDGGGGAAGGGDRWAPDLRGGCGSNGNGGRWAPPDQVLENVLESVLEFLTAARDRNAASLVCRSWYRAEAQTRRELFIGNCYAVSPRRAVERFGGVRAVVLKGKPRFADFSLVPHGWGAKVSPWVAALGPAYPRLERICLKRMTVSDDELALIPKSFPLFKDLSLVCCDGFTTRGLAVIAEGCRHLRVLDLTEDYFHEEESEVVDWISKFPECNTSIESLVFDCVSVPFNFEALEALVARSPALRRLRVNDHVSIEQLRRLMARAPHLTHLGTGSFRSEPGPGGALSVSELAASFAASRSLVCLSGFLDVNGAYLPAIYQVCPNLTSLNFSFAALTAEEFIPVIRHCINLRTLWVLDTVGDEGLRAVAETCSNLRELRVFPLDATEDSEGSVSDIGLQAISEGCRKLESILYFCQRMTNAAVVAMSENCPDLLVFRLCIMGRHRPDRITGEPMDEGFGAIVMNCKKLTRLSVSGLLTDKAFAHIGKHGKLIKTLSVAFAGNSDMSLQHVFEGCTRLQKLEVRDSPFGDKGLLSGLNYFYNMRFFWMNSCRLTVRGCGDVAQQMPNLVVEVMKENEGEMDTVDKLYLYRSLAGPREDAPSFVNIL

SEQ ID NO: 211 - protein, 110 aa, Hordeum vulgare
MNSRPIVLVFLLLVLIISSQFEWKQQIGEAEASPDATRRRQPALVVREDAVKEKIILAQEKNIQQLTELIQSLQVQLLHCRGSNNTAQGASSTQSSSSYTEADRHQIIDD

SEQ ID NO: 212 - protein, 667 aa, Hordeum vulgare
MLLRLLSSSSRAIATKPHPPQTLAAAAAGATTSTTRKLAAMAGNREAFRVVVANTLERRLFYVPSFKIYGGVAGLYDYGPPGCAVKANVLASWRQHFVLEEGMLEVDCPCVTPEIVLKASGHVEKFTDLMVKDEKTGNCYRADHLLKDFCKEKLEQDTTLSPEKVEELNHILAVLDDLSAEQLGAKIKEYGIVAPDTKNPLSDPYPFNLMFQTSIGPSGLSAGYMRPETAQGIFVDFKDLYYYNGNKLPFAAAQIGQAFRNEISPRQGLLRVREFTLAEIEHFVDPEDKSHPKFSDVSDLEFLMFPREDQLTGGSATRLQLGEAVSEGTVNNETLGYFIGRVYLFLTQLGIDKDRLRFRQHLPNEMAHYAADCWDAEIECSYGWIECVGIADRSAYDLRAHSDKSGVPLEAHEKFAEPREVEKLVITPSKKELGLTFKGNQKAVLEALEAMGETEALGMKAALESKGEVEFKVCTLGRDVTVKRNMVSINMEKKKEHQRKFTPSVIEPSFGIGRIIYCLFEHCFYQRTGRTDDEQLNVFRFPPLVAPIKCTVFPLVKVEKFDIVAKKISKALTTAGISHIIDITGTTIGKRYARTDEIGVPLAITVDSTTSVTIRDRDSKDQIRIEVDEVASVVKEVTDGQSTWADIMWRYPAHTTLATDEEEASET

SEQ ID NO: 213 - protein, 458 aa, Hordeum vulgare
MPPASTSPSTAPAATKPPPRHPLGLDTLASTSRSLFAAGRRSPVTTLVCAIALLALIMYGEDARTIAELSIDDYLYPDADIYNVSGLAPIALPPPTCDLAHGRWVFDNESLPLYREKECTFLTKQVTCLANGRNDDTWQYWQWQPNNCSLPTFDARRFMERMRGKRLMFVGDSLNRNQWESLVCMVQSILSKGRKKIVKRGSLTIFHAKEYRATLEFYWAPFLVESNSDNPKIHSIEHRIIRPERIEGHAQYWRDVDYLIFNTYIWWMNTADMKVRRPDTRYWSEHDEVPRIEAYGRVLKTWSDWLNENIDPARTSVFFMTISPLHISPDKWGNPHGIKCAKETLPVLNYTEPLDLNHDMRMYDLVASTARSMKKVPVTLIDITRMSDYRKDAHTSVYSVRQGYLLTAKQKNDPEKFADCIHWCLPGVPDVWNTVLYTRIFSKSAPSSPPAIALPPPQ

SEQ ID NO: 214 - protein, 786 aa, Hordeum vulgare
MASSLTPRSQFQKKENLGNARRGMGYNAPPRRNVLSAINNGGGANADPAPSEAGSEAPAFEFSGRDDVDRLLNEKMKGKSKNDYKGRTEQMSEYIKRLRACIRWLVELEDGYLAEQEKLRGQIDSDNARHAEFEAQLSGALEELKAANLEMTTRCDSLEESLNKEKAARLLAVESYEKEREERESAEASRDVLTVDLERVTHEAKRFSEQLKMVQDTNKRLQEYNSSLQQYNSNLQADTSKNGEIISKLQREKSAMMEAMTNLKDLNNSMKNQLDSSMSSQKEAIRVKEELRKEVECLRADLQQVREDRDQSVAQLNTLTAELATYSEQAKKSSKDSELLQIKAAAFEETCSSQQEQIETLQKQLAVATEKLKHADVTAIEAMTGYETQKETIKDLEERLAHAEFQIIEADKLRKKLHNTILELKGNIRVFCRVRPFLSDTDSNGQEEAIISYPSSVENAGRGIDLINQGQRCSFSYDKVFDHSASQDDVFVEMSQLVQSALDGYKVCIFAYGQTGSGKTYTMMGKPGRDQKGIIPRSLEQIFKTSQSLETQGWKYCMQASMLEIYNETIRDLLAPGRSSSEMPGGKQYTIKHDSQGNTTVSDLTTTNVFSTADVTSLLEKASHSRSVGKTQMNEQSSRSHFVFTLKIFGSNESTGQQVQGVLNLIDLAGSERLTKSGATGDRLKETQAINKSLSALSDVIFAIAKNDDHVPFRNSKLTYLLQPCLGGDSKTLMFVNVSPEATSAGETLCSLRFASRVNACEIGVARRQTQSKSSSSDNSNRLSYG

SEQ ID NO: 215 - protein, 528 aa, Hordeum vulgare
MDAAAEMDAGELEAVFRAAADFASYPGVHGEDAVRQFLEQFPLHDLLGALQSQGAEPETVETVAACLDKVFSSRYGASLLPSYAAFIEAGLLTNLNNIRQLACKAVVHLLDKAEDSDVAVDTFVQHNLYPLLINCLIEGDEEISAIVLDAIKRLAEIPKGTDIIFPPDGQGLQLNKVAAQSSSMARIRILSLIAKLFAASSCTATAIRDSNLLSLFEDEIKDRKDMLKTLSALEVLYELAEHPHSNMFLLKTSLLQHITDVINDPSADSIVRSRASLISGRLLASADAFMTIEQSCVTNLLLAIDKILRTEESQNTDEIESALETLGLIGTTSQGACLLFSDPPNVAKHVVEMSFDRQGRGKQLAALHAFGSICGVDREEDQMKLDDYQAEECLKRLVYSAASNSPKLTPSALLLSILQQDPDVRIAGYRVLSGLVVREWCLREVCSKPEIIGVVTDPKMETTKLGMEARYACCVAINKALASSHLLHEPSLSELIGKLNEAVRRGPYLSQKKPRVEAQPVVGTMERF

SEQ ID NO: 216 - protein, 176 aa, Hordeum vulgare
MGNCQAAEVAAAVVQHPGGRVERLYWSAPAAEVMRANPGHYVALVTLRVAEERQDAGARRTVRLTRVKLLKPKETLLLGHVYRLITANEVTKAVQARKEEKLRKARQQLQQLESSTRQSKLRPAADGDDDDDDDEASLDESLDQLARQDGGDGHRSSGARHRQWRPSLHSIDEAAS

SEQ ID NO: 217 - protein, 153 aa, Unknown
  Sequence found in Organisms: Hordeum vulgare, Triticum aestivum
MANSNLPRRIIKETQRLLSEPAPGISASPSEENMRYFNVMVLGPAQSPYEGGVFKLELFLPEEYPMAAPKVRFLTKIYHPNIDKLGRICLDILKDKWSPALQIRTVLLSIQALLSAPNPDDPLSENVAKHWKSNEAEAVETAKEWTRMYASGA

SEQ ID NO: 218 - protein, 149 aa, Unknown
  Sequence found in Organisms: Hordeum vulgare, Pseudoroegneria spicata, Secale cereale, Triticum aestivum
MAAVLTRPTPGTVQCFGRKKTAVAVAYCKPGRGLIKVNGAPIELIRPEMLRLKAFEPILLAGRSRFKDIDMRIRVRGGGKTSQIYSIRQAIAKSLVAYYQKYVDEAAKKEVKEIFGRYDRTLLVADPRRCEPKKFGGRGARARFQKSYR

SEQ ID NO: 219 - protein, 843 aa, Hordeum vulgare
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQFEGEEAYQTFSRVIENANVIMATYEDVLLGDVQVYPEKGTVAFSAGLHGWAFTLTNFAKMYASKFGVDEVKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKTASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALCEENMRGICYEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDIMASDPLDPGTQSATLVTEIRKRKGLKEQMTPLSDFEDKL

SEQ ID NO: 220 - protein, 469 aa, Hordeum vulgare
MDCKDVGILAMDMYFPPTCVQQEALEVHDGASKGKYTIGLGQDCMAFCSEVEDVISMSLTVVKSLLEKYHIDPKLIGRLEVGSETVIDKSKSIKTWLMQIFEESGNTDIEGVDSSNACYGGTAALLNCVNWVESRCWDGRYGLVVCTDSAVYAEGPARPTGGAAAIAMLIGPNAPISFESKYRASHMAHVYDFYKPDLASEYPVVDGKLSQTCYLMALDSCYRQYCAKYEKLVGEQFSISDADYCVFHSPYNKLVQKSFARLYFNDFMRNCSSVDNDAKEKLQPFANLTSEESYQSRDLEKGSQQLAKHLYDIKVQPSTLLPKQIGNMYTASLYAALASVIYNKHASLNGQRIVMFSYGSGLTSTMFSFKLNEGQHPFSLTNIASVLDVAAKLESRHVTSPEKFIDTLKLMEHRYGAKDFETSKDISLLPPGTFYLTKVDSMYRRFYEKKTDGIVDGKIKCSNGIANGH

SEQ ID NO: 221 - protein, 183 aa, Hordeum vulgare
MALQVWMVGENGEDLNNHRELLPLSKLQEIGVLYWHLDPKKSESEQELAKIRKDKGYSYMDYLDICPGKLANFEEKLKNFFTEHMHADEEIRYCLEGGGYFDVRDKDDKWVRIWIKEGDMIVLPAGIYHRFTLDAANHVKLMRLFLGEPVWTAHNRPQEDHPVRQEYVKRLTDDNAGHALAAH

SEQ ID NO: 222 - protein, 410 aa, Hordeum vulgare
MSWLARSIAATLSSAPDDDGHSEAASGDRTPDHAANAEEDEQPDTPGRGVKGDISELTESLTRRFWGVASFLAPPPAAGAEASTAAAETEADAEGEYGPQSPRVAGIRNDLAEIGGRVRSGISMLSNANAVAEISKIASSFLPFAPEEEEEDEVDAVGVTEEVVVFVRHISTSPETWLDFPLFVNDRHADDFELSDTQYEHALAIERIVPSLSYLRTELCSTNMSEACFWKIYFVLLHSKLNKEDAELLSTTQISEAREELLQSSPRMKNVSSEGPGCSSESSNVPSTQAEDIEFSPSSIQDKIGTAEATSFQEPTPDPLPAAEADKHPISTSEPEIVDKSVIEEELVAITEIKNPGDKPNLYTPDDDDDKEVEDWLEDMDHDDNKTGNITSVGQDEDVSFSDLEDDDDD

SEQ ID NO: 223 - protein, 401 aa, Hordeum vulgare
MQSAAAIGLIRPCAARPILKSPSPGAARLPASRVALRLSAAAPRARLVAAAGLGRIGLVPASPEQEKRSGGLVAAAAAGKAAPGEEAGEESGAALAKTLQLGVFFGLWYLFNIYFNIYNKQVLKVFPYPINITTVQFAVGTTISLFMWATGILKRPKISGAQLLAILPLAIVHTMGNLFTNMSLGKVAVSFTHTIKAMEPFFSVLLSAMFLGELPTPWVVLSLLPIVGGVALASISEASFNWAGFLSAMASNVTFQSRNVLSKKLMLKKEASLDNINLFSIITVMSFFLLAPVTLLTEGVKVTPTFLQSAGLNLQQVYTRSLIAAFCFHAYQQVSYMILARVSPVTHSVGNCVKRVVVIVTSVLFFKTPVSPINSIGTAIALAGVFLYSQLKRLQPKPKAA

SEQ ID NO: 224 - protein, 112 aa, Unknown
  Sequence found in Organisms: Hordeum vulgare, Triticum aestivum
MVKGRTGQRVRLYVRGTILGYKRSKSNQYETASLVQIEGVNTREDVAWYGGKRMAYVYKAKTKSNGTHYRCIWGKVSRPHGNTGVVRAKFTSNLPAEAMGKKVRVFMYPSSI

SEQ ID NO: 225 - protein, 126 aa, Hordeum vulgare
MQQGDGTEAQVTWDDQQNINRFGRLNNRLHELADEIRLAKEANENLEDAGNELILSDEDVVRFQIGEVFAHMPVDDVETRLEQMKEDAAKKLEKLEEEKESILAQMAELKKILYGKFGEAINLEED

SEQ ID NO: 226 - protein, 586 aa, Hordeum vulgare
MERILKSARESGSLNLSNRALSDVPGEVYNNLDTGSLDDKWWEGVDLQKLILAHNNLEVLREDLRNLSSLVVLNISHNQISSLPAAIGDLPLLKSLDASFNQIKLIPEEVGLASALVKADFSNNCLTELPASLGRCLNLSELKASNNNISRLPDELAGCCKLSKFDMEGNKLVLLPENMFTSWTLLTELNAAKNQLTTIPASIGALSKLVRMDLHQNKITSIPSSIKGCSSLAEFYMGNNSLSTIPADIGMLSKLGTLDLHSNQLKEYPVGACKLKLSFLDLSNNALSGLPPELGTMTTLRKLLLSGNPMRALRSSLVSGPTSTLMKYLRSRLSSDEEASGSRTTPTKDDQISAARRLSASSKELNLSGLGVPNVPPAAWETSDVVKLDLSKNLIEDLPNELSLCSSLQALILSNNKIKKWPGMVVSSLPSLTSLKLDNNPLAAISSTDVESLSKLEVLDLSGNASSLTEPSVISSLPQLHELYLRRMKLQGFPIGLFQLKHLRILSLSQNHLTTIPEGIKDFSALVELDLSDNNITALPAELGLLEPSLQVLKLDGNPLRSIRRTVLERGTKAVLSYLKEKLPSN

SEQ ID NO: 227 - protein, 134 aa, Hordeum vulgare
MGSLTSSSTGRKSTVESVDPEAACALLASEQYGYVDVRMWEDFDKGHVAGARNVPYYLSVNPNGKERNPHFVDQVAALYSKQDRLLVGCRSGVRSRLATADLVAAGFTNVKNLEGGYLSLLKSASYPQPTTSHP

SEQ ID NO: 228 - protein, 257 aa, Hordeum vulgare
MSEQGAGQGSKEESLMDKITEKFHGSSSSSSSSDDEAGRAAGSSSSSVKAKIYRLFGREKPVHSVLGGGKPADLLLWRNKKISGGVLAGATAIWLLFEVLEYHLLTLLCHGFILTLGILFLWSNASAFVNKCPPNIPEVKIPEDLAVNVARSLRYEINRGFASLRAIGQGRDLKKFLIVVAGLWILSALGSSCNFLTLFYIVFMVLYTVPVLYEKYEDKIDAFGEKAMVELKKYYAIFDEKCLSKIPKGPSKDKKQH

SEQ ID NO: 229 - protein, 415 aa, Hordeum vulgare
MEGCRGRPWTRLPALLLVALACAAAAAVGECRVVHVGEAHRRSMLANGLGATPPMGWNSWNHFACDGNGEVVIRETADALVSTGLAAAGYKYVNLDDCWAEPERDAKGNLAANKNTFPHGIEALADYVHSKGLKLGIYSDAGYKTCAKAQPGSLGYEEQDAKTFASWGVDYLKYDNCNNGDTKPLERYPEMSKALMQAGRPIFFNLCEWGDMHPARWGAAYGNSWRTTNDIEDTWDSMVSRADQNEVWAEYARPGGWNDPDMLEVGNGGMTNDEYIVHFSIWAISKAPLIIGCDVRHMSQDTYDILANKEVIAVNQDPLGVQGKKVRMEGSSEIWAAPLTGYRTAVLLLNRHAKDEAQITAHWDDIGLPAGTAVEARDLWLHKTLEPKFTDKMSFNVTPHAARMFVLTPLKSQLD

SEQ ID NO: 230 - protein, 337 aa, Hordeum vulgare
MERFRFRSPPLSLKLAFAAVSFAAVSCSSSSPLPSSAASSSPRPSPRAVAADLLAVLAGPRAAARVPAGEASRLNSCLRFLSPVNPAATSAAYPWRGSRKVLLEGCDAAEADAMVMWPPAPVLELARIAVDSGGDPGAIHRLLDPTMLPVPDVEGTKKSKCHLTRTPYGRRFADEDINSYFAFLFELIAARGPSVGLNVSLNRYDLFHGHLFLASGTGRLGILFHAKEYPAFDKKSFPYNLGYCQAESDVPYDDSMNLRNILWLAPLPSSETKAWAAPGVLVVLDAHPDGIIYQDLIRDYVQIVRTIYEDDFGKHAVDVNYLNVANAAAPADRIFIC

SEQ ID NO: 231 - protein, 199 aa, Hordeum vulgare
MAARNDNESDGDVGTNPAEGGSSLSLPPLAAGPAVCVLRSAGDFAGGAFVGSIFGYGQGLLTKKGFKGSLGNAGSSAKSFAVLSGVQSLVLCLLRKLRGKDDIINSGIAGCCTGLALSFPGTPQALLQNCATFAAFSCIMEGLNKQQTAMAHTLAGNALTTFAHDKGGVLPPFTLPPILDVSDAFSSCCQALVVNPKKH

SEQ ID NO: 232 - protein, 69 aa, Hordeum vulgare
MKFAGWYMKIAVGGAAIGAAMELFMIHTGFYEKVTVLESEKRAWESSPEAQAMREALNPWHKRDEEEKK

SEQ ID NO: 233 - protein, 400 aa, Hordeum vulgare
MGKSKDKKASREAKVDKKLALGLGVKRKLLKKKKDRVLDAAVESEGAAGHAIVEDKGSKKTVLMKQKKKTKHAKVISSRSKADNLVTLNEDEATPKLKKKNKKQLKESKSPIEVQSPLDSNDAGTMKLKKKKKKAKEGKSSVEPNDADAILHENLDKETLNTDVNQLAAGSEVRDIGKPEKAKKRKKNKTTDVHQVAAESEVMDIGEPEKAKKRKKNKTKKVKQSGEVNKIDTQVSVREDNLEMHEVDTANVDEIASVDEDCSRGMQKWILEYRQKRPGLKVLQQNIDVFITAHEEQQEQEKKEREAAAAEDGWTVVMHHKGRKKTTDAETGTAVGSVSLAAMQEKMAQKKPKEVGRNFYRHQKREAQMSELAMLQSKFEQDKKRIQQLRAQRKFKPYGF

SEQ ID NO: 234 - protein, 350 aa, Hordeum vulgare
MSPQGTNEVQSNQPNTMGSDAPAGDSGSLVVANSDNRKVSREDIELVQNLIERCLQLYMTKGEVVRTLSTRARIEPGFTTLVWQKLEEENSEFFRAYYIRLKLKRQIVLFNHLLQHQYNLMKYPAPPNVPLAPMQNGMHPMPVNNLPMGYPVLQQPLMPAPGQPHIDPMVCGLSSGHVVNGIPAPGGYHPMRMNSGNDMVVDNGAPEAAHAGAMSSDMAVSPSSAASTNHAPFTPSEIPGMDMDTSALDSPFGSDMGNTGPLQLGADGSSRDSIRSLGQLWNFSLSDLTADLTSLGDLEALENYAGTPFLPSDSDLLLDSPDHDDIGNHDDIVEYFADAINGSQSDEEKP

SEQ ID NO: 235 - protein, 1378 aa, Hordeum vulgare
MAGKSKGARNKAKAQAASQDAVSVEPAVPVTDVVEEAKPENGEVTDAPAAEVASAGEAVAAADVEKEEGGAAEAAQAAEKPAEGELHLYPVSVKTQSGEKLELQLSPGDSVIDVKQFLLDAPETCFYTCYDLILHTKDGSTHQLEDYNEISEIADITAGGCSLEMVAATYDERSIRSHLRRVRELLSLSSLHVSLSTSLALQQESAQAKNSDAGKTKTAHQELDGLNFMEDTTVALTNLLASAPAEIKCVDSIVFSSFNPPPSYRRLHGDLIYIDVVTLEGSKHCITGNSKSFYVNASNGSVLDSRPLKQSHEASTLVGLLQKISAKFKKGFREILDRKASAHPFENVQALLPVTSWLGAHPVPEHRRDSARAEDSVVLSYGTELIGMQRDWNEELQSCREFPHANPQERILRGRALYKVTCDFVDAAVKGAVGVINRCIPPINPTDPECFHMYVHNNIFFSFAVDSDYEQISKDQKPDCQNGSSRSTPVPSPDLGAKAVSGVAPGSKTEEPNSVLEGPTEAQIADSEQATYASANNDLKGTKSYQEADISGLYNLAMAIIDYRGHRVVAQSIIPGILQGDKSDSLLYGSVDNGKKISWNESFHAKVVEAAKRLHVKEHVVLDGSGNPVKLAATVECKGIVGSDDRHYILDLMRVTPRDANYIGLQHRFCVLRPELVASFVEAESIKKSPTQKVPDVPTELNGQESDDQHVRASDTTAASVEENDKSDEGPASAPAESNDSTDEILFNPNVFTEYKLAGSPEEIEADEALVKKVGSYLLDTVIPKFVQDLCSLDVSPMDGQTLTDVLHSNGINVRYLGKVAGMIKDLPHLWDLFSAEIIVRSAKHVVKDILRQSPDHNIAPAVAHFLNCFFGKVLAVATKGTGSPQSKTQKGQKSSQSASSKKGQSAYSQLTSDGVWSDIKEFAKHKYQFEAPDDARAGAKRVAVLRNLCQKVGITIAARKYDLHSTAPFQSSDILNLQPVVKHSVPTCTDARKLMEAGKIRMAEGTLNEAYGLFSEAFSLLQQINGPMHKDAANCCRYLAMVLYHAGDTAGAIVQQHRELIINERCLGLDHPDTAHSYGNMALFYHGLNQTELALRHMSRTLLLLSLASGPDHPDVAATLINVAMMYQDASNMSTALRYLQEALKKNERLLGPGHIQTAVCYHALAIAFSCMGAYKLSVQHETKTHDILVKQLGSDDSRTKDSENWLNTFKEREQQVIAQKQKGQVTAPSANAVEFLKAHPGLFQAMKAAAIQSGGDGPANVNRGRGGDERAAKAAAEARKTAVARGVNLRNGPAASVSDINQILNLINSAASASAASPAANAQTPESEVPQSNGTTLNGAKEAKDASRLAAKADGQAPVGLGASLELKKQKSKQKA

SEQ ID NO: 236 - protein, 712 aa, Hordeum vulgare
MEESFVPLRGIKNDLRGRLTCYKQDWTGGFSAGIRILAPTTYIFFASAIPVISFGEQLERSTDGVLTAVQTLASTALCGIIHSVVGGQPLLILGVAEPTVIMYTFMFSFAKDRADLGPNLFLAWAGWVCVWTAVLLFLLAVLGACSIINRFTRIAGELFGLLIAMLFMQQAIKGLVDEFRIPERENIKALQFVPSWRFANGMFAIVLSFGLLLTALRSRKARSWRYGAGWLRGFIADYGVPLMVLVWTGVSYIPHDSVPKGIPRRLFSPNPWSPGAYDNWTVIQDMPNVPLMYIIGAFMPATMIAVLYYFDHSVASQLAQQAEFNLRKPPSFHYDLLLLGFLTLLCGLIGIPPSNGVIPQSPMHTKSLATLKHQILRNRLVATARQSMRQNASLSQLYNSMQDAYHQIQTPLIHQQQSVKGLNELKDSTVQLASSMGNFDAPVDETIFDIEKEIDDLLPMEVKEQRLSNFLQAVMVGGCIAAMPLLKKIPTAVLWGYFAFMAIESLPGNQFWERILLLFTAPSRRYKVLEEYHTTFVETVPFKTIAMFTLFQTTYLLVCFGITWIPIAGVLFPLMIMLLVPVRQYILPKLFKGAHLNDLDAAEYEESPAIPFNLAAQDIDVALGHTQSAEILDDMVTRSRGEIKRLNSPKITSSGGTPVTELKGIRSPCISEKAYSPRITELRHERSPLGGRDSPRTGEARPSKLGEGSTPK

SEQ ID NO: 237 - protein, 744 aa, Hordeum vulgare
MSSGAVLVAIAASIGNLLQGWDNATIAGAVLYIKKEFSLETQPLIEGLIVAMSLIGATVITTFSGAVADAVGRRPLLIASSVLYFVSGLVMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSKGRMAEAKRVLQRLRGREDVSGEMALLVEGLGVGKDTHFEEYIIGPDDELADDGLAPDQEKLKLYGAEEGVSWIARPVRGGGQSALGSALGLMSRHGSMVSQGKSLVDPLVTLFGSVHEKMPEVMGSMRSTLFPNFGSMFSVAEQQQAKADWDAESHRDDEDYASDHGADDIEDNLNSPLISRQATSVEGKEIAAPHGSIMGGVERSSSMQGGDAVSSMGIGGGWQLAWKWTEREGADGQKEGGFQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGILLSNIGLSSSSASILISALTTLLMLPSIGIAMRLMDMSGRRFLLLSTIPVLIVALAILVLVNVLDVGTMVHAALSTISVIVYFCFFVMGFGPIPNILCAEIFPTSVRGICIAICALTFWIGDIIVTYTLPVMLNAIGLAGVFGIYAVVCMIAFVFVYMKVPETKGMPLEVITEFFSVGAKQGKEATD

SEQ ID NO: 238 - protein, 692 aa, Hordeum vulgare
MASAATAPPAGKRPATGGREGDQMVVTPLGAGSEVGRSCVHMTFKGRTVLFDCGIHPAYSGMAALPYFDEIDPSAIDVLLVTHFHLDHAASLPYFLEKTTFKGRVFMTHATKAIYRLLLSDYVKVSKVSVEDMLFDEQDIIRSMDKIEVIDFHQTLEVNGIRFWCYTAGHVLGAAMFMVDIAGVRILYTGDYSREEDRHLKAAEIPQFSPDICIIESTYGVQQHQPRHVREKRFTDAIHNTVSQGGRVLIPAFALGRAQELLLILDEYWSNHPELHKIPIYYASPLAKKCMAVYQTYINSMNERIRNQFAQSNPFHFKHIDPLNSIDNFHDVGPSVVMASPGSLQSGLSRQLFDKWCTDKKNTCVIPGYAVEGSLAKTIINEPREVTLANGLTAPLNMQIFYISFSAHADFPQTSGFLGELCPPNIILVHGEANEMGRLKQKLITQFDGTNTKIVSPKNCQSVEMYFSSEKMAKTIGRLAEKVPEVGDSVSGLLVKKGFTYQIMAPEDLRVYTQLSTANITQRIAVPYSGSFEVIKYRLKQIYESVESSTEEDVPTLTVHERVAIRLDSESYVTLQWSSDPISDMVSDSVVAMILNIGREGPKVVPIEEAVKTEEETERVGRKVVYALMVSLFGDVKVAEEGKLIITVDGDAAHLDGRSGDVECANAGLKERIKTAFRRIQGAVRPILLSAS

SEQ ID NO: 239 - protein, 674 aa, Hordeum vulgare
MARHAVLLVVTVAVLLARRAAAEYPWPVCGSTGSFAANDSTYLASIGAIAATLPSNASASPGGLYATARAGQVRALGLCRGDANATACSGCLAQGFQDLPSACAYSKEATMYYDPCFLHYSSLDSRASDDTASGSAFSTAYSDNATAEPARFDRVVAALLNATADYAAHNSSATRLYASGVVAFDREIPEVYSWAQCTPDLTPARCRDCLANMIQQLGTPLYSVGARVLGIRCSVRYENRPFLDGPVMLRLPATGDPAPSPTTAPAPAPDVVPNVVTPVAAVGRGRKYSVPGMVLMVVLPSLAAANFIAGLFIWRRRRRSPAQANQPYPSYSTEGKDTESVDSMLMDISTLRAATGDFAESNKLGQGGFGAVYKGTLPDGEEIAVKRLSKSSTQGVEELKNELALVAKLKHKNLVRLVGVCLEQQERLLVYEFVPNRSLDQILFDTEKGEQLDWGMRHRIIRGIARGLQYLHEDSQLKVVHRDLKASNVLLDADMNPKISDFGLARLFGRGQTQGVTNRVIGTYGYMAPEYLMRGNYSVKSDVFSFGVMVLEIVTGRKNSDTLQSQDLLTMVWEHWSDRTVLEMMDPCMNNGFLESDARRCVQIGLLCVQENPVDRPMMSAVGMMLGSDTVSLGAPSKPTSTFYTRNASADSGNGFNVSTISVNDGPKDHSTTT

SEQ ID NO: 240 - protein, 295 aa, Hordeum vulgare
MAGAEAVERAHELYRGGRHREALELYSAALAAARGHAQRIALHSNRAACYLKLHDFHKAAEECTSVLELDTEHAGALMLRAQTLVTLKDYQSALFDVNRLIEINPSSEVYRNLHARLKTQLSLAPIPESDEESLYTEEDKEDLPPKDNTKNETALVKSDQPSAKLIPENKPVTKALKVEVLPNLHSKPEGTIQKPKGHSELDYKEPLTEAPKVQVSPSLYKEPLTEARKVQVSPSLPSKPECWGTIQKPKGHSGLDYSKWDKVENDSSEDDDDDEEDDLPRYKFKVRTIGVRTVK

SEQ ID NO: 241 - protein, 744 aa, Hordeum vulgare
MGSGRVCYVVASVVLLWLGVATAQGDSPWKTLSGNAPAIIAKGGFSGLFPDSSEFAYQFAMIASSPDTVLYCDVRLTKDGLGVCLPDIKMDNCTNIPDFYPKGKKSYLVNGVSTTGWFSVDYNGTELSQVSLKQAIFSRTPRFDPSFFPLLAVEDVASKFKPPGMWLNIQHDDFYSQFNMSMRKYILSVSRRVIVDYISSPEASFLTSISGRISNNTKLVFRFLDEATLEPSTKDTYGSMLKNLTFIKTFASGILVPKKYVWPVSPDNYLQMYTSIVDDAHKVGLEIYAADFANDFALSYNHSYDPLAESLSFIDNGAFSVDGILTDFPVTPSEAIGCFANLNKSNTAHGKPLIISHNGASGDYPGCTDLAYQKAVDDGADVIDCPVQVTKDGIPVCMGSINLMDGTTVAKSPFASQTAVMKDIESVLGVFTFNLTWDDIVKNLKPKISTPLSTFSLDRNPRYRNAGNFMRLSDFLDFSKDKDLSGIMISIEHAAFLAAELGFDMVDAVIKALDDSGYNKQTAQKVMIQSTNSSVLVKFKQQTKYDLVYMINEDVSDAAPSSLAGIKKFADAVSVETSSVFPENRHFTSHQTDLVESLQTAGLSVYAYNLMNEFVSQPYDFFSDATAQIIAYVQGAGVDGLITDFPATARRYKSNTCMNMGNKTPSFMAPPRPGDLLQLISKPAQPPALAPMPLLLDSDVSEPPLPPARSNTATTAPAPSSARRTQTGIPFLVTLAMLCAWAAI

SEQ ID NO: 242 - protein, 218 aa, Hordeum vulgare
MEWACCGSGYSSSGTQSPAAGDGEEGSYMTVSSAPPKRRAGRTKVRETRHPVYKGVRSRNPGRWVCEVREPQGKQRLWLGTFDTAEMAARAHDVAAMALRGRAACLNFADSPRRLPVPPQGAGHDEIRRAAVEAAELFRPAPGQRNAATVAAATAPPVALGNAELVADSPYYPMDGLESEMQGYLDMAHGMLIEPPPMAWPSTWIEEDYDCEISLWNY

SEQ ID NO: 243 - protein, 350 aa, Hordeum vulgare
MDDDGSLSIRNWGFYETMKGNLGLQLMPSVTGGHRDTKPLLPNGTFLQHHTPPHHPPHSHHPRDYGNGEPSGGMPAEPPAIHMDFVRNEAWMHPSQHQHQHQHQHQHQHQHQHQLQHQHQHQHSRELKVLNAVPVGPAPHIGHPGHAVHHHPTGFGMMPDARGAHTLQMMQPQEPPVPDEEKITPPLVEDHSVVGSKPPVKKRQQGRQPKVPKPKKPKKDATPGEDGAPKARAPRSRGPLKPVEMVINGIDFDISRIPTPVCSCTGAPQQCYRWGAGGWQSACCTTSISTYPLPMNTKRRGARIAGRKMSQGAFKKVLEKLAGEGYNLNNPIDLKTFWAKHGTNKFVTIR

SEQ ID NO: 244 - protein, 494 aa, Brachypodium distachyon
MASKAVTIGDLIQRVTSSCLSNRFPGNYALNDSGADTDLDEEDDDPFADFGDAADECRPSPGEVTAAAAAGGEQEEEERKLKIWEEEEKRKVAETAAETKGGERAREADALMAEVFDAVSGVRRAYAALQGAHCPWDPDRMRAADAGVVAELRHLARLRDRFRRSAASPDGRIPQANPSPPPLREALAPYEAALEDLQRQLQSKQAEVDGLKEKLASNTSSSRRRLHPSKKQQHPNGAEAVVGAPTAELFAACAEQARAATRAFAAHLLNLIRAAGLDPAAATRSLTKIPVASSSPKVAKHAMEAHVTRVLLGGFEHESFYLDGSLSSLLDPAASRRDRHAQFRDMRGMDPAELLGVLPDCAFGRYAAAKFASLLPPRVEEAVLGAGHRGGGGGKHPRTPFYGEFLRAAKAVWLLHLLAFALEPPPSHFEAGRGAEFHPEYMESVAGPPPPRAGAGMVVGFAVAPGFKLCNAAVVRARVYLVPRGTTGHHPPPC

SEQ ID NO: 245 - protein, 291 aa, Brachypodium distachyon
MRELVVSSFSSTAAANAALVRGWWEEVNESPEWQDGAFFSLAAAYALVSAVALIQLVRIQHRVPEFGWTTQKVFHLMNFVVNGVRAVVFGFHACVFSLQIKVYKLVLLDLPGLLFFSAYTLLVLFWAEIYHQARSLPTDKLRIIYLAVNSIVYVIQICIWVYLGINDNKLVELVSKIFIVAVSAVALLGFAVYGGRLFVLLRRFPIESKGRKKKLYEVGTVTTICCTCFLIRCVVVALSAFDADVSLEVMDHPILDFFYYMLTEILPSALVLYILRKLPPKRVSAQYHPIN

SEQ ID NO: 246 - protein, 227 aa, Brachypodium distachyon
MDTAASDGSSSEQRRLLTIPKEGERIIAPTRRPDGSLRKEIRIRAGYVPQDEVAIYQSKGALMRKSGPDVTPGYDPALDAKPKTKAAKRNERRKEKRHQGSSTNDKGKSLDIEEADARETHTVLSSTNKQSDMVDSVAEQLSGVAISESPLVATPSTNATDNLQSESSAPEIDKKIRALKKKIRLAEAQVQGEPEKLKPDQLEKTKKIEGWREELKLLESRRVQSAS

SEQ ID NO: 247 - protein, 96 aa, Brachypodium distachyon
MVQKRGDRLLPSSQTTPLHAAIPRRGFLCSSFGGEEEKRGEAARREMAVMDTAFKALTAGLGVATLYLAATFSVNVYRGLAWHSEQSKLEKEKSEG

SEQ ID NO: 248 - protein, 449 aa, Brachypodium distachyon
MEKKFTVTRTSKSLVPPSSSSPTPAATEDDAPVPVIMRLSTIDRVPGLRHLVLSLHAFDGHGVVAGEDDEERIRWPARVVREALGKALVDYYPFAGRFVVDEEGEVGVKCSGEGAWFVEAKAECSLEEARHLDGNPMEMVIPKEDLLPEPIPGVDPLDIPLIMQVTEFTCGGFVVGLISVHTIADGLGAGQFINAVADYARGLPKPRVSPVWARDLVPDPPKMPAPPPKLELLDLRHFTVDLSPDHIAKVKSQYFASTGHRCSAFDVVVAVTWQSRTRALRLAGAGYDDVHVCFFANTRHLMLHGGAGAAGFYGNCFYPVRATCGSAEVASADVAGVVKVVRDAKARLAGDVARWAVGGFEQDPYELTFTYDSLFVSDWTRLGFLEADYGWGPPAHVVPFSYHPFMAVAVIGAPPKPKLGSRVMTMCVEEDHLPEFRDQMNAFAFTAGK

SEQ ID NO: 249 - protein, 649 aa, Brachypodium distachyon
MPLAAAATVAAARPSPIGLPRPLCRASAHPRRRFRLQATSPASTPAPAPAPATADEGPGAGPCPVVRFDMADFTVADRVSVGLHGRSDEMIFEATVRDPSSELYGSTVVLRQLTSSQAKRRGRRALEVLKKLARRQIMYHSYAMQVHGYVTPSNVMEEGDGPFILVHGYHGSYSLRHWLQLSDWLPTLEATLALDEEQVRRVGDDSIGGPAVTRQLRLIRILMRDLLIGVNYLHSHGMAHTELRLENVHVSPVDKHVKVGILGNAVDFHDSDPNNSSVPSNNDRRKMMIAFDMRCVGFIMAKMVLKELMDSSTFLKFKSFLNKGNDPSCLREFLVPILSQNSPTGNIGLQMLDRHWGAGWNLLALLLATKSDNRISCLDALRHPFLCGPKWRISPSVNVVRWGLGSTAVRLAEDYIYGHHQRRRLAYFIELMEVLNPNSRTESWLHLLPGRWCLLYCTGRHIGLTLRQPTPRILMSDVFLTFAQTPESVDPVLSLASDIGFKIMPESDWPHDKSGTEGNLSVTTSARIAPGRIYINAEDSKDSRITSSRRYLHGKWGKASKMKELPASLPTASINVDEDEVDVSMTCGSTLNVNSARKVLQEVRTQTPPEMFDLSKIVCGTYIDSRLMILRGVNGSALLFIRSNCTSDS

SEQ ID NO: 250 - protein, 98 aa, Brachypodium distachyon
MADDSPSSPASYIRLVQHLIEKCICYNMDREECVKTLEKQANIMPTVTSTVWKELEKENREFFETYKKERGDQEPLQKSSCTPSEQASASKSSDDNDN

SEQ ID NO: 251 - protein, 625 aa, Setaria italica
GGGGRPFAGLAAATSRIASLGRAGDAASARAVFDAMPQRDAVSWNAMLTAYARAGRPRDTLELFACAPASDAFSLTAALAAAAALRCPAAGAQIHARLLRLGLRAPLPVGNALVAMYAKCARADDAARSFEEMHDRNDLSWCSLLHAYVASGHLRPAQELFDEMPNRNNVAWNTLLMGYSRSGNARQCLLLFNKMRMAGLTCDDATLCILVDACTELAHPSTGFSVHKIVLQSGWNAMAEVSNSLVSLYTKFSMLDDAVRIFESMKVRTIVSWNSLIYAYMKLGYTEQAASLFRSIPETNVISWTSMIGGLARNGCADEALTLFFEMVAHEHIHPDDFTYGAVLHACATSVSLASGRMVHGRVFQTGFASYLYVANSLMDMYAKCGDVESASNVFNGIFVKDLVSWNTMLFGFAINGWANEALMVYDSMKSHEVCPDEVTFAGLLTACSHSGLLEQGEIFFETMVSAHGIQPKPEHLSCVLDMYARSGNIKKAAEILDHFVESIRTHKSDVHEALLSACSSEHLNAGIARKVVKDMVRTEPARDAAYVMLSNLFCASGQWSEAERVRRAMAEHGVKKSPGCSWIEVEGAVKVFVSGAQDPDLTGFVCDVLRLLDGEIRNITRCGV

SEQ ID NO: 252 - protein, 431 aa, Setaria italica
MGTIGFPVTRTSRSLVAPSSATPQETLRLSVIDRVAGLRHLVRSLHVFDGRSGGGAGGDEALLATPARTLREALGKALVDYYPFAGRFVTEEDGEVRVACTAEGAWFVEASAACSLEEVKHLDHPMLIPKEELLPEPAPDVNPLDMPLMMQVTEFTCGGFVVGLISVHTIADGLGAGQFINAVADYARGLPKPRVAPVWARDIIPAPSKIVSRPPRFELFDLRYFTVDLGPDHIAKVKSSFFEATGQRCSAFDVCVAKTWQSRVRALRLDADDPSRPVHVCFFANTRHLLPPAPGFYGNCFYTVKATRPCGEIAAAGVVEVVRAIRDAKARLAADFARWAGGGFERDPYELTFTYDSLFVSDWTRLGFLEADYGWGTPAHVLPFSYHPFMAVAVIGAPPAPKPGARVMTMCVTEKHLPEFREQMNAFAAGN

SEQ ID NO: 253 - protein, 290 aa, Setaria italica
MAATPPPPAAALEQLSSNKMFGGRNLRFRHQSATLGCPMTFSVYLPPSPASKIPVLYWLSGLTCTDENFIIKAGAQRAAAAHGIALVAPDTSPRGLNIEGESDSYDFGVGAGFYLNATNEKWKNWRMYDYVVKELPKVLSDHFEQLNTTQASIFGHSMGGHGALTIYLKNTDKYKSVSAFAPIVNPINCPWGQKAFSNYLGSTKSDWEEYDATCLIKKKNKVSAPILIDQGEDDKFLAEQLLPRNFEEACKAVGVPLILRMQPGYDHSYFFIATFVDDHIAHHAQFLKSA

SEQ ID NO: 254 - protein, 284 aa, Setaria italica
MEPGAGTALYPLHRCKTIYLVRHAQGIHNVAGEKDFNAYKSHDLFDAQLTPLGWSQVDGLREHVKKSGLAKKIELVITSPLLRTMQTAVGVFGGENYTDGVNAPPLMVENAGHSGRRAISSLNCPPFLAVETCREHLGVHPCDKRRSITEYRPLFPAIDFSLIENDEDVLWEPDVREANESVGLRGMKFIDWLWTREEKEIAIVSHSGFLYHTLNMYSKECHPTIRDEVGKHFANCELRSMVLVDRSMLGSDSPSFNYPGKIPAGLDLPSDVADEKHLEEAQKN

SEQ ID NO: 255 - protein, 425 aa, Setaria italica
MAEARQLRSFVEVPAGSHFPIQNLPFGVFRRRQAQEPPRPAVAIGDFALDLAAVSDAGLFDGPALAGSPCFHQETLNMFLGMGRPAWKEARATLQRILSADEPVLRDNEALRKKCLVPMSDIEMVMPITVGGYTDFFCSVHHARNCGFIFRGPQTPVNPNWFHLPIGYNGRASSVVVSGTDVIRPRGQGHPTGNSTPYFGPSRKLDFELEMAAIVGPGNELGKPIDVNDAEENIFGLALMNDWSARDIQAWETIPLGPFLGKSFSTTISPWIVTLDALKPFTCEAPKQEPEPLPYLAEKNHINYDIPLEVWIKPKDQSDASIVAKTNFKHLYWTVTQQLAHHTINGCNMRPGDIFATGTLSGPEPESLGCLLELTWNGQKEIAVGNSTRKFLEDGDEVILTGCCKGEGYNIGFGTCTGKVLPALP

SEQ ID NO: 256 - protein, 246 aa, Setaria italica
MGASPSRHEASSDSSRAGNGRAVAVATSSAASGTGSNSNQAQSKRAPAPHMFHEIVAQEKTATTAAELEDQVHGAGIYLAGKTKKYWVHEKTRCNCFMLFPRGLSVTWSEDPNYWSWHPLKETSDSEIEAVSLQNVCWLEIHGKLELSHLTPGVTYDVVFEAMLTEPTYGWTAPVNLRLKLPDGAVQERKEKLQEKPRNQWLELKAGELTAQPGQKGEVEISLFEYDGGQWKRGLLVKGIKIVPKE

SEQ ID NO: 257 - protein, 608 aa, Setaria italica
MMAAELVKQYSNITLGEDSEICDIKHALKALRKKILSLDFDNSMHVHDPQDSFEYLEVLYKIRRLSERLRNLDPCGEAKQLDELTVYADDLSEMAMARLEEEFVYLLTHYKQPLEQEVLSFRSTEDGSVEDFSSSSFSEEQSEGKATPNDVAGGPEYLVPDLIQPGALSAVKSIAKFMFLNGYDKECCQAYINSRQNAIDEYFASLRLDKLSIEELMNTSWTKLNILIRRWNRAMRVFIRVYLASEKRLSNHIFGELTDSTADLCFYEISFNSVIQLLSFYVSVAIGPPKTEKLFRLLDMYEVLNDLLPEAESLFESGYDDMILNEYHEALLQLGESARKTFAEFKYAIQSYTSSNAVARGEVHPLTKYVMNYIRALTAYSKTLDSILKDTDRRHLHLASDIQLMANAYPNFTATALHLQSVAAILEANLEAGSRLYRDDRLQNIFMMNNIHYMVQKVKNSDLKSFLGDDWIRVHNRKFQQHAIRYERASWNSVLSYLSDDGLCAAGDAASRKTIREKIKNFNLSFEEVYRVQTAWSVPDDQLRDDVRISISLKVIQAYRTFVGRYGSVLDGSRHRDRYIKYRPEDLETLLLDLFEGAQKSLLHSCRA

SEQ ID NO: 258 - protein, 353 aa, Setaria italica
MEVGDLHKVWDVRELKRKPDAAAARALLDRVAKQVQPIMRRHKWRVKVLSEFSPRNARLLGLNVGAGVEVKLRLRRAGRDYDFIPYEEVLDTMLHELCHNDRGPHDAQFYKLWDELRKECEELVSKGITGTGQGFDGTGRRVGGFTIHPPPPSLRQATLVAAQKRARNGALLPSGPRKLGGNNDIMSALSPAQAAAMAAEWRMHDDLWCGSHNQSGIDDSDDVIILEEPPNNMTIKDGKTTKGSCSNTSAESSTSSGIHTAARDGPSSFWTTGDAVDDSKWECGACTLLNQPLAPICEVCGTAKPKIAKAKYMTWSCKFCTLENSTKLDKCSACDHWRYSYGPPIATYGPSYD

SEQ ID NO: 259 - protein, 283 aa, Setaria italica
MDEVTQAVENLKKEWNQAVSQLEESIAAIRSCGKTGKGTEEANSLPRLNGSAQDALQLLKSLQFRLDLLAQQLPTFEEVQSGQATLESWDEQYKKLRASLRNANLQAKENIRKAAQEERELLLGGGEESTIRRRNLQTKTGMTSSAESITESLRRSRQMMVQEVERSASTLATFDESTSVLRKAEGEYQGHRSLLSRTRGLLSTMQRQDVLDRVILTAGFIIFSLAVLYVVSRRIGLLTLQRKLADAIRSGSLSAEDIVAKAQQHGPAAADAAGPAPPIYDEL

SEQ ID NO: 260 - protein, 459 aa, Setaria italica
MAVRHSLEVADDRCDDDGHRPRRAGTAWTCAAHIITAVIGSGVLSLAWSVAQLGWVVGPACMFCFALVTYVSAALLADCYRRGDPEKGPRNRSYVDAVRAYLGKKHTWACGSLQYVSLYGCGVAYTITTATSIRAILKANCYHDHGHDAPCDYGGSYYMLVFGAAQLFLSFIPDFHDMAWLSVVAAVMSFSYAFIGLGLGMATTISNGRIKGSVTGVPMRTPMQKIWRVSQAIGDIAFAYPYSLILLEIQDTLKSPPAENKTMKRASMISILVTTFFYLCCGCFGYAAFGSDAPGNLLTGFGFYEPYWLIDFANACIILHLLGGYQVYSQPIFQFADRFFAERFPDSGFVNDFHTMRVPCLPPWRVNLLRVCFRTVYVASTTAVAVAFPYFNEVLALLGALNFWPLAIYFPVEMYFIQRNVPRWSARWVVLQTFSVVCLLVSAFALVGSIEGLVTQKLG

SEQ ID NO: 261 - protein, 578 aa, Setaria italica
MDRRAGAILVCLLFVLVRDVSAVAETEAGNVRLVQEAPNRKIEGTGRQDDGKVGGRVSVSTVAWSTLIMAAATGLGAVPFFFMELEAQWAGLCNGLAAGVMLAASFDLVQEGQVYGSGSWVVFGILSGGIFIWLCKKFLEQYGEVSMLDIKGADASKVILVVGIMTLHSFGEGSGVGVSFAGSKGFSQGLLVTIAIAVHNIPEGLAVSMVLSSRGVTPQKAMIWSIITSLPQPIVAVPAFLCADAFQKVLPFCTGFAAGCMIWIVIAEVLPDAFKEATPSQVASAGTLAVAFMETLSTVLLGFTDGNNSEDASGFLVSLVFGLGPLIGGIILVTFSLAFSMPHPLLTGVASGIAFRLAAWRPVQLLMSSKMGLFTTLFLLIVGCLVYHAATSSILRVVNRKRSSVNVITSSSGFSLSVLTLQSLLACGSVFLHAYAEGLVLGVAARKAYGLGRYMVLPASLHGLPRGAAVASCVYGATDSWRGALAAAALTGLAGPSAAISAILARIDYDGLDYWMVIACGALIPSFGRVFRRSLRLDMRKSIVGLLIGIAFASVCLMSTRFICLHTPYCNSAPEAVT

SEQ ID NO: 262 - protein, 501 aa, Setaria italica
MAASMASPRGRSIRETVLETVAAYHNQQRMRRKLRKSLTYAGELSSAGRARGDGASSSASVSSLCGPEDDDEPFWEEEEGTVELVQLGANRAKNVLILMSDTGGGHRASAEAIKDAFRIEFGDEYRVFVKDLCKDHAGWPLNNMESSYKFMVKHVQLWKVAFHSTSPRWVHCFYLAALASFYAKKVEAGLKKYKPDIIISVHPLMQHIPLWVLKWQGLQNRVVFVTVITDLNTCHPTWFHANVNRCYCPSEEVAKRAALDDLQPSQIRVFGLPIRPSFCRAVLVKDELRKELELDPELPAVLLMGGGEGMGPVKKTAKALGESLFGREHGKPIGQLIVICGRNKTLSSSLQALEWKIPVKIRGFETQMEKWMGACDCIITKAGPGTIAEALIRGLPIILNDFIPGQEVGNVPYVVDNGAGVFSKSPKETASLVARWFGPDSEELKRMSENALKLAQPEAVFDIVRDIHELSREQGVISQISSSLTSSFFIPSPETTPLQLI

SEQ ID NO: 263 - protein, 189 aa, Setaria italica
MAKFAVLLLLAVAASATVLAHGRELPTQIKLVRGAVAAAGGGVSGDSMECVYTVFIRTGSIWKAGTDSNITLELAAADGNGVGITDLPSWGGLMGQGHSYFERGNLDIFSGRGPCMARPPCWMRVASDGTGPHHGWYCNYVEVTVTGPHKGCAQELFTVEQWLATDAPPYKLEAVVDHCARAGAGAAAA

SEQ ID NO: 264 - protein, 1437 aa, Setaria italica
MRPAPWHPTFPFPATGVLPLLLLGLFAVASGGTGPSPGAFNRGEAGGAEAYSILTFHDYTPPPPPALPPPPAAPAATCAGDLRGVGDLDTQCVVQKSVRLGGGVYISGNGSLVILGGVAVTCERPGCVLSANLSGGILLGHRARVVAGWVSLAAANITLGVDAVVNTTALAGDPPDQTSGVPTGTYGDGGGHGGRGASCFVKKGQAQEDSWGGDTYAWSALKTPNSYGSKGGSTTVEKDYGGGGGGVVWLFAKEIVLNGTVLADGGNGGTKGGGGSGGSIYLKAATMRGGGKISACGGNGLAGGGGGRVSIDVFSRHDDAQIFVHGGKSSGCLDNAGAAGTLYEEVPKSITVSNDNLSTQTDTVFLDPPYEPLWTNVLIKNHAKVSLPLRWSRIQAQGQILLAGATLTFGLTHYPYSEFELLAEELLMSDSTIKVFGALRMSVKMLLMWNSRMTIDGDRESGVATSLLEGSNLIVLKESSVIHSNANLGIHGQGVLNLSGQGDTIEAQRLILSLFYNIVVGPGAVLRGPLINGSIGEMAPKLNCEDESCPMEIFHPPEDCNLNSSLSFTLQICRVEDIDVSGLVQGTVINFNRARSVTVQTSGTISATGLGCQGGIGQGKMLSSGISGGGGHGGKGGDGIYSGDHAEGGPAYGHADLPCELGSGSGNVSASSTAGGGIIVMGSLEQSLPNLSLSGSIEANGGSFTGLASHATIGGPGGGSGGTILLFVRTLLLKEDSVLSSVGGIGNNGSGGGGGGRIHFHWSDIPTGDDYVPFATVKGTILTRGGVSEGHGFPGENGTVTGKDCPKGLYGTFCKECPSGTYKNITGSSKSLCSPCPPNELPRRAVYISVRGGVAETPCPYKCVSDRYRMPHCFTALEELIYTFGGPWLFGLLLSGLLVLLALVLSIARMKFVGTDELPGPAPTQHSSQIDHSFPFLESLNEVLETNRAEESHCHVHRMYFMGPNTFSEPWHLPHTPPEQISEIVYEDAFNKFVDEINALAAYQWWEGSVYSILCILSYPLAWSWQQWRRRKKLQKLCEFVRSEYDHSCLRSCRSRALYEGLKVAATPDLMLGYLDFFLGGDEKRTDLPPRLHQRFPMSLIFGGDGSYMAPFSLHSDRVVTSLISQAVPSSIWHRLVAGLNAQLRLVRRGNLNTTFLPVLKWLETHANPALNTYHVRVDLAWFQTTALGYCQFGLVLHAVGGPVAAELQGDSVIITEQHSVNQNTYADSQLSHSRINDALLCKRITGTVLNVENLKMLKDRRDLFYPLSLILHNTKPVGHQDLVGLVISILLLADFSLVLLTFLQLYSYSMVDVLLVLFILPLGILAPFPAGINALFSHGPRRSAGLARVYALWNITSLVNVAVAFVCGFLHYKSSNKKHSSMQPWNLGGDETSWWLFPTGLVLCKCIQARLVDWHVSILEIQDRAVYSNDPTIFWQ

SEQ ID NO: 265 - protein, 1258 aa, Setaria italica
MAGSAVTDDSAASTAGMRDDERSLSGESLSEWRSCERADSDSPSTSPPFWDTDGEDDDPGPKPSELFGRYTWKIENFSKEKKREMKSEPFEAGGYKWYILVYPQGCDVSNHLSLFLCVANHDKLLPGWSHFAQFTIAVGNVDPKKMKYSDTLHRFWKKEHDWGWKKFMELSKIQDGFLVDDVLEIIAQVQVIREKVDRPFRCLDRPYRRELLRVYMTQVEQIYRRFVEERRSKLSKLIEDKTRWPSFCGFWSAIDPSTRRRMSREKTDTILKVLVKHFFVEKEVTSTLVMDSLYTSLKALEYQVNGKKGSTKVSDLEELPAPMVHIDMDMFVLAGDVIPLIKRAASEPLPCQPLAPKDDKTSQSRMKDGTAGEVYKVSMEREERRLTELGLKILETFVLSHIFSGIEVAYQEAVALKRQEELIREEEEEAGLLENHMKGKRGGGANEKDKRAKKKQAKQKKNNRKVKDRERDEKCEVKILERFHDEIAIDNSDGLPVVEVTAKVDALEEGSSDGSDMPNRGKNQHNKGLSIVGFAEEGDGLPSTSSVAGGLGRNSSGFCTVPKLDQDTVLLTLRDKLRKLGQRLHEKNIEGQKLLKAHFEARDAKAKEAESSNSSSSLEKPPDVPESPKHSSEVAVDLKANGMPTKDVSVVNCMPEEAVSGIPPPTNTEAVTAPATAKIDLVSNKVNGSSSKMKGNTASKPPAVDVDKDAPLPSKSPRINRAASVPPKLPLVDKVTPVPPKSPPINKAPAVRPKSPAIDKTTQVRPKSPAVDKAAPVRSQSPAVDKATPIRPKSPAVDKAPPVCPKSPASDKATPVLPKSTPVDKASPALVKSPTGGKDASGPSRSSVHEKSIPAPPRLPQVDKAALPSSELPQTSSDANSEAPEAATFRKVTANLVSEVTASRPSSAPVFPTPRSTAPTTSHVHISSLLSCSMSEAAGRSVNGPSPSAPPYTPQTYRNAIVGKAGLCTTSASLSYHSTSLSQDTTLSQPLSAYASSTAVMMPPAGRPDQLSTRHVLKSGLGKLEAHDSWQQWKGDSNINKHLWRDQAPYQQMTNGQAYEQPRRDDSYQQASSRGTEKLSRYGGLQSRQFQSGTSDSHVWHQQQGPVPEEFPHLDIINDLLEEDHINSNMPDSFRQDYHAFGRPFSSRGNLADMEMASVSSPGRFNSTDHYYDDGFSRSYDMSALHGLRERQFPSMGTYSNGLSDISVSKPWLNGSPNPAVSLGANTNGYHHQVGDYTNLGGGVNGVSVWRRHANGRW

SEQ ID NO: 266 - protein, 412 aa, Setaria italica
MASSNGKPAQGEEGRAAAEGSIGGYESLHRLLEANLSPELFQEASRLLLGLNCARPLEAISLPEATTTLAETHNFDVQAFRFSADKEFLRQPRVVRVGLIQNSIAVPTTYHFADQKKAIMDKIRHIVDAAGASGVNILCLQEAWTMPFAFCTREKRWCEFAEPVDGESTQFLQELAQKYNMVIVSPILERDVNHGETIWNTAVVIGNNGNIIGIHRKNHIPRVGDFNESTYYMEGNTGHPVFETAYGKIGVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLIISDMDLNLCRQIKDKWAFRMTARYEMYASLLSEYLKPDFKPQVIVDPLINKRA

SEQ ID NO: 267 - protein, 494 aa, Setaria italica
MFSHGADSAHDAGGVGVSTAGATVPARFVWPYGGKRVFVSGSFTRWSEHLQMSPVEGCPSVFQATCSLSPGMYQYKFFVDGEWRHDERQPTVSGEYGIVNTLYLTREINQINSVLSPSTPGTRMNMDVDNETFQRTVTVSDGNNQEGPLRVSEAAIQISRCRVIEYLSLHTGYDLLPDSGKVIALDINLPVKQSFHILHEQGIPVAPLWDSFRSQFVGLLSPLDFILILKELETHGSNLTEEQLETHTISAWKEAKRQTYGRYEGRPHQPLVHATPYESLRDIALKILQNGISTVPIIYSSSSDGSFPQLLHLASLSGILKCICRYFKNSTGNLPILNQPVCTIPLGSWVPKIGDPNSRPLAMLRRTASLSSALNMLIQAGVSSIPIVDDNDSLVDTYSRSDITALAKDKVYTHVRLEEMAIQQALQLGQDANTPFGYFNGQRCQMCLRSDPLLKVMERLSNPGVRRVFIVEAGSKRVEGIISLSDIFKFLLSL

SEQ ID NO: 268 - protein, 435 aa, Setaria italica
MARLVLSECCGLAPLRLRAGRGAIAAPSAPASLSAAALPRRGPAAAAIHRDWALRVSAPTRLTSTVEGEDRGSSPLGEEAAGGEFDPGAPPPFGLAEIRAAIPKHCWVKDPWRSMSYVLRDVVIVLGLAAAAARLDSWLVWPLYWAAQGTMFWALFVLGHDCGHGSFSNNPKLNSVVGHILHSSILVPYHGWRISHRTHHQNHGHVEKDESWHPLPESLYKSLDFMTRKLRFTMPFPLLAFPLYLFKRSPGKKGSHFNPSSDLFQPNEKKDIITSTASWLAMVGVLAGLTFVMGPIQMLKLYAVPYLVFVAWLDMVTYLHHHGHEDKIPWYRGKEWSYLRGGLTTLDRDYGLINNIHHDIGTHVIHHLFPQIPHYHLIEATEAAKPVLGKYYKEPKKSGPLPLHLFGVLAESLKQDHYVSDTGDVLYYQTDKKMT

SEQ ID NO: 269 - protein, 340 aa, Setaria italica
MMFWRDGGGSGSGSGRDSLSGGPPCGQVRVLVVGDSGVGKSSLVHLLLNGSAVARPAQTIGCAVGVKHITYSSPGSSSNSIKADAERNFFVELWDVSGHERYKECRSLFYSQINGVIFVYDLSQRKTKTNLNKWAVEVAESGTFSAPLGSGGPGGLPVPYLVIANKVDIAPRDGRRVSSGNLVDVARQWVEKQGLLPPSDELPLADSFPGNSGLLTAAKEARYDKEALIKFFRMLIRRRYFSNELPAPSPWSLTSREDTILPVETVNDDDLFQRKSYGSQSYKYNGVAPLPAQRNLTPPPTLYPQQPMSSSSENYRYHRFSSSSIPDSGGGRPSRADINI

SEQ ID NO: 270 - protein, 244 aa, Zea mays
MSETGHTVQVTNLSSRVSESDLHEFFSFSGPIEHIELIRSEGYGATAYVTFKERFALETAVLLSGATIVDQPVCITYWGQPEGTFNFWDRPTWEVEEEIEYRNYQTCQYNTTPQEAFTVAQDIMKTMLEKGYVLSKDALAKARAFDESYGLTAAAAARAAELSKRIGLTDRVNAGVGAMRSVDETYRVRETTKTVATATGRTAAKVVNGIVTSSYFSAGAMILSDALTRAAKAAADLAAHGRQN

SEQ ID NO: 271 - protein, 793 aa, Zea mays
MDPEFGVGTAPQKGRRAWRTTLLLAYQSLGVVYGDLSISPLYVYKSTFAEDITHSETNQEIFGALSFVFWTLTLVPLLKYATIVLRADDSGEGGTFALYSLICRHANVSLLPNRQVADEELSTYRLERPREAAGRSGLLRAWLEKHTRLHTALLVMVMIGTCMVIGDGVLTPAISVFSAVSGLELSLSKDQHEYAVIPITCAILVFLFALQHYGTHRVGFLFAPIILAWLLCMSAIGLYNIVRWNPQIYQALNPVYMIRFLRKTKKSGWMSLGGILLCMTGSEAMFADLGHFSYSAIQLAFTSLVYPSLILGYMGQAAYLSQHHNLDASYQIGFYIAVPECVRWPVLVLAILASVVGSQAIISGTFSIINQSQSLSCFPRVKVVHTSDKVHGQIYIPEVNWILMILCVAVTVGFRNTKHMGNASGLAVITVMLVTTCLMPLVIMLCWDRSPWLALAFFLFFGSIEALYFSASLIKFLDGAWVPILLALILLAVMFVWHHTTIRKYEYDMHNKVTLEWLLALGDKLGMVRVPGIGLVYTDLTSGVPANFSRFVTNLPAFHRVLVFVCVKSVPVPHVLPAERYLVGRVGPPGHRSYRCIVRYGYRDVHQDVDSFETELVESLATFIKLDALFRCSDAAGDQQRDSSYYERENALTVIGSNPLRRHLALGYDDSHSHDDGASSAGSDRVDGIELAAAAPAPAVVKKQVRFAVAPPRSPGVDETVLEELHELCEAREAGTAFILGHSHVKTKPGSSILKRLAVGVGYNFLRRNCRGPDVVLRVPPASLLEVGMVYVL

SEQ ID NO: 272 - protein, 457 aa, Zea mays
MDQIATPDETAHASAPSVHKLFDAKLGHHSVMDGTLASTSQSSNIKTQLIRSSSLSRSISVNLEKRSPESDPESPQSHVSHPKFAEPMFSNSSTFCTSLFSSSSTTEPCRQMGTLPFLPHPPKCEQQVSAGHSSSSSLLLSGDTGLDVAEQSDDLNDLLNLSGDASDGSFHGENNALAFDEQMEFQFLSEQLEIAITDNEKNPHLDDIYGTPPQLSSLPVSSCSNQNLGSPVKVQLSSSQSSSSSATANKSRLRWTLELHERFVEAVKKLEGPEKATPKGVLKLMKVEGLTIYHVKSHLQKYRLAKYIPEPKDDKKASSEDKKAQLGKGSIDSSKNKNLQVAEALRMQIEVQKQLHEQLEVQRQLQLRIEEHARYLQKILEEQQKAGNVPLKAPTKAQATKSSPESTSDERTESEVDTISPRPPKNRNPGVDAECKSPGRIKRTKVQADLENEGLCS

SEQ ID NO: 273 - protein, 252 aa, Zea mays
MAATAPNGNPTVSSLAATVPVQAVLFDIDGTLCDSDPLHHVAFQEMLLEIGYNNGVPIDEEFFIKNIAGRSDVEAAQNLFPDWELEKGLKFLEDKEAKYRSLAKERLVPVKGLAKVVQWVKDHGYKRAAVTNAPRINAELMISLLGLSDFFQAVIVGGECEQPKPAPYPYLRALKELQVSAEHSFVFEDSPAGIRAGVAAGMPVVGVATRNPEKSLVEAGAALLVKDYEDPKLWAALEEMDGEEAKLKKASE

SEQ ID NO: 274 - protein, 307 aa, Zea mays
MAENFQLQGRHGKSRVRVSRVWRRPAAAGGDVIVEWNVAVSIVSDCLPSYTSSDNSAIVATDSIKNTVYVKAKECTEVVSMEEFAVILGRHFTSLYPQVSEATVTIVERPWERVTVDGKPHSHGFKVGVEKHSTEVIVKKSGSLRINSGIQGYSLLKTTQSGFEGFVTDRYRLLPDTRERIVATEVTAWWRYPFEHVSQLPSKPFCFTQRYQDVKKVLAETFFGPPDVGVYSPSVQNTLYLMAKEVLTRFPDISSVQLRMPNLHFLPVNLGSKEAPLVKFADDVYLPTDEPHGTIEATLISRPMSKL

SEQ ID NO: 275 - protein, 920 aa, Zea mays
MRSLTVASRHPGAAFSTRRRPLLHPAAAGRDSTFQRCWRWEKTQDSSFGSSLRTSRLPRTVHGDILKNLLAPTAGAVSVEQAEAIADLPKGEMWSVHKFGGTCMGTSERIHNVADIVLRDPSERKLVVVSAMSKVTDMMYNLVNKAQSRDDSYIAVQDEVFDKHMTTAKDLLAGEDLARFLSQLHADISNLKAMLRAIYIAGHATESFFDFVVGHGELWSAQMLSYAIQKSGTPCSWMDTREVLVVNPSGANQVDPDYLESEKRLEKWFSRCPAETIIATGFIASTPENIPTTLKRDGSDFSAAIIGSLVKARQVTIWTDVDGVFSADPRKVSEAVILSTLSYQEAWEMSYFGANVLHPRTIIPVMKYNIPIVIRNIFNTSAPGTMICQQPANENGDLEACVKAFATIDKLALVNVEGTGMAGVPGTANAIFGAVKDVGANVIMISQASSEHSVCFAVPEKEVALVSAALHARFREALAAGRLSKVEVIHNCSILATVGLRMASTPGVSATLFDALAKANINVRAIAQGCSEYNITIVLKQEDCVRALRAAHSRFFLSKTTLAVGIIGPGLIGRTLLNQLKDQAAVLKENMNIDLRVMGIAGSRTMLLSDIGVDLTQWKEKLQTEAEPANLDKFVHHLSENHFFPNRVLVDCTADTSVASHYYDWLKKGIHVITPNKKANSGPLDRYLKLRTLQRASYTHYFYEATVGAGLPIISTLRGLLETGDKILRIEGIFSGTLSYIFNNFEGARTFSDVVAEAKKAGYTEPDPRDDLSGTDVARKVIILARESGLGLELSDIPVRSLVPEALKSCTSADEYMQKLPSFDEDWARERKNAEAAGEVLRYVGVVDVVNKKGQVELRAYKRDHPFAQLSGSDNIIAFTTSRYKDQPLIVRGPGAGAEVTAGGVFCDILRLSSYLGAPS

SEQ ID NO: 276 - protein, 162 aa, Zea mays
MAAVSSTSTASSYFSPQPQLPISTADPAASKSRLMRQPRRSSSFVMVEASSASGSDGGVARTKSLTEDDLEELKGCLDLGFGFAYSEIPELCGTLPALELCYSMTRRFLDEQKAPGQDEELEPASPPLPNWRISGPGDDPEEVKARLKYWAQAVACTVKLCS

SEQ ID NO: 277 - protein, 220 aa, Zea mays
MAAAVESVVVVHNVAKRHNVGTLARSATAFGVAEVVVVGRRDVSAFGSHGATSHLRFRHFVSLALARAYLKDERGCDICGVEITDDAQPVTAHPFRRSTAFLFGNEGTGLSQKECEICDFFVYIPQYGGGTASLNVTVAASIVLHHFGVWAGFTERGREGNKFVVAERPQGHSRGLYCTDSVEAVVEERKMRKENACDVLEENGCSHLQESNGLDLMFAD

SEQ ID NO: 278 - protein, 279 aa, Oryza sativa
MAEEQPRAAAEGGGETLMEKIADKLHIGGDGSSSDSDADERKQPKPSAPPAPAEVATESFVDSAAAAAAEAKAKVFRLFGREEPIHKVLGGGKPADVFLWRNRNISAGVLGGATAIWILFELLGYHLLTFVCHGLIFSLGLLFLWSNASSFINKSPPRIPEVIIPEDLVVNIALSTRYEINRAFANLRQIALGRDIKKFLIVIAGLWLLSVLGSCCNFLTLVYIVFVVLHTVPILYEKYEDQIDSYGEKGWVEIKKQYAVLDAKVLSKVPRGPLKDKKH

SEQ ID NO: 279 - protein, 84 aa, Oryza sativa
MSCCGGNCGCGSGCQCGGGCGGCKMFPDVEATATTKTFVLAAPSNKASSGGMEMAVESGENGGCGCNTCKCGTSCSGCSCCSCN

SEQ ID NO: 280 - protein, 696 aa, Sorghum bicolor
MFFRARRAAARRSHTHTPTTRAAGRTQSVAMGFFQQCSSSSSSPLLPVLLALIGLYCAAAVSCSAAAAPLPAPETTTTMHESYAGKSEFRTVNRKELDSCLNPSPYLAINVSITGGAGAGAGAGAAIPDEAFLQVTVSGVLKPDASDWVAMITPSNSSVAGCPLSGVNYVETGDLANLPLLCHYPVKSQYLTSDPGYMGCKNAGCGKRDASGACKARTCAATLTFHVVNFRTDVEFVLFSGGFKTPCLLKRSGALRFANPASPLYGHLSSTDSKATSMKLTWVSGDGNPQQVQYGDGKSSTSEVATFTQDDMCSVPVLPSPAKDFGWHDPGYIHSAVMTGLQPSQSYTYRYGSDSVGWSDRVKFKTPPAAGSDELSFVIYGDMGKAPLDPSVEHYIQPGSISVTKAVAKEIQTGNVDSIFHIGDISYATGFLVEWDFFLHLITPLASQVSYMTAIGNHERDYANSASVYVTPDSGGECGVAYESYFPMPAVSKDKPWYSIEQGTVHFLVMSTEHEWSEKSEQYNWMDEDLSSVDRSRTPWVIFIGHRPMYSSHGGILPNVDSNFVASVEPLLFNYQVDLVFFGHVHNYERTCAVYQGDCKGMPTKDKNGIDVYDNSNYTAPVHVIAGAGGFTLDSFPNNGEAWSLSRVSEFGYGKVHATRTDMLVQFVNSSSMEVRDQFRIVKGASVNKTPSLILQ

SEQ ID NO: 281 - protein, 368 aa, Sorghum bicolor
MSANGESGGDPAAARRRWDLTNKGPESTPMLKEAVEMSTDEESDGVVICHLNGNTDGCDETISGSRDDDSPEGQETNSIKDPDVQGDTQEDKCVNQDSLKLIDQEKSAPPKSPAKSATASSGSERPKRVVPQPFSLSTQRRSSGVNGGVTNPSANKDKSGDKSSISPASMTKKSTPVAPKKTLQPEQAFHPVEEDSCSVTSSTTTSTRAGRTKTTVPVAPSFVCANRADKRKEFYTKLEEKHKALEAEKDEAEARKKEEQDVALKQLRKSLVIKAKPMPSFYQEGPPPKAELKKVPTTRAKSPKFTSSRRKSCSDTTQTPEGKNTNSTSTRSHRHSIGTSKDANRVQCSPKSGVATKTRSVKPELKAL

SEQ ID NO: 282 - protein, 308 aa, Sorghum bicolor
MDPPRAVAVLLLVLLPVLAPVASGVPFVVLHGIGDECGNDGLASFTEMLGEWSGSKGYCIEIGRGAWDSWLMPLQEQANTVCKKVKKMKELSEGYNIVGLSQGNLIGRAVIEYCDGGPLVKNFISIGGPHAGTASVPLCGSGFVCILIDDLIKSEIYSDYVQAHLAPSGYLKIPTDMEDYLKGCRFLPKLNNEIPSARNTTYKERFSSLENLVLIMFEDDAVLIPRETAWFGYYPDGAFSPVLPPQETKLYTEDWIGLRTLDEAGRVKFVSVPGGHLRISRSDMKKYIVPYLTPEASSKQSVHRMLSL

SEQ ID NO: 283 - protein, 665 aa, Sorghum bicolor
MISSHAFLLSLHGLAMVSTLITNTEGQAFCPSFSCGHLQDIRSPFRMQGDPQGCGFPEYELVCIDSKAIIHINSGRYFVTNISYTDSTFWVVDANLDNSSCPIPASNQHPYINGLQSEGSTLLDPDTVTWAAFITCSEMLSDVTSLFSSCCSGIYRPVNCRSTKNSFVYVFTTTFFPMVGYIKPSCRYLSMIPLGSRHVKRPDNASYEDIVKFMRNGFSVDFPYSSGWTYHWIINLCLKEAKGYYNDKISNSSIVDQTFATAFGIDLHFLRCVNDYSYRTKLFWAVVAMISAVDIVKFVIVFGMLSRFVFAPLAVLTFLAYKYWKTRISIDAVEKFLQMQQALSPTRYAYTDITAITGHFREKLGQGGYGSVYKGMLPGDVNVAVKMLGNSLCNGDEFISEVSTIGSIHHVNVVRLVGFCSEEMKRALVYEYMPRGSLDKYIFSSEQRFSWDKLNEIALGIARGINYLHQGCEMQILHFDIKPHNILLDNNFTPKVADFGLAKLYPRDNSFVPVSAAWGTIGYIAPEMISRNFGVVSCKSDVYSFGMLLLEMAGGRRNLDQHAERRSQMYYPAWVYNHLTRQEVGEICEAFDIHEVERKLCVVGLWCIQMKSHDRPTMSEVIGMLEAGVDGLQMPPEPFFCGDEQNSVTGTFRLSSELSAISENE

SEQ ID NO: 284 - protein, 763 aa, Sorghum bicolor
MAAMVGARRALLAARFSPRGAIAASAKPAPLYRRVDSPPRLPAESVCLQSWVPHRAAGSFASERTDEDYQREWGQNKAGSYADSRSNGSSLHIQRDVPSAGSTTGIHTNRAVDGGGSSEQHYRSGGSYGFRNSHQPYTGARANNETSGYNASQPYRGGGAYSQQGLDGYFPNDRQQYNGTEANSTYSSGYNTQSNQKVYEREGVNYGQYGYGPSGQACPNPIGNNHHIQKQQYVDHRSGESYPDRSRNHPSQYVNPTHFHKEHVAGFQQGNNSNFGYNASQSYQSPHFNRQADMHSTPQGYSMYLNTDVQRPSHGVHQEKHSHAQSAGSFGNHLNNAPHEDGKYHQSLQGNFSNVGLPYEVPKAVGKHKGTVEELEKFCEDGNVKEALEVLAMLKENRIVLHPPQYFRLMQACGDAAALSEARLIHSQISESSTVVDTDFQNEILKMYAKCGSMEDAKKLFSSMDHHNLTSWSTMISGFVHNTLGEEAIDFFDRFKQTGDKPDLGMFRHVFLACGILGSVNEGMLHFESMQKDFGIHPTMEHYASIISMLGQSGYIAEAYEFVEQMPVEPSIEVWENLMNMCRLNGFLELGDRCAQIIERLDSSRLNEQSKMGLFPVDASDLAKEKERKKASVAEARSKVHEYRAGDRSHPDTPKIYEELRYLLAHMKEAGYIADTRFVLHDVDQETKEDALLAHSERLAISYGLITSAPRSPIRVIKNLRSCGDCHTAFKIISKLVGRQIIARDAKRFHHFENGVCSCKDYW

SEQ ID NO: 285 - protein, 146 aa, Sorghum bicolor
MTTSLKKNRKKRGHVSAGHGRIGKHRKHPGGRGNAGGMHHHRILFDKYHPGYFGKVGMRYFHKLRNKFYCPSVNVERLWSMVPADKVAEAAGGDKAPLLDVTQFGYFKVLGKGMLPPKPIVVKAKLISKVAEKKIKAAGGAVLLTA

SEQ ID NO: 286 - protein, 475 aa, Sorghum bicolor
MDAGTYSISSEKSHKAAKAAAAPRPPLQEAGSQPYMPSLSTGSRNPSAKCYGDRFIPDRSAMDMDVAQYLLTEPRKDKENAAAAASPSKEMYRRLLAEKLLNNRTRILAFRNKPPEPENVSATIAASAHHAKPAKQRRHIPQSAERTLDAPELVDDYYLNLLDWGSNNVLSIALGDTVYLWDASTGSTSELVTIDEDSGPITSVSWAPDGKHIAVGLNSSDVQLWDTSSNRLLRTLRGVHEARVGSLAWNNSILTTGGMDGKIVNNDVRIRNHVVQTYEGHSQEVCGLKWSGSGQQLASGGNDNLLHIWDVSMASSMPSAGRNQWLHRLEDHTAAVKALAWCPFQSNLLATGGGGSDRCIKFWNTHTGACLNSVDTGSQVCALLWNKNERELLSSHGFTQNQLTLWKYPSMVKMAELTGHTSRVLFMAQSPDGCTVASAAADETLRFWNVFGAPEAPKPVKASHTGMFNSFNHIR

SEQ ID NO: 287 - protein, 558 aa, Sorghum bicolor
MDPAQYFQPRTFSIKLWPPSESTRLMLVERMTKNLSTESESIFSRKYGTLGKEEAHENAKRIEELCFASADEHFKREPDGDGSSAVQLYAKETSKMMLEVLKKGPRTTAELEAPVADTPLVPDTPLVPADTPLVPADTVLDISGGKRAFIEADEAKELLSPLTKPGNSYQRICFSNRSFGIGAANVAGPILESVKNQLTEVDISDFVAGRPEDEALDVMRIFSKALEGSVLRYLNISDNALGEKGVRAFSELLKSQESLEELYVMNDGISEEAAKALSELIPATEKLKVLHFHNNMTGDEGAMYIAEMVKRSPNVESFRCSATRIGSDGGVALSEALGTCTRLKKLDLRDNLFGVDAGLALSKTLPKLPDLVELYLSDLNLENEGTIAIVKALKQSAPQLEVLEMAGNEINAKAAPDLAECLTAMQSLKKLTLAENELKDGGAVIIAKSLEDGHTDLKELDVSTNMLQRVGARCFARAVADKPAFVQLNINGNFISDEGIDEVKEILKAGKKSLDVLGSLDENEPDGEPDDEEEDQDAEDNEDELDSKLQSVKVEQDD

SEQ ID NO: 288 - protein, 773 aa, Sorghum bicolor
MPDLPCDGDGVCMVCRAASPPEVDLLRCSTCATPWHSPCLSKPPALADAASWSCPDCSPDPAAAAAPSGPANTLVAAIRAIEADTTLSDHEKARRRQALLAGDAHDDDDDDDAAADDALEIVGKNFSCVFCMKLPDRPVTTPCGHNFCLKCFQKWIQNRKRTCAKCRAQIPAKMAEQPRINSALVEVIRMAKISKNPNSAGSAVPYHYIRNDDRPDKAFTTDRAKKSGKANASSGQIFVTIAPDHFGPILAENDPRRSIGVRVGETWEDRLECRQWGAHFPHVAGIAGQSTYGAQSVALSGGYEDDEDHGEWFLYTGSGGRDLSGNKRTNKEQSSDQKFEKLNAALRISCLKGYPVRVVRSHKEKRSSYAPESGVRYDGVYRIEKCWRKIGIQGKFKVCRYLFVRCDNEPAPWTSDDHGDRPRPLPKIKELQGATDITERKGRPSWDYDEKDGWKWMVPPPVSKKPVLSGDPETDKQIRRSTKRAHLSVAERLLKEFGCSICRAVIKEPLTTPCAHNFCKTCLLGKYDSQSSMRERSRGGRTLRAQKIVKTCPSCPTDICDFLENPQINREMMELIETLQRKAVEEGKVASDDAEECGDGDSEENDGALVKGEEDDSGLNEEEQDSADADANADGSVKIVVEIKEGGKDDKKSEMGATEVVDVLVDEDAAKQTKKRKVDEDAVKQTKKRKGDAETGTNGAKRMKSSAAVEEVAVCGTPVKRTRKSGDMDAEGNGSPAVSSGRRVTRSSSVNATGADDSPARRTRSRAGADAGC

SEQ ID NO: 289 - protein, 445 aa, Sorghum bicolor
MASELTYRGGGPSAAASAGAGGYSPKPSKPLAWLPRAARYAVAENRPLFALAGMLIAAAVISIASPSASSTSTTGSAAAVSSYSNNNNNNPLARFSVEPAHHRDVATRHFVGGKVPLGLKRKALRVLVTGGAGFVGSHLVDRLLERGDSVIVVDNFFTGRKDNVLHHLNDPNFEMIRHDVVEPILLEVDQIYHLACPASPVHYKYNPIKTIKTNVVGTLNMLGLAKRINAKFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHVGPFNLGNPGEFTMLELAKVVQDTIDPNAQIEFRQNTQDDPHKRKPDISRAKELLGWEPKIPLREGLPLMVSDFRKRIFGDQDAAATTGNQQG

SEQ ID NO: 290 - protein, 142 aa, Unknown
  Sequence found in Organisms: Zea mays, Oryza sativa, Sorghum bicolor, Setaria italica, Saccharum officinarum, Panicum virgatum
MSYLLPHLHSGWAVDQAILAEEERLVIIRFGHDWDETCMQMDEVLAAVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 291 - protein, 119 aa, Triticum aestivum
MEKDNHKEGEGATAWMTVPAFGDWDMKNGAMPDYSMDFSKIREMRKQNKKELSRASLGGDDDLLAHHKQQHQQHQPAAKAPQPTKLGAPAKDHGPLHGRDHSPTGRKRFLSYFQCCIKA

SEQ ID NO: 292 - protein, 648 aa, Triticum aestivum
TAIVLDVGTANNSEPIVLLPTEVEPQSSISSDIQEDTIFNYRRKYLPTQQVAYHTPPRFPAEVIDCIRKGVSLLFRHFGLRDFARIDGWFLPSPATSLPSSENGVKFGNTEYGAILFTDINLISGMEQTSFLFQQASKIGFSHSRILRTIVQRACSRFPSLVPSNNAWTALSRKMQSAKQAEIIQNGTCKQKAFVIFGGDTSERQVSLMSGTNVWLNLQGFEDLDVTPCLLAPSNGYSSHNEDFSESSRDVWTLPYSLVLRHTTEEVHAACFEAIEPERVEITSRLRNQVMKELERALSKQDWFAGFDITDEQPIKYSLQQWIDYVKEAKAVVFIAVHGGIGEDGTIQSLLESAGVPYTGPGPIASRTCMDKVATSLAVDHLASYGIHTIPKDVRAREELLKSSLVDIWNDLKAKLQTETVCVKPARDGCSTGVARLRCPEDLEVYANALRGTLPRLPANCLSKAHGVIEMPVPPPESLIFEPFIETDEIIISNKSWNDSTRHLVWKGENEWLEVTVGVVGKRGEMHSLNPSITVKESGDILSLEEKFQGGTGINLTPPPATIMSEDALQKCKSCIEMTANTLGLEGFSRIDAFVNVHSGEVLLIEVNTVPGMTPSTVLIHQALTEEPPIYPHKFFRTLLDLAFARAG

SEQ ID NO: 293 - protein, 339 aa, Zea mays
MERYEVIKDIGSGNFGVAKLVRDVRTKELFAVKFIERGMKIDENVQREIMNHRSLRHPNIVKFKEVVLTPTHLAIVMEYAAGGELFERICNAGRFSEDEARFFFQQLISGVSYCHSMQICHRDLKLENTLLDDSIAPRLKICDFGYSKSSVLHSQPKSTVGTPAYIAPEVLARKEYDGKVADVWSCGVTLYVMLVGAYPFEDPDEPKNFRKTLTRIISVQYAVPDFVRVSMECRHLLSRIFVAKPEQRITIPEIKNHPWFLKNLPIEMTDEYQMNLQLVDMNVPSQSLEEIMSIILEARKPGDGLKHAGQLPGLGSMELDDIDVDDIDVEDSGDFVCAL

SEQ ID NO: 294 - protein, 289 aa, Sorghum bicolor
MSKDDVTAEAEAAAKAPYWDPPPAPLLDTSELKKWSLYRALIAEFMATLIFLYVSIATVIGYKNQSKAESCTGVGALGIAWSFGATIFILVYCTGGISGGHINPAVTFGLFVGRKLSLVRTLLYIVAQCLGAICGVGIVKGIMKVPYNSLGGGANAVATGPSDGVLTGYSVGSALAAEIVGTFILVYTVFSATDPKRTARDSFIPVLVPLPIGFAVFVVHLATIPITGTGINPARSLGAAVVHAAWKDHWIFWVGPLIGATVAALYHKLVLRGEAVKALGSFRSTSATV

SEQ ID NO: 295 - protein, 946 aa, Oryza sativa
MLIPLAHLPRPPPLTASAIFRPRAPRLLASLSLATPPPPLLAASAFASLPLRALLSESQREVEMVGESEGRPLRVGLVCGGPSPERGISLNSARSVLDHIQGEDLLVTCYYIDCGMNAYAISPAQLYSNTPSDFDFKLESLAQGFQSLFDFAQHLAANVDIVFPVIHGKFGEDGGIQELLEKANVPFVGTPSKNCLLAFDKYNASLELNAQGFLTVPNFLVEKDKLAKSKLEEWFQSINLDKENGKVVVKPTSAGSSIGVVVAYGANDAAEKAEGIISEGIDDKVIIEVFLEGGTEFTAIVVDVGTANNSEPVVLLPTEVELQSSSNIDIQEDTIFNYRRKYLPTRQVAYHTPPRFPSEVIDCIRQGVSILFRCLGLRDFARIDGWFLPTPVTSLPSAENTGKFGNTKYGAVLFTDINLMTGMEQTSFLFQQSSKVGFSHSRILRTVVQHACSRYPSLVPCSNAWTALSRKIQAAKQAEAIQKGTSKKKVFVIFGGDTSERQVSLMSGTNVWLNLQGFDDLDVTPCLLTSGNGYSSFHNQNMNGISRDVWTLPYSLVLRHTIEEVNAACIEAIDPERMELTSRLRDQVMNELGQSLSKYDWFAGFDIADKQPIKYSLQQWINHVKEAQAVVFIAVHGGIGEDGTIQSLLGSAGVPYTGPGQIASRTCMDKVATSLAVSHLASYGVHTIPKDLRATEEILKSSPDDIWNDLKAKLQTETVCVKPARDGCSTGVARLCCPKDLEVYANALERKLQRMPANCLSRAHGVIEMPVSPPESLIFEPFIETDEIIISTKSVDDSTRHLVWKGENKWLEVTVGVVGKRGEMLSLNPSITVKESGDILSLEEKFQGGTGINLTPPPSTIMSEEALQKCKSCIETLANTLGLEGFSRIDAFVNVQNGEILLIEVNTVPGMTPSTVLIHQALTEKPPIYPHKFFRTLLDLAFARAN

SEQ ID NO: 296 - protein, 414 aa, Triticum aestivum
MSWLARSIAATLSSAPDDDEDDHSEAASGDKSPDHAASADAEEDEQPDTPGRGVKGDISELTESLTRRFWGVASFLAPPPPAGAEAAETSTAAAEAEAEGEYGPQSPRVAGIRNDLAEIGGRVRSGISMLSNANAVAEISKIASSFLPFVPEEEEEEVDAVGVTEEVVVFVRHISTSPETWLDFPLFVNDRHADDFELSDTQYEHALAIERIVPSLSYLRTELCSTNMSEACFWKIYFVLLHSKLNKEDAELLSTTQILEAREELLQSSPRMKNVASEGPGGSSESSNVLSTQAEDIELSPSSIQDKSGMAEATSFQEPTPDPLPGAEADKHPISTSEPEIIDKSVIEEELVVKTEIKNPGDKPNLYTPEDDDDKEVEDWLEDMDHADNKTGNITSVGQDEDVSFSDLEDDDDD

SEQ ID NO: 297 - protein, 232 aa, Setaria italica
TSSAIMVYREAVSTGLVPSSDVLSQVLGCLRLPHDNSLKSSFIENMGISCDIPHNPNINSLFEGFGEYDIRAFSMLEEAASLGAVSSISMKDTRIVIDARKLKIYSAEVSLLTTLRSLKHRLAAGARLPNVTILLPTEKKQVDIDEREKTLKLSGRIGQAIGSLLRRLGISYQGEESHGRMRINGLTLRRWFNPKLNSKSSSAAPADLLPLSSRLAKGIADQQRDIRSLSLE

SEQ ID NO: 298 - protein, 506 aa, Hordeum vulgare
VVLKGKPRFADFSLVPHGWGAKVSPWVAALGPAYPRLERICLKRMTVSDDELALIPKSFPLFKDLSLVCCDGFTTRGLAVIAEGCRHLRVLDLTEDYFHEEESEVVDWISKFPECNTSIESLVFDCVSVPFNFEALEALVARSPALRRLRVNDHVSIEQLRRLMARAPHLTHLGTGSFRSEPGPGGALSVSELAASFAASRSLVCLSGFLDVNGAYLPAIYQVCPNLTSLNFSFAALTAEEFIPVIRHCINLRTLWVLDTVGDEGLRAVAETCSNLRELRVFPLDATEDSEGSVSDIGLQAISEGCRKLESILYFCQRMTNAAVVAMSENCPDLLVFRLCIMGRHRPDRITGEPMDEGFGAIVMNCKKLTRLSVSGLLTDKAFAHIGKHGKLIKTLSVAFAGNSDMSLQHVFEGCTRLQKLEVRDSPFGDKGLLSGLNYFYNMRFFWMNSCRLTVRGCGDVAQQMPNLVVEVMKENEGEMDTVDKLYLYRSLAGPREDAPSFVNIL

SEQ ID NO: 299 - protein, 387 aa, Hordeum vulgare
EHFVDPEDKSHPKFSDVSDLEFLMFPREDQLTGGSATRLQLGEAVSEGTVNNETLGYFIGRVYLFLTQLGIDKDRLRFRQHLPNEMAHYAADCWDAEIECSYGWIECVGIADRSAYDLRAHSDKSGVPLEAHEKFAEPREVEKLVITPSKKELGLTFKGNQKAVLEALEAMGETEALGMKAALESKGEVEFKVCTLGRDVTVKRNMVSINMEKKKEHQRKFTPSVIEPSFGIGRIIYCLFEHCFYQRTGRTDDEQLNVFRFPPLVAPIKCTVFPLVKVEKFDIVAKKISKALTTAGISHIIDITGTTIGKRYARTDEIGVPLAITVDSTTSVTIRDRDSKDQIRIEVDEVASVVKEVTDGQSTWADIMWRYPAHTTLATDEEEASET

SEQ ID NO: 300 - protein, 302 aa, Hordeum vulgare
NDLAEIGGRVRSGISMLSNANAVAEISKIASSFLPFAPEEEEEDEVDAVGVTEEVVVFVRHISTSPETWLDFPLFVNDRHADDFELSDTQYEHALAIERIVPSLSYLRTELCSTNMSEACFWKIYFVLLHSKLNKEDAELLSTTQISEAREELLQSSPRMKNVSSEGPGCSSESSNVPSTQAEDIEFSPSSIQDKIGTAEATSFQEPTPDPLPAAEADKHPISTSEPEIVDKSVIEEELVAITEIKNPGDKPNLYTPDDDDDKEVEDWLEDMDHDDNKTGNITSVGQDEDVSFSDLEDDDDD

SEQ ID NO: 301 - protein, 745 aa, Hordeum vulgare
FVSCCCLASPHCRHYILDLMRVTPRDANYIGLQHRFCVLRPELVASFVEAESIKKSPTQKVPDVPTELNGQESDDQHVRASDTTAASVEENDKSDEGPASAPAESNDSTDEILFNPNVFTEYKLAGSPEEIEADEALVKKVGSYLLDTVIPKFVQDLCSLDVSPMDGQTLTDVLHSNGINVRYLGKVAGMIKDLPHLWDLFSAEIIVRSAKHVVKDILRQSPDHNIAPAVAHFLNCFFGKVLAVATKGTGSPQSKTQKGQKSSQSASSKKGQSAYSQLTSDGVWSDIKEFAKHKYQFEAPDDARAGAKRVAVLRNLCQKVGITIAARKYDLHSTAPFQSSDILNLQPVVKHSVPTCTDARKLMEAGKIRMAEGTLNEAYGLFSEAFSLLQQINGPMHKDAANCCRYLAMVLYHAGDTAGAIVQQHRELIINERCLGLDHPDTAHSYGNMALFYHGLNQTELALRHMSRTLLLLSLASGPDHPDVAATLINVAMMYQDASNMSTALRYLQEALKKNERLLGPGHIQTAVCYHALAIAFSCMGAYKLSVQHETKTHDILVKQLGSDDSRTKDSENWLNTFKEREQQVIAQKQKGQVTAPSANAVEFLKAHPGLFQAMKAAAIQSGGDGPANVNRGRGGDERAAKAAAEARKTAVARGVNLRNGPAASVSDINQILNLINSAASASAASPAANAQTPESEVPQSNGTTLNGAKEAKDASRLAAKADGQAPVGLGASLELKKQKSKQKA

SEQ ID NO: 302 - protein, 282 aa, Hordeum vulgare
YRGGRHREALELYSAALAAARGHAQRIALHSNRAACYLKLHDFHKAAEECTSVLELDTEHAGALMLRAQTLVTLKDYQSALFDVNRLIEINPSSEVYRNLHARLKTQLSLAPIPESDEESLYTEEDKEDLPPKDNTKNETALVKSDQPSAKLIPENKPVTKALKVEVLPNLHSKPEGTIQKPKGHSELDYKEPLTEAPKVQVSPSLYKEPLTEARKVQVSPSLPSKPECWGTIQKPKGHSGLDYSKWDKVENDSSEDDDDDEEDDLPRYKFKVRTIGVRTVK

SEQ ID NO: 303 - protein, 352 aa, Setaria italica
MEVGDLHKVWDVRELKRKPDAAAARALLDRVAKQVQPIMRRHKWRVKVLSEFSPRNARLLGLNVGAGVEVKLRLRRAGRDYDFIPYEEVLDTMLHELCHNDRGPHDAQFYKLWDELRKGITGTGQGFDGTGRRVGGFTIHPPPPSLRQATLVAAQKRARNGALLPSGPRKLGGNNDIMSALSPAQAAAMAAEWRMHDDLWCGSHNQSGIDDSDDVIILEEPPNNMTIKDGKTTKGSCSNTSAESSTSSGIHTAARDGPSSFWTTGDAVDDSKWECGACTLLNQARFLFHLPLAPICEVCGTAKPKIAKAKYMTWSCKFCTLENSTKLDKCSACDHWRYSYGPPIATYGPSYD

SEQ ID NO: 304 - protein, 686 aa, Sorghum bicolor
MFFRARRAAARRSHTHTPTTRAAGRTQSVAMGFFQQCSSSSSSPLLPVLLALIGLYCAAAVSCSAAAAPLPAPETTTTMHESYAGKSEFRTVNRKELDSCLNPSPYLAINVGAGAAIPDEAFLQVTVSGVLKPDASDWVAMITPSNSSVAGCPLSGVNYVETGDLANLPLLCHYPVKSQYLTSDPGYMGCKNAGCGKRDASGACKARTCAATLTFHVVNFRTDVEFVLFSGGFKTPCLLKRSGALRFANPASPLYGHLSSTDSKATSMKLTWVSGDGNPQQVQYGDGKSSTSEVATFTQDDMCSVPVLPSPAKDFGWHDPGYIHSAVMTGLQPSQSYTYRYGSDSVGWSDRVKFKTPPAAGSDELSFVIYGDMGKAPLDPSVEHYIQPGSISVTKAVAKEIQTGNVDSIFHIGDISYATGFLVEWDFFLHLITPLASQVSYMTAIGNHERDYANSASVYVTPDSGGECGVAYESYFPMPAVSKDKPWYSIEQGTVHFLVMSTEHEWSEKSEQYNWMDEDLSSVDRSRTPWVIFIGHRPMYSSHGGILPNVDSNFVASVEPLLFNYQVDLVFFGHVHNYERTCAVYQGDCKGMPTKDKNGIDVYDNSNYTAPVHVIAGAGGFTLDSFPNNGEAWSLSRVSEFGYGKVHATRTDMLVQFVNSSSMEVRDQFRIVKGASVNKTPSLILQ

SEQ ID NO: 305 - protein, 667 aa, Hordeum vulgare
MLLRLLSSSSRAIATKPHPPQTLAAAAAGATTSTTRKLAAMAGNREAFRVVVANTLERRLFYVPSFKIYGGVAGLYDYGPPGCAVKANVLASWRQHFVLEEGMLEVDCPCVTPEIVLKASGHVEKFTDLMVKDEKTGNCYRADHLLKDFCKEKLEQDTTLSPEKVEELNHILAVLDDLSAEQLGAKIKEYGIVAPDTKNPLSDPYPFNLMFQTSIGPSGLSAGYMRPETAQGIFVDFKDLYYYNGNKLPFAAAQIGQAFRNEISPRQGLLRVREFTLAEIEHFVDPEDKSHPKFSDVSDLEFLMFPREDQLTGGSATRLQLGEAVSEGTVNNETLGYFIGRVYLFLTQLGIDKDRLRFRQHLPNEMAHYAADCWDAEIECSYGWIECVGIADRSAYDLRAHSDKSGVPLEAHEKFAEPREVEKLVITPSKKELGLAFKGNQKAVLEALEAMGETEALGMKAALESKGEVEFKVCTLGRDVTVKRNMVSINMEKKKEHQRKFTPSVIEPSFGIGRIIYCLFEHCFYQRTGRTDDEQLNVFRFPPLVAPIKCTVFPLVKVEKFDIVAKKISKALTTAGISHIIDITGTTIGKRYARTDEIGVPLAITVDSTTSVTIRDRDSKDQIRIEVDEVASVVKEVTDGQSTWADIMWRYPAHTTLATDEEEASET

SEQ ID NO: 306 - protein, 786 aa, Hordeum vulgare
MASSLTPRSQFQKKENLGNARRGMGYNAPPRRNVLSAINNGGGANADPAPSEAGSEAPAFEFSGRDDVDRLLNEKMKGKSKNDYKGRTEQMSEYIKRLRACIRWLVELEDGYLAEQEKLRGQIDSDNARHAEFEAQLSGALEELKAANLEMTTRCDSLEESLNKEKAARLLAVESYEKEREERESAEASRDVLTVDLERVTHEAKRFSEQLKMVQDTNKRLQEYNSSLQQYNSNLQADTSKNGEIISKLQREKSAMMEAMTNLKDLNNSMKNQLDSSMSSQKEAIRVKEELRKEVECLRADLQQVREDRDQSVAQLNTLTAELATYSEQARKSSKDSELLQIKAAAFEETCSSQQEQIETLQKQLAVATEKLKHADVTAIEAMTGYETQKVTIKDLEERLAHAEFQIIEADKLRKKLHNTILELKGNIRVFCRVRPFLSDTDSNGQEEAIISYPSSVENAGRGIDLMNQGQRCSFSYDKVFDHSASQDDVFVEMSQLVQSALDGYKVCIFAYGQTGSGKTYTMMGKPGRDQKGIIPRSLEQIFKTSQSLETQGWKYCMQASMLEIYNETIRDLLAPGRSSSEMPGGKQYTIKHDSQGNTTVSDLTTTNVFSTADVTSLLEKASHSRSVGKTQMNEQSSRSHFVFTLKIFGSNESTGQQVQGVLNLIDLAGSERLTKSGATGDRLKETQAINKSLSALSDVIFAIAKNDDHVPFRNSKLTYLLQPCLGGDSKTLMFVNVSPEATSAGETLCSLRFASRVNACEIGVARRQTQSKSSSSDNSNRLSYG

SEQ ID NO: 307 - protein, 183 aa, Hordeum vulgare
MALQVWMVGENGEDLNNHRELLPLSKLQEIGVLYWHLDPKKSESEQELAKIRKDRGYSYMDYLDICPGKLANFEEKLKNFFTEHMHADEEIRYCLEGGGYFDVRDKDDKWVRIWIKEGDMIVLPAGIYHRFTLDAANHVKLMRLFLGEPVWTAHNRPQEDHPVRQEYVKRLTDDNAGHALAAH

SEQ ID NO: 308 - protein, 586 aa, Hordeum vulgare
MERILKSARESGSLNLSNRALSDVPGEVYNNLDTGSLDDKWWEGVDLQKLILAHNNLEVLREDLRNLSSLVVLNISHNQISSLPAAIGDLPLLKSLDASFNQIKLIPEEVGLASALVKADFSNNCLTELPASLGRCLNLSELKASNNNISRLPDELAGCCKLSKFDMEGNKLVLLPENMFTSWTLLTELNAAKNQLTTIPASIGALSKLVRMDLHQNKITSIPSSIKGCSSLAEFYMGNNSLSTIPADIGMLSKLGTLDLHSNQLKEYPVGACKLKLSFLDLSNNALSGLPPELGTMTTLRKLLLSGNPMRALRSSLVSGPTSTLMKYLRSRLSSDEEASGSRTTPTKDDQISAARRLSASSKELNLSGLGVPNVPPAAWETSDVVKLDLSKNLIEDLPNELSLCSSLQALILSNNKIKKWPSMVVSSLPSLTSLKLDNNPLAAISSTDLESLSKLEVLDLSGNASSLTEPSVISSLPQLHELYLRRMKLQEFPIGLFQLKHLRILSLSQNHLTTIPEGIKDFSALVELDLSDNNITALPAELGLLEPSLQVLKLDGNPLRSIRRTVLERGTKAVLSYLKEKLPSN

SEQ ID NO: 309 - protein, 134 aa, Hordeum vulgare
MGSLTSSSTGRKSTVESVDPEAACALLASEQYGYVDVRMWEDFDKGHVAGARNVPYYLSVTPNGKERNPHFVDQVAALHSKQDRLLVGCRSGVRSRLATTDLVAAGFTNVKNLEGGYLSLLKSASYPQPTTSHP

SEQ ID NO: 310 - protein, 400 aa, Hordeum vulgare
MGKSKDKKASREAKVDKKLALGLGVKRKQLKKKKDRVLDAAVESEGAAGHAIVEDKGSKKTVLMKQKKKTKHARVISSRSKADNLVTLNEDEATPKLKKKNKKQLKESKSPIEVQSPLDSNDAGTMKLKKKKKKAKEGKSSVEPNDADAILHENLDKETLNTDVNQLAAGSEVRDIGKPEKAKKRKKNKTTDVHQVAAESEVMDIGEPEKAKKRKKNKTKKVKQSGEVNKIDTQVSVREDNLEMHEVDTANVDEIASVDEDCSRGMQKWILEYRQKRPGLKVLQQNIDVFITAHEEQQEQEKKEREAAAAEDGWTVVMHHKGRKKTTDAETGTAVGSVSLAAMQEKMAKKKPKEVGRNFYRHQKREAQMSELAMLQSKFEQDKKRIQQLRAQRKFKPYGF

SEQ ID NO: 311 - protein, 712 aa, Hordeum vulgare
MEESFVPLRGIKNDLRGRLTCYKQDWTGGFSAGIRILAPTTYIFFASAIPVISFGEQLERSTDGVLTAVQTLASTALCGIIHSVVGGQPLLILGVAEPTVIMYTFMFSFAKDRADLGPNLFLAWAGWVCVWTAVLLFLLAVLGACSIINRFTRIAGELFGLLIAMLFMQQAIKGLVDEFRIPERENIKALQFVPSWRFANGMFAIVLSFGLLLTALRSRKARSWRYGAGWLRGFIADYGVPLMVLVWTGVSYIPHDSVPKGIPRRLFSPNPWSPGAYDNWTVIQDMPNVPLMYIIGAFMPATMIAVLYYFDHSVASQLAQQAEFNLRKPPSFHYDLLLLGFLTLLCGLIGIPPSNGVIPQSPMHTKSLATLKHQILRNRLVATARQSMRQNASLSQLYNSMQDAYHQIQTPLIHQQQSVKGLNELKDSTVQLASSMGNFDAPVDETIFDIEKEIDDLLPMEVKEQRLSNFLQAVMVGGCIAAMPLLKKIPTAVLWGYFAFMAIESLPGNQFWERILLLFTAPSRRYKVLEEYHTTFVETVPFKTIAMFTLFQTTYLLVCFGITWIPIAGVLFPLMIMLLVPVRQYILPKLFKGAHLNDLDAAEYEESPAIPFNLATQDIDVALGHTQSAEILDDMVTRSRGEIKRLNSPKITSSGGTPVTELKGIRSPCISEKAYSPRITELRHERSPLGGRDSPRTGEARPSKLGEGSTPK

SEQ ID NO: 312 - protein, 295 aa, Hordeum vulgare
MAGAEAVERAHELYRGGRHREALELYSAALAAARGHAQRIALHSNRAACYLKLHDFYKAAEECTSVLELDTEHAGALMLRAQTLVTLKDYQSALFDVNRLIEINPSSEVYRNLHARLKTQLSLAPIPESDEESLYTEEDKEDLPPKDNTKNETALVKSDQPSAKLIPENKPVTKALKVEVLPNLHSKPEGTIQKPKGHSELDYKEPLTEAPKVQVSPSLYKEPLTEARKVQVSPSLPSKSECWGTIQKPKGHSGLDYSKWDKVENDSSEDDDDDEEDDLPRYKFKVRTIGVRTVK

SEQ ID NO: 313 - protein, 449 aa, Brachypodium distachyon
MEKKFTVTRTSKSLVPPSSSSPTPAATEDDAPVPVIMRLSTIDRVPGLRHLVLSLHAFDGHGVVAGEGDEERIRGPARVVREALGKALVDYYPFAGRFVVDEEGEVGVKCSGEGAWFVEAKAECSLEEARHLDGNPMEMVIPKEDLLPEPIPGVDPLDIPLIMQVTEFTCGGFVVGLISVHTIADGLGAGQFINAVADYARGLPKPRVSPVWARDLIPDPPKMPAPPPKLELLDLRHFTVDLSPDHIAKVKSQYFASTGHRCSAFDVVVAVTWQSRTRALRLAGAGYDDVHVCFFANTRHLMLHGGAGAAGFYGNCFYPVRATCGSAEVASADVAGVVKVVRDAKARLAGDVARWAVGGFEQDPYELTFTYDSLFVSDWTRLGFLEADYGWGPPAHVVPFSYHPFMAVAVIGAPPKPKLGSRVMTMCVEEDHLPEFRDQMNAFAFTAGK

SEQ ID NO: 314 - protein, 649 aa, Brachypodium distachyon
MPLAAAATVAAARPSPIGLPRPLCRASAHPRRRFRLQATSPASTPAPAPAPATADEGPGAGPCPVVRFDMADFTVADRVSVGLHGRSDEMIFEATVRDPSSELYGSTVVLRQLTSSQAKRRGRRALEVLKKLARRQIMYHSYAMQVHGYVTPSNVMEEGDGPFILVHGYHGSYSLRHWLQLSDWLPTLEATLALDEEQVRRVGDDSIGGPAVTRQLRLIRILMRDLLIGVNYLHSHGMAHTELRLENVHVSPVDKHVKVGILGNAVDFHDSDPNNSSVPSNNDRRKMMIAFDMRCVGFIMAKMVLKELMDSSTFLKFKSFLNKGNDPSCLREFLVPILSQNSPTGNIGLQMLDRHWGAGWNLLALLLATKSDNRISCLNALRHPFLCGPKWRISPSVNVVRWGLGSTAVRLAEDYIYGHHQRRRLAYFIELMEVLNPNSRTESWLHLLPGRWCLLYCTGRHIGLTLRQPTPRILMSDVFLTFAQTPESVDPVLSLASDIGFKIMPESDWPHDKSGTEGNLSVTTSARIAPGRIYINAEDSKDSRITSSRRYLHGKWGKASKMKELPASLPTASINVDEDEVDVSMTCGSTLNVNSARKVLQEVRTQTPPEMFDLSKIVCGTYIDSRLMILRGVNGSALLFIRSNCTSDS

SEQ ID NO: 315 - protein, 353 aa, Setaria italica
MEVGDLHKVWDVRELKRKPDAAAARALLDRVAKQVQPIMRRHKWRVKVLSEFSPRNARLLGLNVGAGVEVKLRLRRAGRDYDFIPYEEVLDTMLHELCHNDRGPHDAQFYKLWDELRKECEELVSKGITGTGQGFDGTGRRVGGFTIHPPPPSLRQATLAAAQKRARNGALLPSGPRKLGGNNDIMSALSPAQAAAMAAEWRMHDDLWCGSHNQSGIDDSDDVIILEEPPNNMTIKDGKTTKGSCSNTSAESSTSSGIHTAARDGPSSFWTTGDAVDDSKWECGACTLLNQPLAPICEVCGTAKPKIAKAKYMTWSCKFCTLENSTKLDKCSACDHWRYSYGPPVATYGPSYD

SEQ ID NO: 316 - protein, 283 aa, Setaria italica
MDEVTQAVENLKKEWNQAVSQLEESIAAIRSCGKTGKGTEEANSLPRLNGSAQDALQLLKSLQFRLDLLAQQLPTFEEVQSGQATLESWDEQYKKLRASLRNANLQAKENIRKAAQEERELLLGGGEESTIRRRNLQTKTGMTSAAESITESLRRSRQMMVQEVERSASTLATFDESTSVLRKAEGEYQGHRSLLSRTRGLLSTMQRQDVLDRVILTAGFIIFSLAVLYVVSRRIGLLTLQRKLADAIRSGSLSAEDIVAKAQQHGPAAADAAGPAPPIYDEL

SEQ ID NO: 317 - protein, 342 aa, Setaria italica
MMFWRDGGGSGSGSGSGRDSLSGGPPCGQVRVLVVGDSGVGKSSLVHLLLNGSAVARPAQTIGCAVGVKHITYSSPGSSSNSIKADAERNFFVELWDVSGHERYKECRSLFYSQINGVIFVYDLSQRKTKTNLNKWAVEVAESGTFSAPLGSGGPGGLPVPYLVIANKVDIAPRDGRRVSSGNLVDVARQWVEKQGLLPPSDELPLADSFPGNSGLLTAAKEARYDKEALIKFFRMLIRRRYFSNELPAPSPWSLTSREDTILPVETVNDDDLFQRKSYGSQSYKYNGVAPLPAQRNLTPPPTLYPQQPMSSSSENYRYHRFSSSSIPDSGGGRPSRADINI

SEQ ID NO: 318 - protein, 793 aa, Zea mays
MDPEFGVGTAPQKGRRAWRTTLLLAYQSLGVVYGDLSISPLYVYKSTFAEDITHSETNQEIFGALSFVFWTLTLVPLLKYATIVLRADDSGEGGTFALYSLICRHANVSLLPNRQVADEELSTYRLERPREAAGRSGLLRAWLEKHTRLHTALLVMVMIGTCMVIGDGVLTPAISVFSAVSGLELSLSKDQHEYAVIPITCAILVFLFALQHYGTHRVGFLFAPIILAWLLCMSAIGLYNIVRWNPQIYQALNPIYMIRFLRKTKKSGWMSLGGILLCMTGSEAMFADLGHFSYSAIQLAFTSLVYPSLILGYMGQAAYLSQHHNLDASYQIGFYIAVPECVRWPVLVLAILASVVGSQAIISGTFSIINQSQSLSCFPRVKVVHTSDKVHGQIYIPEVNWILMILCVAVTVGFRNTKHMGNASGLAVITVMLVTTCLMPLVIMLCWDRSPWLALAFFLFFGSIEALYFSASLIKFLDGAWVPILLALILLAVMFVWHHTTIRKYEYDMHNKVTLEWLLALGDKLGMVRVPGIGLVYTDLTSGVPANFSRFVTNLPAFHRVLVFVCVKSVPVPHVLPAERYLVGRVGPPGHRSYRCIVRYGYRDVHQDVDSFETELVESLATFIKLDALFRCSDAAGDQQRDSSYYERENALTVIGSNPLRRHLALGYDDSHSHDDGASSAGSDRVDGIELAAAAPAPAVVKKQVRFAVAPPRSPGVDETVLEELHELCEAREAGTAFILGHSHVKTKPGSSILKRLAVGVGYNFLRRNCRGPDVVLRVPPASLLEVGMVYVL

SEQ ID NO: 319 - protein, 252 aa, Zea mays
MAATAPNGNPTVSSLAATVPVQAVLFDIDGTLCDSDPLHHVAFQEMLLEIGYNNGVPIDEEFFIKNIAGRSDVEAAQNLFPDWELEKGLKFLEDKEAKYRSLAKERLVPVKGLAKVVQWVKDHGYKRAAVTNAPRINAELMISLLGLSDFFQAVIVGGECEQPKPAPYPYLRALKELQVSAEHSFVFEDSPAGIRAGVAAGMPVVGVATRNPEKSLVEAGAALLVKDYEDPKLWAALEEIDGEEAKLKKASE

SEQ ID NO: 320 - protein, 307 aa, Zea mays
MAENFQLQGRHGKSRVRVSRVWRRPAAAGGDVIVEWNVAVSIVSDCLPSYTSSDNSAIVATDSIKNTVYVKAKECTEVVSMEEFAVILGRHFTSLYPQVSEATVTIVERPWERVTVDGKPHSHGFKVGVEKHSTEVIVKKSGSLLINSGIQGYSLLKTTQSGFEGFVTDRYRLLPDTRERIVATEVTAWWRYPFEHVSQLPSKPFCFTQRYQDVKKVLAETFFGPPDVGVYSPSVQNTLYLMAKEVLTRFPDISSVQLRMPNLHFLPVNLGSKEAPLVKFADDVYLPTDEPHGTIEATLISRPMSKL

SEQ ID NO: 321 - protein, 920 aa, Zea mays
MRSLTVASRHPGAAFSTRRRPLLHPAAAGRDSTFQRCWRWEKTQDSSFGSSLRTSRLPRTVHGDILKNLLAPTAGAVSVEQAEAIADLPKGDMWSVHKFGGTCMGTSERIHNVADIVLRDPSERKLVVVSAMSKVTDMMYNLVNKAQSRDDSYIAVLDEVFDKHMTTAKDLLAGEDLARFLSQLHADISNLKAMLRAIYIAGHATESFSDFVVGHGELWSAQMLSYAIQKSGTPCSWMDTREVLVVNPSGANQVDPDYLESEKRLEKWFSRCPAETIIATGFIASTPENIPTTLKRDGSDFSAAIIGSLVKARQVTIWTDVDGVFSADPRKVSEAVILSTLSYQEAWEMSYFGANVLHPRTIIPVMKYNIPIVIRNIFNTSAPGTMICQQPANENGDLEACVKAFATIDKLALVNVEGTGMAGVPGTANAIFGAVKDVGANVIMISQASSEHSVCFAVPEKEVALVSAALHARFREALAAGRLSKVEVIHNCSILATVGLRMASTPGVSATLFDALAKANINVRAIAQGCSEYNITIVLKQEDCVRALRAAHSRFFLSKTTLAVGIIGPGLIGRTLLNQLKDQAAVLKENMNIDLRVMGIAGSRTMLLSDIGVDLTQWKEKLQTEAEPANLDKFVHHLSENHFFPNRVLVDCTADTSVASHYYDWLKKGIHVITPNKKANSGPLDRYLKLRTLQRASYTHYFYEATVGAGLPIISTLRGLLETGDKILRIEGIFSGTLSYIFNNFEGARTFSDVVAEAKKAGYTEPDPRDDLSGTDVARKVIILARESGLGLELSDIPVRSLVPEALKSCTSADEYMQKLPSFDEDWARERKNAEAAGEVLRYVGVVDVVSKKGQVELRAYKRDHPFAQLSGSDNIIAFTTSRYKDQPLIVRGPGAGAEVTAGGVFCDILRLSSYLGAPS

SEQ ID NO: 322 - protein, 162 aa, Zea mays
MAAVSSTSTAASYFSPQPQLPISTADPAASKSRLMRQPRRSSSFVMVEASSASGSDGGVARTKSLTEDDLEELKGCLDLGFGFAYSEIPELCGTLPALELCYSMTRRFLDEQKAPGQEEELEPASPPLPNWRISGPGDDPEEVKARLKYWAQAVACTVKLCS

SEQ ID NO: 323 - protein, 220 aa, Zea mays
MAAAVESVVVVHNVAKRHNVGTLARSATAFGVAEVVVVGRRDVSAFGSHGATSHLRFRHFVSLALARAYLKDERGCDICGVEITDDAQPVTAHPFRRSTAFLFGNEGTGLSQKECEICDFFVYIPQYGGGTASLNVTVAASIVLHHFGVWAGFTERGREGNKFVVAERPQGHSRGLYCTDSVEAVVEERKMRKENACDVLEENGSSHPQESNGLDLMFAD

SEQ ID NO: 324 - protein, 279 aa, Oryza sativa
MAEEQPRAAAEGGGETLMEKIADKLHIGGDGSSSDSDADERKQPKPSAPPAPAEVATESFVDSAAAAAAEAKAKVFRLFGREEPIHKVLGGGKPADVFLWRNRNISAGVLGGATAIWILFELLGYHLLTFVCHGLIFSLGLLFLWSNASSFINKSPPRIPEVIIPEDLVVNIALSTRYEINRAFANFRQIALGRDIKKFLIVIAGLWLLSVLGSCCNFLTLVYIVFVVLHTVPILYEKYEDQIDSYGEKGWVEIKKQYAVFDAKVLSKVPRGPLKDKKH

SEQ ID NO: 325 - protein, 558 aa, Sorghum bicolor
MDPAQYFQPRTFSIKLWPPSESTRLMLVERMTKNLSTESESIFSRKYGTLGKEEAHENAKRIEELCFASADEHFKREPDGDGSSAVQLYAKETSKMMLEVLKKGPRTTAELEAPVADTPLVPDTPLVPADTPLVPADTVLDISGGKRAFIEADEAKELLSPLTKPGNSYQRICFSNRSFGIGAANVAGPILESVKNQLTEVDISDFVAGRPEDEALDVMRIFSKALEGSVLRYLNISDNALGEKGVRAFSELLKSQESLEELYVMNDGISEEAAKALSELIPATEKLKVLHFHNNMTGDEGAMYIAEMVKRSPNVESFRCSATRIGSDGGVALSEALGTCTRLKKLDLRDNLFGVDAGLALSKTLPKLPDLVELYLSDLNLENEGTIAIVKALKQSAPQLEVLEMAGNEINAKAAPDLAECLTAMQSLKKLTLAENELKDGGAVIIAKSLEDGHTDLKELDVSTNMLQRVGARCFARAVADKPAFVQLNINGNFISDEGIDEVKEILKAGKKSLDVLGSLDENEPDGEPDDEEEDEDAEDNEDELDSKLQSVKVEQDD

SEQ ID NO: 326 - protein, 773 aa, Sorghum bicolor
MPDLPCDGDGVCMVCRAASPPEVDLLRCSTCATPWHSPCLSKPPALADAASWSCPDCSPDPAAAAAPSGPANTLVAAIRAIEADTTLSDHEKARRRQALLAGDAHDDDDDDDAAADDALEIVGKNFSCVFCMKLPDRPVTTPCGHNFCLKCFQKWIQNRKRTCAKCRAQIPAKMAEQPRINSALVEVIRMAKISKNPNSAGSAVPYHYIRNDDRPDKAFTTDRAKKSGKANASSGQIFVTIAPDHFGPILAENDPRRSIGVRVGETWEDRLECRQWGAHFPHVAGIAGQSTYGAQSVALSGGYEDDEDHGEWFLYTGSGGRDLSGNKRTNKEQSSDQKFEKLNAALRISCLKGYPVRVVRSHKEKRSSYAPESGVRYDGVYRIEKCWRKIGIQGKFKVCRYLFVRCDNEPAPWTSDDHGDRPRPLPKIKELQGATDITERKGRPSWDYDEKDGWKWMVPPPVSKKPVLSGDPETDKQIRRATKRAHLSVAERLLKEFGCSICRAVIKEPLTTPCAHNFCKTCLLGKYDSQSSMRERSRGGRTLRAQKIVKTCPSCPTDICDFLENPQINREMMELIETLQRKAVEEGKVASDDAEECGDGDSEENDGALVKGEEDDSGLNEEEQDSADADANADGSVKIVVEIKEGGKDDKKSEMGATEVVDVLVDEDAAKQTKKRKVDEDAVKQTKKRKGDAETGTNGAKRMKSSAAVEEVAVCGTPVKRTRKSGDMDAEGNGSPAVSSGRRVTRSSSVNATGADDSPARRTRSRAGADAGC

SEQ ID NO: 327 - protein, 419 aa, Triticum aestivum
MSWLARSIAATLSSAPDDDDDDDDHHSEAATGDETPDHAASADAEEDEQPDTPGRGVKGDISELTESLTRRFWGVASFLAPPPPPAGAEAETSTAAAEAEAEAEGEYGPQSPRVAGIRNDLAEIGGRVRSGISMLSNANAVAEISKIASSFLPFVPEEEEEDVDAVGLTEEVVVFVRHISTSPETWLDFPLFVNDRHADDFELSDTQYEHALAIERIVPSLSYLRTELCSTNMSEACFWKIYFVLLHSKLNKEDAELLSTTQILEAREELLQSSPRMKNVASEGPGGPSESSNVLSTQAEDKELSPSSIQDKSGMAEATSFQEPTPDPLPGAEADKHPISTSEPEIIDKSVIEEELVVKTEIKNQGDKPNLYTPEDDDDKEVEDWLEDMDHADNKTGNITSVGQDEDVSFSDLEDDDDD

SEQ ID NO: 328 - DNA, 792 bp, Zea mays
gcctggcccattgcaatctcgagaagcaactccgtcgcgccgcactcaatcgcctccgattctgcggagactcagcatcggaatggcggcggcggctcgtgccgggttccggcggctcttctccgtctcggccttcgctgcaccgcctcctcctgccgcgcgccccgcggcgaacccttgcaacaacctcttcgtctcagggttaaataaacgcacaacgtccgagggacttaaggaagcattttctaaatttggtcaggttattgaagcaagagtaatcactgataggatatctggatactccagaggatttggctttgtcaaatatgcgactgtacaagaagctggtgaggccataaaaggcatggatggaaagttccttgacagttgggttattttcgctgagacgccacacaaccatcacaacaaggagcaccagcttatgattgaagttgccatacacggtcgatgacatacactgtatttttctgccgagtgtaatagtggatgttgattgccggccaaacatttgcagagagaatgtagcttgatgtgctccttgaacttcctttgttgtggttaacattggacttactgcaacctcatgcgcgtggcccataactttcgtctttcatttacaggtcactacattttttttgaccactgtgttggaaggaggttacactgcagcagaaatgcaatgtgttggaaggaggcccacctcctccttcggccaaaaacagtataaaataaatatgtcgaattatacaagaaaaaaaattgacccctcaa

SEQ ID NO: 329 - DNA, 3867 bp, Brachypodium distachyon
cgcggttcgcgcgcacttgatattagcacggcctcggaagctagcaacctctccccttattagtactcctcgtcttcatccctcacgacctctcgtcttccgcgccccttgatcaaaaatcaaacacgggaaagccaaaaaaactacaggcagcaaagccattgttgatcgacccatggagcacgctcgcctcgtcacacccacagcgctcgcggccgtgcccttcttcttcctcttcctcctcctctgcctgcacgccgatgcggccacgacgctcttacaaggccaatcgctgggccgcaacgacaagctcgtgtcgcccaacggcgcgttcctcctcgccttcttcgtcccgcgcggcggcggcgacgggtcgcgcgcgtacctcggcgtcctctacgcccgcgccgcggaggagaccgtgccgtgggtcgccaaccgcgacgcgccggtcagcgcctcctccgccttatactccgccacggtcacttcctccggccagctccagatcctcgagggcgaccgcgtcgtgtggcagaccagcaacacgccgccttcgtcttcctcggggaacaacaacaacttcactctcacgatccaagacacgggaaacctcgtgctcggcaatgggggacagaatacggcgccgctgtggcagagcttcgaccacccgacggacaccttccttccggggatgagcatcacgctggaccggcgcgacggggccgtggcgagcaacacgctattcacctcctgggccagccccggcgacccggccccgggcaacttcacgctgggccaggacccgctcggctcggcccagctctacatctggcgccacacccccggcaataccccgaacaacagcggcatcaagtactggagatcggggcagtgggccaacaccaagttcgtgggcatcccctggcggtccctctacgtctacgggttcaggctcgccggcgacgcgtcgcggggcagcggcacccgcggcggcgtcatgtcctacaccttcagcgcctacaacgagtcccagttcaggttcgtgctgaagcccaacggcacggagacctgctacatgctcctggaatccacgggcgcctgggaggtggtctggtcgcagcccaccatcccttgccacgcctacaacacgtgcggccccaacgccggctgcgccgccgccgacgaccatggccgcgccgccgcctgcaagtgcctccaggggttcgagccgaggtcggaggaagagtattacgggagagggaactggacgcggggttgcgtgaggagcaagccgctgacgtgcagcgagaggaacgtggaggtgagcggtggcgacgccttcgcggcgctccccggcgtcaagcttcccgacttcgccgtgtgggagtcgacggtcggcggcgccgacgcgtgcaaggggtggtgcctggctaactgcacgtgtggtgcgtacagctacagcgacggcaccgggtgcttgacgtggtccggccgggatttggtggatgtctacaagttccccaacggagaagggtatgacctgcacatcaaggtccctgcttctctattagaaacaggcgcgaaacggaggcgatggacagcggttattgtcagcgtagtcaccgccctggcggttgtactggccgcttgcggcattctcctgtggaaatgcagaagaagaatcggagagaaattgggcgttggcggcagggaagagaagaagccgagaccctcgatgctgcatccccggagggaagcgaaaaacgatttctcggggcccaaacagcagcccgatctcgaggaagcggagaacggcgacagctgcgagctgccgcttttcccccttgagaccttggcggaggccaccggcggcttcagcgactccaacaagctcggcgagggagggttcggccatgtgtacaaggggagtcttcccggcggcgaagaggtggcggtgaagaggctgtcgaagagctcggggcaggggtgcgaggagttcaagaacgaggtgatactcatctcgaagctgcagcaccgcaacctggtccggatcctggggtgctgcatccaggggcacgagaagatgctggtctacgagtacatgcccaacaaaagcctcgacgccttcctcttcgatccggcgcggcgggggctcctggactggaagacgaggctgagcatcatcgaagggatcgcgcgggggctgctgtacctccacagggactcgaggctccgcgtggtgcacagggacctcaaggccagcaacatcctcctggaccacgacatgaaccccaagatctccgacttcggcatggccaggatcttcggcggcgaccagaagcaggagaacaccaaccgcgtcgtcgggacactagggtacatgtcgccggaatacgcgatggagggcctgttctcggtgaggtccgacgtgtacagcttcggcatactggtgctggagatcatcaccggccagaagaacagcagcttccaccacatggaaggctcgctcaacatcgtaggctacgcgtggcagatgtggaacgcggacaaggggtcggagctgatcgacccgtcgatccggtcgtcgtcggcgtcgcgggaggcgctgcggtgcgtccacatggcgctgctgtgcgtgcaggaccacgcgtgcgaccggccggacatcccctacgtggtgatggcgctgggcagcgacagctccgtgctgccgatgcccaagccgcccaccttcacgctgcagtgcacctcgtccgacagggaaggctttctcgggggcaatgccgattactacgagtcctactccgcttccgatctcacggtaaccatgctccaagggaggtgacagcagtacgtagacaggaattaatccatgtgctgattagctaggggctgggtgattttaggattttgagttttgtctcccttttgctctgtacattgcgcaattttgtaacaccgtgtgttgattatttttattttattttttgacatgaggaaaggctgtttagtcattatttgattattaccagaaagtgtatattttggggtagttctctggagagaacagcagaccactaggcaacgacagcattgaacgtccgttctgttttcggtacttctttccttccccattactaacagattcagtttattcagttcactaaataaggtagtaccattactcaacaggtcaatttaggacaaaatgtggcttagtttcttggtggacaagcacggtctatcaacaacgtctcgaagaacgagcaatttgtgatccatagaactccaataggcctcctatgacgcagccaacattattagctagagtattggtagccagatggtgtcccagctgattgtggcggctgctgggcttctctctgctttgcgtactccgcgaatatcacccaaccatcgaggaactttccatccatgccttttatgccctcaccagcttcttccacagttgcatatttaacaaagccaaaacctctggagtatccagatattctatccgtgatgactcttgcttcagtaacctgaccgaatttcgagaaggcttccctaagtccgtcagttgtcgtgcgcttattcaaccctgagacgaagaggttgttgcagggctccgccgcggggcgagcggccgggggaggcggtggggagaaggccgagacggaaaacatccgccggaacccagcacgagcagcaccggcgcgagaagcgaccgccgccatgagtatcgatgggtcggtggacggtggtgagtgcggcgctacgattagaggatttctcttgttgcgacgggaagggtttgctgtttgcgcttgctcagagttaatgttgggccgagaaggcgagaac

SEQ ID NO: 330 - DNA, 904 bp, Oryza sativa
gaatgattgagctctctcgacttctcgaatggtctcgaccatcttcgctaaacccttccttggtcgccgccgcgccgcaaagcctccgtccgttccgcaccgccgctctcttccccgccaccgtcggtcgctggctgagtatggcggcggccgctgctcgcgccgggttccggcggatgttctccgtctcgggcttcacgccgccgcctccccccgccgcccgccccttggcggacccctgcaacaacctcttcgtctcagggttgaataaacgcacgacatctgacggacttagggaagccttctcgaaattcggtcaggttattgaagctagagtaatcactgatagaatatctggatactctcgaggatttggctttgtcaaatatgcaactgttgaagaagccggtgagggcataaaaggcatggatggaaagttcctcgatggttgggtgatatttgccgagtacgccaagcagagagaagcacagcagccggcccaaccagcagcatcaactagttaccaatactccaaccaatgatagttgtctctacgatcaggattaccttctattggacaatattgttcgctattttaccatgtgaaaactgaaaatcactctccttgatatttcgtcagggagaaattttagtgtgcacggcatgaacatctccttagtaacttacggtgccgttttgtctgctactgtctgctgggtgactgtactctgtgagcttatgtaactatacaactgccttcatttttgagactacagtattttatgagctgcaactttaacgatccagaagttatcaaaactattaggcacgtattgcaatcgttttcctccaggaagcctactactaaccaagaagacactcggtggcctcgtattaagcttcg

SEQ ID NO: 331 - DNA, 940 bp, Triticum aestivum
cggcacaagcggaaacccttccgccgcaagcacgcgaagcctccattcgcctccgccccttcgcagcgccgctttcgccaccgactcatcgagacatcatacatggcggcggtcgcagcagctcgcgcaggtgcagcacgggccgggttccggcggatgttctccgtctccgccttcgctcccccgcctccccccaccgctcgccccgcggcggagccctgcaacaacctcttcgtctcaggtttgaataagcgcacgacatctgacggactgagggaagccttctcgaaatttggccaggttactgacgcaagagtcatcactgatagaatatctggatactctagagggtttggctttgtgagatatgcaaccgtggaagaagctggtgagggcataaaaggcatggatggaaagttcctggatggttgggtgatattcgcggagtacgccaagcagagagaagcccagcagccgccacaatcagccgggacacagtcatctggctaccaataccctagctagttagttctctcgatcagaaatggcttgttctcaatttatatgctaccaattggaagtcgatttccaataaattgttggggaagggataaaatctagtgttggtcgcttgaactattcccagtacggttatggacttgattatagtttcacttgtgtgcttggctgttgcctgctggctaatgctactttgtgtacgtgtgtgtaactgtaacatacgccagcagctataatttagaacttcgttacatatacaatcagtgtgtactagcagtcaggctctgtacagaaagccttgcgtgtgtttgtgtctatgcagtcttctgctgcctgcattggtgtaccataccagccggaagatcagctgcattgcaacagcaaactgccaacggtaaaactgatgatatatgcaggtatg

SEQ ID NO: 332 - DNA, 681 bp, Brachypodium distachyon
gcactcaccaccgtccaccgacccatcgatactcatggcggcggtcgcttctcgcgccggtgctgctcgtgctgggttccggcggatgttttccgtctcggccttctccccaccgcctcccccggccgctcgccccgcggcggagccctgcaacaacctcttcgtctcagggttgaataagcgcacgacaactgacggacttagggaagccttctcgaaattcggtcaggttactgaagcaagagtcatcacggatagaatatctggatactccagaggttttggctttgttaaatatgcaactgtggaagaagctggtgagggcataaaaggcatggatggaaagttcctcgatggttgggtgatattcgcggagtacgcaaagcagagagaagcccagcagccgccacaatcagctgggacaccatctggctaccaatactctagctaataatgttggctgcgtcataggaggcctattggagttctatggatcacaaattgctcgttcttcgagacgttgttgatagaccgtgcttgtccaccaagaaactaagccacattttgtcctaaattgacctgttgagtaatggtactaccttatttagtgaactgaataaactgaatctgttagtaatggggaaggaaagaagtaccgaaaacagaacggacgttcaatgc

SEQ ID NO: 333 - DNA, 731 bp, Secale cereale
cctccacattcgcctccgcccctacgcacttcgcagcgccgctttcgccaccgactcatcgggacatcatacatggcggcggtcgcagcagctcgcgccggtgcagcacgggtcgggttccggcggatgttctccgtctccgccttcgctcccccgcctccccccaccgctcgccccgcggcggagccctgcaacaacctcttcgtctcaggtttgaataagcgcacaacatctgacggactgagggaggccttctcgaaatttggtcaggttattgacgcaagggtcatcactgatagaatatctggatactctagagggtttggctttgtgaaatatgcaaccgtagaagaagccggtgagggcataaaaggcatggatggaaagttcctcgatggctgggtaatattcgcggagtacgccaagcagagagaagcccagcagccgccacaatcagctgggacacagacatctggctaccaataccctagctagttagttctctcgatcagaaatggcttgttctaaatttatgctgccaattggaagtcgatttccaataaattgttaagggataaaatctattgttggccgcttgaactattccagtacggttatatgtagtttcacttgtttgtgcttggccgttgcctgctggctaatgctactttgtgtacgtgtgtgtaactgtaacatacgctactggctataatttaaaacctcgttacata

SEQ ID NO: 334 - DNA, 1779 bp, Saccharum officinarum
cctacctccgccctcccagtctcagatccgcctcctcctcgctccctccctccctccctccatccatccatccatccctcccttctagatctcccgcccactcgagagtcgagatccaccgcctccgcgccccctcaccggaacagcagcgcgaggaagcagggggcagaggccagccatgggcaaggaaggggccagcggcggcggcggcggcgacggcggcatgtcggagtcggtgatccgcaaggtcctgatctcctacatgtacgtggcagtgtggatcttcctctccttctctgtgatcgtctacaacaagtacatcctcgaccccaagatgtacaactggcccttccccatctccctcaccatggtgcacatggccttctgctcctcgctcgccgtcgcgctcgtccgcgtcctccgcgtcgtcgacctcccttcctcgcccgccatgacgtcgcagctctacgtctcctccgtggtgcccatcggcgcgctatactcgctctcgctctggttctccaactccgcctacatctacctctccgtctccttcatccagatgctcaaggcgctcatgcccgtcgccgtctactccatcggggtgctcttcaagaaggagaacttcaagtcctccgccatgctcaacatgctctccatctccttcggcgtcgccattgccgcctacggcgaggcccgcttcgacgcccgcggcgtcgccctgcagctcgccgccgtcgccttcgaggccacgcgcctcgtcctcatccagatcctcctgacctccaagggcatctccctcaaccccatcacctcgctctactacgtcgcgccctgctgcctcgccttcctcgtcgtgccctgggtcttcgtcgagctgcccaggctgcgcgccgttggcagcttccaaccggacctctttgtcttcggcaccaactcgctctgcgccttcgcgctcaacctcgccgtcttcctgctcgtcggcaagacgtccgctctcaccatgaacgtcgcaggcgtcgtcaaggactggctgctcatcgccttctcctggtccgtcatccgcgacaccgtcacccccatcaacctcttcggctacgggatcgccttcctcggggtgggctactacaaccacgtcaagctgcaggcgctcaaggccaaggaggcgcagaagaaggcggcgcaggccgacgaggaggccggctcgctgctgcaggagcgcgactcgctcggcgaccgcaagactgacaaccaggcctagcgagtgtgacggatctcatgatccaaccgccctcgcccgattcggagacctggtgcaaacaccatctgaaaattggtggcttgatacatggttgatttccacggagctggcctcggttgggtgctttgacgcctaaccccattggttgatcttgtggggagtcttgaggaatttgttgtgtagggagcatcaggacgtagatctgcctgctggaccagaagaaacttgattctcacaatgtcacttttcttttttggagccatactattgttttgctattctttttccatatttgtcccttccgagcgcctgtactgtattcactcagtgaagggaacactacatcttcaaatgacaatcacatgacatgtctgcatacgactcccaccgttgcaaattatagacattgcttttgctaggcacttaaatatgcactacgtgtagatacatagtaaaaaggaaatgtatctagaaaagtcaaaaggtcttataatttgaaatggagagagtattcttct

SEQ ID NO: 335 - DNA, 1605 bp, Zea mays
cactaaacagaagctgcatcaacgcaactgtccacgtggccaacatccccctccgtccgagtctgcaataacccctctgcgcagacaccccaaacctccccgtcacctacctgcgccctcccagatccgcctccttctgcctccctgctttccttccagatctccggctccttcccactcgacagtcgagatccaccgcgtccgcgccccctcaccggagcagcgcgaggaagcggggggccagaggccaggccatgggcaaggaaggggccagcggcggcggcggcgacggcggcatgtcggcgtcggtgatccgcaaggtcctggtctcgtacatgtacgtggcggtgtggatcttcctctccttctccgtgatcgtctacaacaagtacatcctggaccccaagatgtacaactggcccttccccatctccctgaccatggtgcacatggccttctgctcgtccctcgccgtggcgctcgtccgcgtcctccgcgtcgtggacctcccgtcctcgcccgccatgacgtcgcagctctacctctcctccgtggtgcccatcggcgccctctactcgctctcgctctggttctccaactccgcgtacatctacctctccgtctccttcatccagatgctcaaggcgctcatgcccgtcgccgtctactccatcggggtgctcttcaagaaggagaccttcaggtcctccgccatgctcaacatgctctccatctcgttcggcgtcgccatcgccgcgtacggcgaggcccgcttcgacgcgcgcggcgtggccctgcagctcgccgccgtcgccttcgaggccacgcgcctcgtcctcatccagatcctcctcacctccaagggcatctcgctcaaccccatcacctcgctctactacgtcgcgccctgctgcctcgccttcctcgtcgtgccctgggtcttcgtcgagctgcccaggctgcgcgccgtcgccggcggcttccagccggacctcttcgtcttcggcaccaactccctctgcgccttcgcgctcaacctcgccgtcttcctgctcgtcggcaagacgtcggccctcaccatgaacgtcgccggcgtcgtcaaggactggctgctcatcgccttctcctggtccgtcatccgcgacaccgtcacccccgtcaacctcttcggctacgggatcgccttcctcggggtgggatactacaaccacgtcaagctgcaggcgctcaaggccaaggaggcgcagaagaaggcggcgcaggccgacgaggaggccgggtcgctgctgcaggagcgcgactcgcacggcgaccgcaagactgacgaccaggcctagcgagtgtgacggatctgaccgcccgatcggtctgaaccctgacaacccgtacaagttcgatgcaacatttgttcattccttgtgtcgaacatgtggggaaaaaagggaaatatatatgagcctttttttgtattttttggccagttgtagctgttactaccacataaacagtaagcaaaatcgttcgcattattatctaaagttattagtgcaattcgaccgagcactgacgaacaggatccagtgtttaaagttatattgctatggt

SEQ ID NO: 336 - DNA, 1595 bp, Zea mays
catgtggccagcaccctcctccgctcaagaccccaagtctgctagaacccgggcgcgctccaaattccccggtcacctacctcctctgccctctcactctcagatccgcgtcctcggctcctcctcctcctcctcctcctcccttccttcgttccttccagatctccctcccagtcgagagtcgagatccaccgcctccgcgccccctcaccggtgcagcgcgaggaagcggggggccagaggccagccatgggcaaggaaggggccagcgacggcggcatgtcggagtcggtgatccgcaaggtcctggtctcgtacatgtacgtggcggtgtggatcttcctctccttctccgtgatcgtctacaacaagtacatcctcgaccccaagatgtacaactggcccttccccatctccctcaccatggtgcacatggccttctgctcctccctcgccgtggcgctcgtccgcgtcctccgcgtcgtcgacctcccgtcctcgcccgccatgacgtcgcagctctacgtctcctccgtgctccctatcggcgcgctctactcgctctcgctctggttctccaactccgcctacatctacctctccgtctccttcatccagatgctcaaggcgctcatgcccgtcgccgtctactccatcggggtcctcttcaagaaggagaccttcaagtcctccgccatgctcaacatgctctccatctcgttcggcgtcgccatcgccgcctacggagaggcccgcttcgacgcccgcggcgtcgccctgcagctcgccgccgtcgccttcgaggccacgcgcctcgtcctcatccagatcctcctcacctccaagggcatctccctcaaccccatcacctcgctctactacgtcgcgccctgctgcctcgctttcctcgtcgtgccctgggtcttcgtcgagctgcccaggctgcgcgccgtcggcatcttccagccggacctcttcgtcttcggcaccaactccctctgcgccttcgcgctcaacctcgccgtcttcctgctcgtcggcaagacgtcggctctcaccatgaacgtcgccggcgtcgtcaaggactggctgctcatcgccttctcctggtccgtcatccgcgacaccgtcacccccatcaacctcttcggctacgggatcgccttcctcggggtgggatactacaaccacgtcaagctgcaggcgctcaaggccaaggaggcgcagaagaaggcggcgcaggccgacgaggaggccgggtcgctgctgcaggagcgcgactcgcacggcgaccgcaagactgacaaccaggcctagcgagtgtgccggatctcatgatccaattcgctcggttctgaacccagtgtactccaaatatgtgatccaacccttacacgtttgatgcaaaatttgttcatttcttgtctttgacttgatctggtggtaccaaggaaataagcacgggaaagatgcaagctttgtgtcgaacatgtgaaaaaaaatatatatgtatgagcaattttttgtcttttttttggggccagttgtagctgttactaccattaaacagtaagcaaaactgtttgcattttatc

SEQ ID NO: 337 - DNA, 1699 bp, Setaria italica
caaagcagcaacccaattgtccacgtggccatcacccccctcctcccaagcctgcaagaaccccctgcccacccgctccaaatccccccatcacctacctcctccgcccccgcctcccagatccgactcctcctccctccctccctccctccctccttcctcagatctccctcccgctcccgcgcgagatccaccgcctccgcgcgcgcccccctcaccggaggagcgctcgcgagctcgggggacagaaggcggccggacaggagccacagccatggggaaggagggcgccggcagcggcggcggaggcgacggcggcatgtcggagtcggtgatccgcaaggtgctcgtctcgtacatgtacgtggcggtgtggatcttcctctccttctccgtcatcgtctacaataagtacatcctcgaccccaagatgtacaactggcccttccccatctccctcaccatggtccacatggccttctgctcctccctcgccgtcgcgctcgtccgcgtcctccgtgtcgtcgacctgccctcgtctcccgccatgacgccgcagctctacgtcgcctccgtgctccccatcggcgcgctctactcgctctcgctctggttctccaactccgcctacatctacctctccgtctccttcatccagatgctcaaggcgctcatgcccgtcgccgtctactccatcggggtcctcttcaagaaggagaacttcaagtcctccgccatgctcaacatgctctccatctccttcggcgtcgccatcgccgcctacggcgaggcccgcttcgacgtccgcggcgtcgcgctgcagctcgccgccgtcgccttcgaggccacgcgcctcgtcctcatccagatcctcctcacctccaagggcatctccctcaaccccatcacctcgctctactacgtcgcgccatgctgcctcgccttcctcgtcgtgccctgggtcttcgtcgagctgcccaggctgcgcgccgtcggcaccttccagccggatctcttcgtcttcggcaccaactcgctctgcgccttcgcgctcaacctcgccgtcttcctgctcgtcggcaagacgtccgcgctcaccatgaacgtcgccggcgtcgtcaaggactggctgctcatcgccttctcgtggtccgtcatccgcgacaccgtcactcccatcaacctcttcggctacggcatcgccttcctcggcgtgggctactacaaccacgtcaagctgcaggcgctcaaggccaaggaggcgcagaagaaggcggcgcaggccgacgaagaggccggctcgctgctgcaggagcgcgactcgcacggcgaccgcaagactgacaaccaggcctagcgagtgtgacggatctgaagatccaaccgctctcgcccgattcggtcggttctgaatccactcccccctagtgtactccaaatgtgtgatccgatccttacaagtttgatgcaaaatttgttcatttcttgtcttggtctggtggtagcaaggcaaataagcacgggaaagatgcaagctttgtgtcgaacatgtgaaaaaaatatatgagcaatttttgtctttttgtccagctgtagtagttacactgcattgacagtagctatggatgaatcatcaaacattggatccactcgtgtaaaacgaatgcaaatcttgctcagtctttagagtagttaattt

SEQ ID NO: 338 - DNA, 1100 bp, Setaria italica
gccatggggaaggagggcgccggcagcggcggcggaggcgacggcggcatgtcggagtcggtgatccgcaaggtgctcgtctcgtacatgtacgtggcggtgtggatcttcctctccttctccgtcatcgtctacaataagtacatcctcgaccccaagatgtacaactggcccttccccatctccctcaccatggtccacatggccttctgctcctccctcgccgtcgcgctcgtccgcgtcctccgtgtcgtcgacctgccctcgtctcccgccatgacgccgcagctctacgtcgcctccgtgctccccatcggcgcgctctactcgctctcgctctggttctccaactccgcctacatctacctctccgtctccttcatccagatgctcaaggcgctcatgcccgtcgccgtctactccatcggggtcctcttcaagaaggagaacttcaagtcctccgccatgctcaacatgctctccatctccttcggcgtcgccatcgccgcctacggcgaggcccgcttcgacgtccgcggcgtcgcgctgcagctcgccgccgtcgccttcgaggccacgcgcctcgtcctcatccagatcctcctcacctccaagggcatctccctcaaccccatcacctcgctctactacgtcgcgccatgctgcctcgccttcctcgtcgtgccctgggtcttcgtcgagctgcccaggctgcgcgccgtcggcaccttccagccggatctcttcgtcttcggcaccaactcgctctgcgccttcgcgctcaacctcgccgtcttcctgctcgtcggcaagacgtccgcgctcaccatgaacgtcgccggcgtcgtcaaggactggctgctcatcgccttctcgtggtccgtcatccgcgacaccgtcactcccatcaacctcttcggctacggcatcgccttcctcggcgtgggctactacaaccacgtcaagctgcaggcgctcaaggccaaggaggcgcagaagaaggcggcgcaggccgacgaagaggccggctcgctgctgcaggagcgcgactcgcacggcgaccgcaagactgacaaccaggcctagcgagtgtgacggat

SEQ ID NO: 339 - DNA, 1730 bp, Panicum virgatum
acgatgctacaccgaggactgatatcatgagcttcgtactaatctcaaagcacccatagaccatagtgcaccgtagctcggcatgcggtacacaagaactcctcccgttccgttcctcacggctcttgccgttgtgacggaccgggtcgacacggcacggcggaacggaagctccgagcccgagccgcgacccctagggcccacattaaaacaagtcaaagcaccctccgctaaacagaaagcccctataaaacgtcccccaaagcagcaacccaagtgtccacgtggccatcagccccctcctcccaagcctgcaagaaccccctgcccaccccgctccaaatccccccaccacctacctccgcccccgcctcccagatccgactcctcctcctccctcctcagatctcgcccccgctcccgcgcgagatccaccgcctccgcccgcgccccctcgccggaggagccggtgcgaaccgggggcagcggtggccgggcagaagccagccatggggaaggagggcgccggcagcggcggcggcgactccggcatgtcggagtcggtgatccgcaaggtgctcgtctcgtacatgtacgtggcggtgtggatcttcctctccttcgccgtcatcgtctacaacaagtacatcctcgaccccaagatgtacaactggcccttccccatctcgctcaccatggtgcacatggccttctgctcctccctcgccgtcgcgctcgtccgcgtcctccgcgtcgtcgacctgccctcctcgcccgccatgacgccgcagctctacgtcgcctccgtgctccccatcggcgcgctctactcgctctcgctctggttctccaactcggcctacatctacctatccgtctccttcatccagatgctcaaggcgctcatgcccgtcgccgtctactccatcggggtgctcttcaagaaggagaccttcaagtcctcctccatgctcaacatgctctccatctccttcggcgtcgccatcgccgcctacggcgaggcgcgcttcgacgtccgcggcgtcgcgctgcagctcgccgccgtcgcgttcgaggccacgcgcctcgtcctaatccagatcctcctcacctccaagggcatctcgctcaaccccatcacctcgctctactacgtcgccccctgctgcctcgccttcctcgtcgtgccctgggtcttcgtcgagctgcccaggctgcgcgccgtcggcaccttccagccggacctcttcgtcttcggcaccaactcgctctgcgccttcgcgctcaacctcgccgtcttcctgctcgtcggcaagacgtccgcgctcaccatgaacgtcgccggcgtcgtcaaggactggctgctcatcgcattctcctggtccgtcatccgcgacaccgtcacccccatcaacctcttcggctacgggattgccttcctcggcgtgggctactacaaccacgtcaagctgcaggcgctcaaggccaaggaggcgcagaagaaggcggcgcaggccgacgaggaggccgggtcgctgctgcaggagcgcgactcgcacgccgaccgcaagacggacaaccaggcgtagcgagtgtgacggatctgatgatccaaccgtcctcgcccgattcggtcggttctgaatccagtcccccccccttagtgtactgtatgatccgacccttacaagtttgatgcaaaatttgttcatttcttgtcttggtctggt

SEQ ID NO: 340 - DNA, 1678 bp, Panicum virgatum
atcagccccctcctcccaagcctgcaagaaccccctgcccacccgctccaaatccccccaccacctacctccgcccccgcctcccagatccgactcctcctcctccctcctcatatctcgcccccgctcccgcgcgagatccaccgcctccgcccgcgccccctcgccggaggagccggtgcgaaccgggggcagcggtggccgggcagaagccagccatggggaaggagggcgccggcagcggcggcggcgactccggcatgtcggagtcggtgatccgcaaggtgctcgtctcgtacatgtacgtggcggtgtggatcttcctctccttcgccgtcatcgtctacaacaagtacatcctcgaccccaagatgtacaactggcccttccccatctcgctcaccatggtgcacatggccttctgctcctccctcgccgtcgcgctcgtccgcgtcctccgcgtcgtcgacctgccctcctcgcccgccatgacgccgcagctctacgtcgcctccgtgctccccatcggcgcgctctactcgctctcgctctggttctccaactcggcctacatctacctatccgtctccttcatccagatgctcaaggcgctcatgcccgtcgccgtctactccatcggggtgctcttcaagaaggagaccttcaagtcctcctccatgctcaacatgctctccatctccttcggcgtcgccatcgccgcctacggcgaggcgcgcttcgacgtccgcggcgtcgcgctgcagctcgccgccgtcgcgttcgaggccacgcgcctcgtcctaatccagatcctcctcacctccaagggcatctcgctcaaccccatcacctcgctctactacgtcgccccctgctgcctcgccttcctcgtcgtgccctgggtcttcgtcgagctgcccaggctgcgcgccgtcggcactttccagccggacctcttcgtcttcggcaccaactcgctctgcgccttcgcgctcaacctcgccgtcttcctgctcgtcggcaagacgtccgcgctcaccatgaacgtcgccggcgtcgtcaaggactggctgctcatcgcattctcctggtccgtcatccgcgacactgtcacccccatcaacctcttcggctacgggatcgccttcctcggcgtgggctactacaaccacgtcaagctgcaggcgctcaaggccaaggaggcgcagaagaaggcggcgcaggccgacgaggaggccgggtcgctgctgcaggagcgcgactcgcacgccgaccgcaagacggacaaccaggcgtagcgagtgtgacggatctcattatccaaccgcgctcgctcgattcggtcggttctgaatccagtcccccctagtgtactgtatgatccgatccttacaagtttgatgcaaattttgttcatttcttgtcttggtctggtggtggcaaggcaaataagcacgggaaagatgcaagctttgtgtcgaacatgtgaaaatatatgagcaattcttgtctttttgaccagctgtagttcttagtactacgtacttggacaggacgccaaattgtttgcattgtctatgtagctacatggatgatcggttttgtctcgcaaactgaatgcaaatctacatcagtttctagagctgttaatttaatattgaactggttctaactatat

SEQ ID NO: 341 - DNA, 1827 bp, Oryza sativa
gtccaatatcccaagacaattaagagccacaatagattaaggtcatagcaactgaaatgcaattgatccattggccaatcttataaaactgattaactccatgttccgtactagataaaatgtaaagtattccatgatacatactcagctaacagtactccacaatgtagacaattttcatatactgtcaaagtaactacaagtggcaaaaattgactcatattttcatatgcccgacacaaagatcgtacttttcctgtatttatttgccttcctaccacaaattaagacaagaaatgaacagattttgcatcaaactagtagaggatcacacattgatgaattcattagaaccaaccaaattgcgtgtgctgttggaccagatcccacgctttaggcctggttgtcgctcttgcgttcgccgtgcgagtcacgctcctgcagcagcgagccggcctcctcgtcggcctgtgcggccttcttctgcgcctccttcgccttgagcgcctgaagcttgacgtggttgtagtagcctacaccgaggaatgcgatcccgtagccgaacaggttgatcggcgtgaccgtgtcccggatcacagaccaggagaaggcgatgagcagccaatccttgacgacgccggcgacgttcatggtaagcgcggacgtcttgccgacgagcaagaagactgccaggttgagcgcaaaggcgcacagggagttggtgccgaagatgaagaagtctggctggaacgtgccgacggcgcgcagcctgggcagctcgacgaaggcccagggaatgacgaggaaggcgaggcagcacggcgcgacgtagtagagcgaggtgatggggttgagcgagatccccttggaggtgaggaggatctggatgaggacgaggcgagtggcctcgaaggctacggcggcgagctggagcgcgacgccgcgggcgtcgaagcgggcctcgccgtaggcggcgatggcgacgccgaaggagatggagagcatgttgagcatggcggaggacttgaagttctccttcttgaagagcacgccgatggagtacacggcgacgggcatgagcgccttgagcatctggatgaaggagacggagaggtagatgtacgcggagttggagaaccagagggagagcgagtagagcgcgccgatggggagcaccgaggaggtgtagagctgcggcgtcatggcgggggacgacgggagctcgacgacgcggaggaggcggacgagcgcgatggcgagggacgagcagaaggccatgtgcaccatggtgagcgagatggggaagggccagttgtacatcttggggtcgaggatgtacttgttgtagacgatgaccgtgaaggagaggaagatccacaccgccacgtacatgtacgacaccagcaccttccggatcaccgaatccgacatgcccccctcgccgccagcgccgccgccgccctccttccccacggccatcctcctccccgccgcccgccgctcggtctctccggctccggcgagacggtggatctgggcggggtggcgagctgtcccgcgtcggcgcgctcgcgagatggagtgtgagatctgggagggagcaggggaggaggaggaggcggatctggctgggaaggaggagaggtaggtggaggaggaagaggagggggtttcctctccaaatcaatcggcggtgcggtgcggtgcgagtagcggaggagtgggggatggatggggggagatggccacgtggagaatagcctctgcctgcatcttggggcgcccccttttataggccggatttgattttgtttttacggccttttc

SEQ ID NO: 342 - DNA, 1683 bp, Oryza sativa
attctccacgtggccatctccccccatccatcccccactcctccgctactcgcaccgcaccgcaccgccgattgatttggagaggaaaccccctcctcttcctcctccacctacctctcctccttcccagccagatccgcctcctcctcctcccctgctccctcccagatctcacactccatctcgcgagcgcgccgacgcgggacagctcgccaccccgcccagatccaccgtctcgccggagccggagagaccgagcggcgggcggcggggaggaggatggccgtggggaaggagggcggcggcggcgctggcggcgaggggggcatgtcggattcggtgatccggaaggtgctggtgtcgtacatgtacgtggcggtgtggatcttcctctccttcacggtcatcgtctacaacaagtacatcctcgaccccaagatgtacaactggcccttccccatctcgctcaccatggtgcacatggccttctgctcgtccctcgccatcgcgctcgtccgcctcctccgcgtcgtcgagctcccgtcgtcccccgccatgacgccgcagctctacacctcctcggtgctccccatcggcgcgctctactcgctctccctctggttctccaactccgcgtacatctacctctccgtctccttcatccagatgctcaaggcgctcatgcccgtcgccgtgtactccatcggcgtgctcttcaagaaggagaacttcaagtcctccgccatgctcaacatgctctccatctccttcggcgtcgccatcgccgcctacggcgaggcccgcttcgacgcccgcggcgtcgcgctccagctcgccgccgtagccttcgaggccactcgcctcgtcctcatccagatcctcctcacctccaaggggatctcgctcaaccccatcacctcgctctactacgtcgcgccgtgctgcctcgccttcctcgtcattccctgggccttcgtcgagctgcccaggctgcgcgccgtcggcacgttccagccagacttcttcatcttcggcaccaactccctgtgcgcctttgcgctcaacctggcagtcttcttgctcgtcggcaagacgtccgcgcttaccatgaacgtcgccggcgtcgtcaaggattggctgctcatcgccttctcctggtctgtgatccgggacacggtcacgccgatcaacctgttcggctacgggatcgcattcctcggtgtaggctactacaaccacgtcaagcttcaggcgctcaaggcgaaggaggcgcagaagaaggccgcacaggccgacgaggaggccggctcgctgctgcaggagcgtgactcgcacggcgaacgcaagagcgacaaccaggcctaaagcgtgggatctggtccaacagcacacgcaatttggttggttctaatgaattcatcaatgtgtgatcctctactagtttgatgcaaaatctgttcatttcttgtcttaatttgtggtaggaaggcaaataaatacaggaaaagtacgatctttgtgtcgggcatatgaaaatatgagtcaatttttgccacttgtagttactttgacagtatatgaaaattgtctacattgtggagtactgttagctgagtatgtatcatggaatactttacattttatctagtacggaacatggagttaatcagttttataagattg

SEQ ID NO: 343 - DNA, 1791 bp, Brachypodium distachyon
gcgaaggaacccagtctccacgtggccatccccagcaagaccaagacatcaaagagccctcacccggcccaggagaggaggtcgctcactccaccaccaagaaccggcactcgcccgagccccaaatcccccaaccaccaacctcctcttcctcctcccagatccgcctaccctccccacactactcccagatctccccagcagatccaccgcctcgccggagcaggagcaggagccgcgcgcagccatggcgaaggaggccggcggcggcggcggcggcggcggcgatgcggccctgtcggattcggtgctccgcaaggtgttggtctcctactgctacgtcgcggtgtggatcttcctctccttcacggtcatcgtctacaacaagtacatcctcgaccccaagatgtacaactggcccttccccatctccctcaccatggtccacatggccttctgctcctccctcgccgtcgccctcgtccgcgtcttccgcgtcgtcgacctcccgtcgtcgcccgccatgacgccgcagctctacacctcatccgtcatccccatcggcgcgctctactccctctccctctggttctccaactccgcctacatctacctctccgtctccttcatccagatgctcaaggcgctcatgcccgtcgccgtctactccatcggggtgctcttcaagaaggagaccttcaggtcctccgccatgctcaacatgctctccatctccttcggcgtcgccatcgccgcctacggcgaggcccgattcgacctccgcggcgtcgcgctccagctcgccgccgtcgccttcgaggccaccaggctcgtcctcatccagatcctcctcacctccaagggtatctcgctcaaccccatcacgtcgctctactacgtcgcgccctgctgcctcgccttcctcttcgtgccctgggtcttcgtcgagctgcccaggctgcgcgccgtcggcatgttcgagccggacttcttcgtcttcgggaccaactcgctctgcgccttcgcgctcaacctcgcggtcttcttgctcgtcggcaagacgtccgcgctcaccatgaacgtcgccggcgtcgtcaaggactggctgctcatcgccttctcctggtccgtcatccgggacacggtgacgccgattaacctgttcggctacgggatcgccttcctgggcgtgggttattacaaccacgtcaagctgcaggcgctcaaggccaaggaggcgcagaagaaggtggcgcaggccgacgaggaggccggctcgctgctgcaggagcgcgaatctcacggcgaacgcaagactgatagccagtcctagagcggcggatccgatccaacagctccccccaaattggtcggtttctgaatccagcatagcgaattccccaatgtgtgatccttacaagtttaatgcaaaatctgttcatttcttgtcttaatttgtggtggaaaagcaaataaatacaggaaatatgcgatctttgtgtcgagcgtgtgaaaatacaagtgattttcatttttttttggcctcattgtactccgttactatcttagacagtaagtagtccagtatctaaagttgtctgcggtggctattatatttagctacggatgatcaaatgttctcaattcgtctttgtaccaaacactgagtaaattggtgccgtagagatcgagcaattattgagcaggaatcaataaaaatattcaatccttggaattgttcgtgcgtttgatcttgatatttatgtttctaattatgttgggatattggac

SEQ ID NO: 344 - DNA, 2271 bp, Panicum virgatum
tgaaacttaccggggcaagtttttaacttcctgccggttatttttacagtttttccttttgctttcttcaattggtcagctacttaaacgaagcacttggccactactcctgcaagtagctcacgttgcgcgatgccaatcgacccaccagaaattcatattttgattaaaaaaaagagagcccaaaacaaacgaaagacaagtcaaagcccttgattaaaatttggccgtaaaccagatccttgatcgctctttttcacattaaaaaatgggcaaatgaaataaacatcgcccaccgaacatgcgaacgcgaagcgattttccacgtggccaccgcgcccagtccacgctcccccacctaaacccccggcccatccccgcctcttccccaaatcctcagatccgcctcctccagagcccagagcacctcctcccggcccgggcctctccccccctcgcgccgcgcctcccctcccctccgcccggatccagatccgccgccaccacctcctgctccagctgctgcccctactccaccgccaccgcgtgcgagagccagcagggcggcggcggcggcgccatggggcgggacggcggcggcgccggcggcatgtcggagtcggtgctccggaaggtgctcctctcctactgctacgtcgcggtgtggatcttcctctccttctccgtcatcgtctacaacaagtacatcctcgaccccaagatgtacaactggcccttccccatctcgctcaccatggtgcacatggccttctgctcctccctcgccgtcgcgctcgtccgcgtcctccgcgtcgtcgacctccccacctcccccgccatgacgccgcagctctacacctcctccgtcgtccccatcggcgcgctctacgccatgtccctctggttctccaactccgcctacatctacctctccgtgtccttcatccagatgctcaaggcgctcatgcccgtcgccgtctactccatcggggtgctcttcaagaaggagaccttccggtcctcctccatgctcaacatgctctccatctcctttggcgtcgccatcgccgcgtatggcgaggcgcgcttcgacttgcgcggcgtcgcgctgcagctagccgccgtcgccttcgaggccacgcgcctcgtgctcatccagatcctgctcacatccaagggcatctcgctcaaccccatcacctcgctctactacgtcgcgccgtgctgcctctgcttcctcgtcgtgccctgggctttcgtcgagctgcccaggctgcgcgccgtgggcacattccagcctgatttcttcatctttgggaccaactcactctgcgccttcgctctcaacctcgctgtcttcctgcttgtcggcaagacctccgcgctgaccatgaacgtggccggagtagtcaaggactggctgctgattgccttctcgtggtccgtgatccgggacacggtcaccccgatcaacctgttcggctacgggatcgctttcctgggggtggcctactacaaccacgtcaagctgcaggcgctcaaggccaaggaggcgcagaagaaggccgcacaggccgacgaggaggctggttcgctgttgcaggagcgcgatgggcacagtgatcgcaagagtgacaaccaggcttagagtgccagatctgatactggcttccccatattggggatccggtgcaaggtgcaaagactgtagtctggtctacggttcctttcaaagaggtgtttcactcctttaactttagatggatctgaagagcaaatcacaagtatttattggattagggattatgcacctgcttcctggagagctttaccctgtttctattagctgtttttgttccacagaaaggcacgccttgctactcatcacttgcctattgcctacatttatttgttctagtagcttagggactaaagatgtactgctgcagattggtaatttggtggttattttctatatgtaatgagcttactgtaatctacacgctaaatctttctctggtgaaacttagtgatcacgcgtgtaactattattagggtgtccttatcagatttaaggtgcattatacagtcaacacatctctttgcaatgcagatggttgtgtttgtagcacttaatttcacctgctggttgagatcaagcattgtagtttgtaagcatttcaatttgcattttggtccactgatgattgaactagctttggttggttaacatgataatgacatatactgtagctcagctgccttgttaat

SEQ ID NO: 345 - DNA, 1790 bp, Panicum virgatum
ggtcgacccacgcgtcctcctccagagcccagagcacctcctcccggcccgggcctctccccccctcgcgccgcgcctcccctcccctccgcccggatccagatccgccgccaccacctcctgctccagctgctgcccctactccaccgccaccgcgtgcgagagccagcagggcggcggcggcggcgccatggggcgggacggcggcggcgccggcggcatgtcggagtcggtgctccggaaggtgctcctctcctactgctacgtcgcggtgtggatcttcctctccttctccgtcatcgtctacaacaagtacatcctcgaccccaagatgtacaactggcccttccccatctcgctcaccatggtgcacatggccttctgctcctccctcgccgtcgcgctcgtccgcgtcctccgcgtcgtcgacctccccacctcccccgccatgacgccgcagctctacacctcctccgtcgtccccatcggcgcgctctacgccatgtccctctggttctccaactccgcctacatctacctctccgtgtccttcatccagatgctcaaggcgctcatgcccgtcgccgtctactccatcggggtgctcttcaagaaggagaccttccggtcctcctccatgctcaacatgctctccatctcctttggcgtcgccatcgccgcctatggcgaggcgcgcttcgacttgcgcggcgtcgcgctgcagctcgccgccgtcgccttcgaggccacgcgcctcgtgctcatccagatcctgctcacatccaagggcatctcgctcaaccccatcacctcgctctactacgtcgcgccgtgctgcctctgcttcctcgtcgtgccctgggctttcgtcgagctgcccaggctgcgcgccgtgggcacattccagcctgatttcttcatctttgggaccaactcactctgcgccttcgctctcaacctcgctgtcttcctgcttgtcggcaagacctccgcgctgaccatgaacgtggccggagtagtcaaggactggctgctgattgccttctcgtggtccgtgatccgggacacggtcaccccgatcaacctgttcggctacgggatcgctttcctgggggtggcctactacaaccacgtcaagctgcaggcgctcaaggccaaggaggcgcagaagaaggccgcacaggccgacgaggaggctggttcgctgttgcaggagcgcgatgggcacagtgatcgcaagagtgacaaccaggcttagagtgccagatctgatactggcttccccatattggggatccggtgcaaggtgcaaagactgtagtctggtctacggttcctttcaaagaggtgtttcactcctttaactttagatggatctgaagagcaaatcacaagtatttattggattagggattatgcacctgcttcctggagagctttaccctgtttctattagctgtttttgttccacagaaaggcacgccttgctactcatcacttgcctattgcctacatttatttgttctagtagcttagggactaaagatgtactgctgcagattggtaatttggtggttattttctatatgtaatgagcttactgtaatctacacgctaaatctttctctggtgaaacttagtgatttcgcgtgtaactattattagggtgtccttatcagatttaaggtgcattatacagtcaacacatctctttgcaatgcagatggttgtgtttgtagggctacttaatttcacctgctggttgagatcaagcattgtagtttgtaagc

SEQ ID NO: 346 - DNA, 1905 bp, Setaria italica
gcgcccagtccacgctcccccacctaaaccccccggcccatcccccacctcttccccaaatcctcagatccgcctcctcctccagcacctccccactcccggcccttcttccccccctcgcgccgcgccttcacaacccaaccctcgccacccccggatccagatccgccgccgccaccaccacctcctccgcccaccaccacctcctccttcctcctcctgcctcctccctcccaccaccaccgcgtgcgggggcccagcagggaggcggcggcggcggcatggggcgggacggcggcggcggcggcatgtcggagtcggtgctccggaaggtgctcctctcctactgctacgtcgcggtgtggatcttcctctccttctccgtcatcgtctacaacaagtacatcctcgaccccaagatgtacaactggcccttccccatctcgctcaccatggtgcacatggccttctgctcctccctcgccgtcgcgctcgtccgcgtcctccgcgtcgtcgacctccccacctcccccgccatgaccccgcagctctacacctcctccgtcgtccccatcggcgcgctctacgccatgtccctctggttctccaactccgcgtacatctacctctccgtgtccttcatccagatgctcaaggcgcttatgcccgtcgccgtatattccatcggggtgctcttcaagaaggagaccttccggtcctcctccatgctcaacatgctgtccatctcctttggcgtcgccatcgctgcctacggcgaggcgcgcttcgacctgcgcggcgtcgcgctgcagctggccgccgtcgccttcgaggccacgcggctcgtgctcatccagatcctgctcacatccaagggcatctcgctcaaccccatcacctcgctgtactacgtcgcgccgtgctgcctctgcttcctcgtcgtgccctgggctttcgtcgagctgcccaggctgcgcgccgtgggaactttccagccagatttcttcatcttcgggaccaactcgctgtgcgccttcgcgcttaaccttgccgtcttcctgctcgttggcaagacctccgcgctgaccatgaacgtcgccggagtagtcaaggactggctgctgattgccttctcatggtcggtgatccgggacacagtcaccccgatcaacctgtttggctacgggatcgctttccttggggtggcctactataaccacgtcaagctgcaagcgctcaaggccaaggaggcgcagaagaaggccgcgcaggctgacgaggaggctggttcgctgttgcaggagcgcgatgggcacggtgatcgcaagagtgacaaccaggcttagagtgccagatctgatactggcttccccatattggggatatggtgcaaggtgcaaaggctgtagtttggtctacggttgctttcatgaaggtgtatgccagattcttgcacttctttaactttagttggatatgaagaacgaatcagaagtatttattggattaggaaatatgcacctgcttcctggagagctttaccctgttatttatttagctgtttttgttccacagaaaggcatgccttgctacctctctcttgcccattgcctaaatttatttgttctaagtagcttagcgactaaagatgtactgctgcagattggtaatttggtggttattttctatatataatgagcttactgtactctacacttcacatctttctctgttgaaattttgtgatttggcgttttgtacggatcatgtttactgatggtaagtgccctttttcacaattaaggtgcattattctctatacaatgcagatggttacattgataggattactgtatctattttcatatgcatgttacatcttagtatgttacattgcctttaaga

SEQ ID NO: 347 - DNA, 1845 bp, Zea mays
gtccatgctcccccaccggcccacctaaaccaagaaagatttttgggacactccagcggtccagcccgacctctttccaaaccggcaaatcctcagatccgccccctcctccgcctccgcctccgcctcctgtaccctcacgccgtgcttccacagccctcccacctccgaatccagatccgccgccaccaactcctgcttctcacctcctaggctgcttcgcgcgacaacctccgcgaggagcagcaggagcggcggcggcggcatggggcgggacggcggtggcggtgtcgccggcggaatgtctgaatcggtgctgcggaaggtgctcctctcctacttgtacgtcgcggtgtggatcttcctctccttctccgtcatcgtctacaacaagtacatcctcgaccccaagatgtacaactggcccttccccatctcgctcaccatggtgcacatgggtttctgctcatccctcgccgtcgcgctcgtccgcgtgctccgcgtcgtcgacctccccacctctccctccatgacgccacagctctacacctcctccgtcgtccccatcggcgcgctatacgcgatgtcgctctggttctccaactccgcatacatctacctgtctgtgtcatttatccagatgctcaaggcgcttatgcccgtcgccgtctactccatcggcgtcctattcaataaggagaccttcaggtcctcctccatgctgaacatgctctccatctccttcggcgtggccatcgccgcctacggcgaggcgcgcttcgacgtgcgcggggtcgcgctgcagctcgctgccgtcgccttcgaggccacgcggctcgtgctcatccagatcctgctcacatctaagggcatctccctcaaccctatcacctcgctctactacgtcgcgccgtgctgcctctgcttcctcgtcgtgccctgggtcttcgtcgagctgcccaggctacgcgccgtcggcaccttccaaccggatttcttcgtctttgggaccaactcactctgcgcctttgcgctcaaccttgctgtgttcctgctagtgggcaagacctcggcgttgaccatgaacgtcgcgggagtagtcaaggattggctgttgattgcattctcgtggtctgtgatccgggacaccgtcaccccgattaacctgttcggatatgggatcgcgtttttaggggtggcctactacaatcatgtcaagctgcaggcgctcaaggctaaggaggcccagaagaaagccgcacaggctgatgaggaggttgggtcgctcttgcaggagcgcgatggacatggtgatcataagagcgacaatcaggcttagactgtcagatctgatcctggccttcccatattggggatctgatgcaaggtgcaaagaccggagtttggtctacggttgctttcaaggaggtggatgacggtttcttgcacttctttaactttgtgtctggagagaaaatcagaggtatttaacgtttaggaaatatgcacctgcttggtggagagctttgccttgttattttagacactttgttctactgaaaggcagccatgccttactacctcacttgtccattgcctagatttatttgttctgctagtagattagggactaaaaatgtactgctgcagaatgttaatttggtggttattttcgatatataatgagcttaccgtaatctacgagctgagcctctcgtgccgtcgtgtgaagtcttgtttattcgtgggactggtagcacgtgttatatggattattttttactggtgatggttattgttaggatgccttttcagatttaaggtcagatgtatatattctagtct

SEQ ID NO: 348 - DNA, 1984 bp, Hordeum vulgare
atgaaatctcttaaattttttatatttaggaacggagggagtacatgatactattatatgttactctgcagagcagccttaaccggaccaacccgaaacaaacgagcccgaactcgagccgtgcgcccgaaaaagaagccgaagccacatcgtccacccctataaaacacgcaacaccgaaccccgaagcagcccattctccacgtggccatcccgggtaagccagaccccgagagcgtgacacaacacacagtcacaggacaggagccgggccactccctctccttctccgtgccaagaaacccacacccaacccgtcctctccaaaatcccccaaccaccagcctcctcttcctcctcctcccagatccgcctccccgccccgctcccagatctcccgctcaggcgaacgaacgcgcgcgcgcgcaggcgaatcacagatccaccagccgccccgccggagccatggcgaaggaggccggcggcgagggggccatgtcggagtcggtgctccgcaaggtgctcgtctcctactgctacgtcgcggtgtggatcttcctctccttcaccgtcatcgtctacaacaagtacatcctcgaccccaagatgtacaactggcccttccccatctccctcaccatggtgcacatggccttctgctcctccctcgccgtcgcgctcgtccgcgtcttccgcgtcgtcgacctcccctcctcgcccgccatgaccacgcagctctacaccagctccgtcctccccatcggcgcgctctactccctctccctctggttctccaactccgcatacatctacctctccgtctccttcatccagatgctcaaggcgctcatgcccgtcgccgtctactccatcggggtgctcttcaagaaggagaccttccgctcctccgcgatgctcaacatgctctccatctccttcggcgtcgccatcgccgcctacggcgaggcccgcttcgacctccgcggcgtcgcgctccagctcgccgctgtcgccttcgaggccaccaggctcgtcctcatccagatcctcctcacatccaaggggatctcgctcaaccccatcacctcgctctactacgtcgcgccctgctgcctcggcttcctcttcctgccctgggtcttcgtcgagctgcccaggctgcgcgccgtcggcatgttcgagcccgacttcttcgtcttcggcaccaactccctctgcgcgttcgcgctcaacctggccgtcttcttgctcgtgggcaagacgtccgcgctcaccatgaacgtggccggcgtcgtcaaggactggctgctcatcgccttctcctggtccgtgatccgggacacggtgaccccgatcaacctcttcggctacgggatcgccttcctgggcgtgggctactacaaccacgtcaagctgcaggcgctcaaggccaaggaggcgcagaagaaggtggcgcaggcggacgaggaggccggctcgctgctgcaggagcgcgactctcacggcgagcgcaagaccgagacccagtcatagagctgcccatctgatctgatccaacaacaacaccaacagcacgcccagtttggttggttctgaatccggcgtagcaggttccccaaaatgtgatacttacatgtttgatgatgcagaatctgttcatttcttgccttaatttgtggtagcaaggcaaataaatacaggaaatatgcaatttttgtgtcggcgtgtgaaaatacaatagttcttagacactaccaccaccagtatcatcaagaaattgtattcggttgtctattgtatcatcatgtttgtagtactacagtaataaccaaccatttggtaaactggtgccggccgtagagatgcagcaatcgagcagcagctaataaaagattcaattttcggaactgcttgcagagccgatcttgatgttcatgtttatttactacgtactcgcgcctaaattcatgatggggtattgggc

SEQ ID NO: 349 - DNA, 1087 bp, Hordeum vulgare
agccgccccgccggagccatggcgaaggaggccggcggcgagggggccatgtcggagtcggtgctccgcaaggtgctcgtctcctactgctacgtcgcggtgtggatcttcctctccttcaccgtcatcgtctacaacaagtacatcctcgaccccaagatgtacaactggcccttccccatctccctcaccatggtgcacatggccttctgctcctccctcgccgtcgcgctcgtccgcgtcttccgcgtcgtcgacctcccctcctcgcccgccatgaccacgcagctctacaccagctccgtcctccccatcggcgcgctctactccctctccctctggttctccaactccgcatacatctacctctccgtctccttcatccagatgctcaaggcgctcatgcccgtcgccgtctactccatcggggtgctcttcaagaaggagaccttccgctcctccgcgatgctcaacatgctctccatctccttcggcgtcgccatcgccgcctacggcgaggcccgcttcgacctccgcggcgtcgcgctccagctcgccgctgtcgccttcgaggccaccaggctcgtcctcatccagatcctcctcacatccaaggggatctcgctcaaccccatcacctcgctctactacgtcgcgccctgctgcctcggcttcctcttcctgccctgggtcttcgtcgagctgcccaggctgcgcgccgtcggcatgttcgagcccgacttcttcgtcttcggcaccaactccctctgcgcgttcgcgctcaacctggccgtcttcttgctcgtgggcaagacgtccgcgctcaccatgaacgtggccggcgtcgtcaaggactggctgctcatcgccttctcctggtccgtgatccgggacacggtgaccccgatcaacctcttcggctacgggatcgccttcctgggcgtgggctactacaaccacgtcaagctgcaggcgctcaaggccaaggaggcgcagaagaaggtggcgcaggcggacgaggaggccggctcgctgctgcaggagcgcgactctcacggcgagcgcaagaccgagacccagtcataga

SEQ ID NO: 350 - DNA, 2511 bp, Sorghum bicolor
agacgattgtccacgtggccaccgcgcccagtccacgctccgctccccacctaaacccccgacccatcccgacctcttccccaaatcctcagatccgccccctcctccgcctccacctccgtttccaccctcgcgccgcgcttccacagcccgagccctccccacctccggatccagatccgccgccaccaacgcctgctcctccccctcctcctcctcctgctgctgctgctgcaccaccaccaccaccaccacctcgaggaccagcagcaggggcggcggcggcggcatggggcgggacggcggtggcggcgtcgccggcggcatgtccgactcggtgctccggaaggtgctcctctcctacttctacgtcgcggtgtggatcttcctctccttctccgtcatcgtctacaacaagtacatcctcgaccccaagatgtacaactggcccttccccatctcgctcaccatggtgcacatggggttctgctcgtccctcgccgtcgtgctcgtccgcgtcctccgcgtcgtcgacctccccacctcgccttccatgaccccgcagctctacacctcctccgtcgtccccatcggcgcgctctacgcgatgtcgctctggttctccaactccgcctacatctacctgtccgtgtccttcatccagatgctcaaggcgctcatgcccgtcgccgtctactccatcggcgtcctcttcaagaaggagaccttcaggtcctcctccatgctcaacatgctctccatctccttcggcgtcgccatcgccgcctacggcgaggcgcgcttcgacgtgcgcggtgtcgcgctgcagctcgccgccgtcgccttcgaggccacgcggctcgtgctcatccagatcctgctcacgtccaagggcatctcgctcaaccctatcacctcgctctactatgtcgcgccgtgctgcttctgcttcctcgtcgtgccctgggccttcgtcgagctgcctaggctgcgcgccgtcggcaccttccaaccggatttcttcatctttgggaccaactcactctgcgcctttgcgctcaaccttgccgtcttcttgctagtcggcaagacctcggcgctgaccatgaacgtcgcgggagtagtcaaggattggctgttgattgcattctcgtggtccgtgatccgggacaccgtcacccccatcaacctgtttgggtacgggatcgcgttcctaggggtgggctactacaatcatgtcaagctccaggcgctcaaggctaaggaggcccagaagaaagccgcccaggctgatgaggaggctgggtcgctcttgcaggagcgcgatgggcacggtgatcgcaagagtgacaatcaggcttagagtgccagatccgatcctggcttcccatattggggaactgatggaaggtgcaaagactggagtttggtctacggttgctttcaaggaggtgtatgccgatttcttgtgctcctttaactttgggtccgaagagcaaatcagaagtatttatgggttaggaaatatgcacctgctttctggagagctttgccctgttatttatttagacacttttgttctacagataggcagccttgccttactacctctcttgtccattgcctacatttatttgttctcctactagtagattagggactaaagatgtactgctgcagattgttaatttggtcgttattttcgatatataatgagcttactgtaatgtacgagttgagttgagtctctcttgcaaagttttttttgtttattcgcggactgatcggcatgttgtatgttaggatgccttttttcagatattagttgagatgtatatagtcatacatctctgtcacatgcagatggttacattggtagaatggtaggaaggaaagtcttacatatctattttcacatgcatgttacagtgttaagcttttggctataaaacaaatttgctgtagcttgctattcactattcagactcgtgtcatggggttggggatcatagctcattaatttcgcttgctttttcatagaactaggttgggatacatatatcattaatttcgcttgcttgttgagatcaagcattatatgacacttcaatttgcatcttggtccactgctgattgaactaggttggttgatggttggtgaacatgatatggctaagctgacttattaatcgccggtcctgcatctcgcggctgccatgtggtggttctgcatctcccggctgctatgtggtactggtagcctttcttgtgattatgatggtttcaacagcttaagctttcaatccaagctgaattaggtgcagagtggtagggtcggctttgtagtttagaatcacagttgcttgaaatccagtgacagcaaggtaggcaaacatgtgatctcgtagtacttgtatctttaaaatttgcttgttggtactgcattagttcttggtgttttgtgcctgcaagaattacaccattaaacattggggttgcaacatctacctg

SEQ ID NO: 351 - DNA, 1681 bp, Saccharum officinarum
ccctcctccacctccacctgcaccctcgcgccgcgttttcacagccctctccacctccggatccagatccgccgccaccagcgcctgctcctccccctcctcctgctgctgctgcaccaccaccaccaccccgaggaccagcagcagggcggcaggggcagaggcggcggcggcggcatggggcgggaaggcggtggcggcgtcgccggcggcatgtctgactcggtgctccggaaggtgctcctctcctacttctacgtggcggtgtggatcttcctttccttctccgtcatcgtctacaacaagtacatcctcgaccccaagatgtacaactggcccttccccatctcgctcaccatggtgcacatgggtttctgctcatccctcgccgtcgcgctcgtccgcgtcctccgcgtcgtcgacctcccgacctcgccctccatgacgccgcagctctacacctcctccgtcgtccccatcggcgcgctctacgccatgtcgctctggttctccaactccgcttacatctacctgtccgtgtcgttcatccagatgctcaaggcgctcatgcccgtcgccgtctactccatcggcgtcctcttcaagaaggagaccttcaggtcctcctccatgctcaacatgctctccatctccttcggcgtcgccatcgccgcctacggcgaggcgcgcttcgacgtgcgcggtgtcgcgctgcagctcgccgccgtcgccttcgaggccacgcggctcgtgctcatccagatcctgctcacatccaagggcatctcgctcaaccctatcacctcgctttactacgtcgcgccgtgctgcttctgcttcctcgtcgtgccctgggccttcgtcgagctgcccaggctgcgcgccgtcggcaccttccaaccggatttcttcatctttgggaccaactcactctgcgccttcgcgctcaaccttgccgtcttcttgctagtcggcaagacctcggcgctgaccatgaacgtcgcgggggtagtcaaggactggctgttgattgccttctcgtggtccgtgatccgggacaccgtcaccccgatcaacctgtttgggtacgggatcgcgtttttaggggtgggctactacaatcatatcaagctgcaggcgctcaaggctaaggaggcccagaagaaatctgcccaggctgatgaggaggctgggtcgctcttgcaggagcgcgatgggcacggtgatcgcaagagcgacaatcaggcttagagtgccagatctgatcctggcttccccatatttggggatctgatgcaaggtgcaaagattggagtttggtctacggttgctttcaaggaggtgtatgccggtttcttgaactttaactttgggtctgaagagcaaatgagaagtatttatgggttaggaaatatgcacctgcttgctggagagctttgccctgttatttatttagacacttttgttctacagataggcagccttgccttactacctctcttatccattgcctaaatttatttgttctcctagtagattagggactaaagatgtactgctgcagattgttaatttggtggttattttcgatatataatgagcttactgtaatctacgagttgaaaaaggatatccaataatcgcttggtttattgaatcaaaattcctatttagggccggc

SEQ ID NO: 352 - DNA, 1763 bp, Secale cereale
agccagaccccgagcgtgtgacacaacacacaggtgacgggagccgggccactccctcctctccgtgccaagaaacccacacccgcacccgtcctctccaaaatcccccaaccaccagcctcctcttcctcctcctcccagatccgcctcccctccccgctccgcccccagatcccccacgcaggcgaacgcgagcgcaggcccagatccgccccgccggagcagccatggccaaggaggccggcggcgagggggccatgtcggagtcggtgctgcgcaaggtgctcgtctcctactgctacgtcgcggtgtggatcttcctctccttcaccgtcatcgtctacaacaagtacatcctcgaccccaagatgtacaactggcccttccccatctcgctcaccatggtgcacatggccttctgctcctccctcgccgtcgcgctcgtccgcgtcttccgggtcgtggacctcccgtcctcgcccgccatgaccacgcagctctacaccagctccgtcctccccatcggcgcgctctactccctctccctctggttctccaactccgcatacatctacctctccgtctccttcatccagatgctcaaggcgctcatgcccgtcgccgtctactccatcggggtgctcttcaagaaggagaccttccgctcctccgccatgctcaacatgctctccatctccttcggcgtcgccatcgccgcctacggcgaggcccgcttcgacctccgcggcgtcgcgctccagctcgccgccgtcgcattcgaggccaccaggctcgtcctcatccagatcctcctcacctccaaggggatctcgctcaaccccatcacctcgctctactacgtcgcgccctgctgcctgggattcctcttcctgccctgggtcttcgtcgagctgcccaggctgcgcgccgtgggcatgttcgagcccgacttcttcgtcttcggcaccaactcgctctgcgccttcgcgctcaacctggcggtcttcctgctcgtcggcaagacgtccgcgctcaccatgaacgtggccggcgtggtcaaggactggctgctcatcgccttctcctggtccgtgattcgggacacggtgaccccgatcaacctcttcggctacgggatcgccttcctgggcgtgggctactacaaccacgtgaagctgcaggcgctcaaagccaaggaggcgcagaagaaggtggcgcaggcggacgaggaggcgggcacgctgctgcaggagcgcgactcgcacggcgagcgcaagaccgagacccagtcatagagctgctcatccgatcagatccgatccaacaccaccaacagcacgcccaatccggttggctctcaatccggcgtagcaggttccccagaatgtaatccttacatgtttgatgatgcaaaatctgttcatttcttgccttaatttgtggtaggagggcaaataaatacaggaaacatgacatttttgtgccgggcgtgtgaaaatacaatagttcttagcagacagtacttctactactactactactactaccagtatcaacaaaattgtatttggttgtctattgtatcatcatcatctttgtactagtaccaagcatttcatcgagtaaattggtgccgtagagatgttgcgatcgagcaacagctagttgtaataaaagattcagttccgaaactgtctgcggagccgatcttgatgtttaataactaaaaaaaaaaaaaactaagtaagatacgcgaacgacga

SEQ ID NO: 353 - DNA, 1684 bp, Secale cereale
gactgccagaccccgagcgtgtgacacaacacacaggtgacgggagccgggccactccctcctctccgtgccaagaaacccacacccacacccgttctctcgaaaatcccccaaccaccggcctccatttcctcctcccagatccgcctcccctcctcagcccgcccccagatcccccacgcaggcgaacgcgcgcgcaggcccagatccgccccgccggagcagccatggccaaggaggccggcggcgagggggccatgtcggagtcggtgctgcgcaaggtgctcgtctcctactgctacgtcgcggtgtggatcttcctctccttcaccgtcatcgtctacaacaagtacatcctcgaccccaagatgtacaactggcccttccccatctcgctcaccatggtgcacatggccttctgctcctccctcgccgtcgcgctcgtccgcgtcttccgggtcgtggacctcccgtcctcgcccgccatgaccacgcagctctacaccagctccgtcctccccatcggcgcgctctactccctctccctctggttctccaactccgcatacatctacctctccgtctccttcatccagatgctcaaggcgctcatgcccgtcgccgtctactccatcggggtgctcttcaagaaggagaccttccgctcctccgccatgctcaacatgctctccatctccttcggcgtcgccatcgccgcctacggcgaggcccgcttcgacctccgcggcgtcgcgctccagctcgccgccgtcgcattcgaggccaccaggctcgtcctcatccagatcctcctcacctccaaggggatctcgctcaaccccatcacctcgctctactacgtcgcgccctgctgcctgggattcctcttcctgccctgggtcttcgtcgagctgcccaggctgcgcgccgtcggcatgttcgagcccgacttcttcgtcttcggcaccaactcgctctgcgccttcgcgctcaacctggcggtcttcctgctcgtcggcaagacgtccgcgctcaccatgaacgtggccggcgtggtcaaggactggctgctcatcgccttctcctggtccgtgatccgggacacggtgaccccgatcaacctcttcggctacgggatcgccttcctgggcgtgggctactacaaccacgtgaagctgcaggcgctcaaggccaaggaggcgcagaagaaggtggcgcaggcggacgaggaggcgggcacgctgctgcaggagcgcgactcgcacggcgagcgcaagaccgagacccagtcatagagctgctcatctcatccgatccgatccaacaacaccaacagcacgcccaatccggttggctctcaatccggcgtagcaggttccccagaatgtaatccttacatgtttgatgatgcaaaatctcttcatttcttgccttaatttgtggtaggagggcaaataaatacaggaaacatgacatttttgtgccgggcgtgtgaaaatacaatagttcttagcagacagtacttctactactactactaccagtatcaacaaaattgtattcggttgtctattgtatcatcatcatctttgtactagtactactaccaagcattgcatcgagtaaattggtgccgtagagatgtggcgatcgagcaacagctagtagtaataaaagattcagt

SEQ ID NO: 354 - DNA, 1555 bp, Triticum aestivum
cctcctcctcctcctcccagatccgcctccccgccccgcccccagatcccccacgcaggcgagcgaccgcgcgccgcgcaggcccagatccgcccgccgccccgccggagcagccatctatggccaaggaggccggcggcgagggggccatgtcggagtcggtgctccgcaaggtgctcgtctcctactgctacgtcgcggtgtggatcttcctctccttcaccgtcatcgtctacaacaagtacatcctcgaccccaagatgtacaactggcccttccccatctcgctcaccatggtgcacatggccttctgctcctccctcgccgtcgcgctcgtccgcgtcttccgggtcgtcgacctcccgtcctcgcccgccatgaccacgcagctctacaccagctccgtcctccccatcggcgcgctctactcgctctccctctggttctccaactccgcctacatctacctctccgtctccttcatccagatgctcaaggcgctcatgcccgtcgccgtctactccatcggggtgctcttcaagaaggagaccttccgctcctccgccatgctcaacatgctctccatctccttcggcgtcgccatcgccgcctacggcgaggcccgcttcgacctccgcggggtcgcgctccagctagccgccgtcgccttcgaggccaccaggctcgtcctcatccagatcctcctcacctccaaggggatctcgctcaaccccatcacctcgctctactacgtcgcgccctgctgcctggggttcctcttcctgccctgggtcttcgtcgagctgcccaggctgcgcgccgtcggcatgttcgagcccgacttcttcgtcttcggcaccaactccctctgcgccttcgcgctcaacctggccgtcttcctgctcgtgggcaagacgtcggcgctcaccatgaacgtggccggcgtggtcaaggactggctgctcatcgccttctcctggtccgtgatccgggacacggtgaccccgatcaacctcttcggctacgggatcgccttcctgggcgtgggctactacaaccacgtgaagctgcaggcgctcaaggccaaggaggcgcagaagaaggtggcgcaggcggacgaggaggccggctcgctgctgcaggagcgcgactctcacggcggcgagcgcaagaccgagacccagtcatcatagagccgctcatctcatccgatccgatccgatccaacaacaccaacagcacgcccaatttggttggttctctcagtccggcgtagcaggttccccaaaatgtgatccttacatgtttgatgatgcaaaatctgttcatttcttgccttaatttgtggtaggaaggcaaataaatacaggaaacatgacatttttgtgccgggcgtgtgaaaatacgatagttcttagcagacagtgctactaccagtatcaacaaaattgtattcggctgtctattgtatcatcatcatctttgtaccagtaccaagcattcgcattgcatcgagtaagttggtgccgtagagatgtggcgatcgagcagcagc

SEQ ID NO: 355 - DNA, 1473 bp, Cenchrus ciliaris
  misc_feature (406)..(406): n is a, c, g, or t
  misc_feature (410)..(410): n is a, c, g, or t
  misc_feature (419)..(419): n is a, c, g, or t
  misc_feature (425)..(425): n is a, c, g, or t
  misc_feature (440)..(440): n is a, c, g, or t
  misc_feature (453)..(454): n is a, c, g, or t
  misc_feature (464)..(465): n is a, c, g, or t
  misc_feature (477)..(477): n is a, c, g, or t
  misc_feature (479)..(479): n is a, c, g, or t
  misc_feature (481)..(481): n is a, c, g, or t
  misc_feature (483)..(483): n is a, c, g, or t
  misc_feature (485)..(485): n is a, c, g, or t
  misc_feature (487)..(489): n is a, c, g, or t
  misc_feature (491)..(491): n is a, c, g, or t
  misc_feature (494)..(494): n is a, c, g, or t
  misc_feature (575)..(575): n is a, c, g, or t
  misc_feature (578)..(578): n is a, c, g, or t
  misc_feature (1044)..(1044): n is a, c, g, or t
cggcccttctccacccccctctttcagcgccttgacaacacaaccctcgccaccctccggatccagatccgccgccgccaccaccacctccttctcctcctgctgctgctccctctcctccaccaccaccgcgtgcgagggcgggccagcggcgcggcggcggcggcggcatggggcgggacggcggcggcggtggcgccggcggcatgtcggactcggtgctccggaaggtgctcctctcctactgctacgtcgcggtgtggatcttcctctccttctccgtcatcgtctacaacaagtacatcctcgaccccaagatgtacaactggcccttccccatctcgctcaccatggtgcacatggccttctgctcctccctcgccgtcgcgctcgtccgcgtcctccncgtngtcgacctnccctcntcccccgccatgacnccgcagctctacnnctcctccgtnntccccatcggcncncncnangnnntntcnctctggttctccaactccgcctacatctacctctccgtgtccttcatccagatgctcaaggcgctcatgcccgtcgccgtntantccatcggggtgctcttcaagaaggagaacttcaagtcctcctccatgctcaacatgctctccatctccttcggcgtcgccatcgccgcctacggcgaggcacgcttcgacgcacgcggcgtcgtttttttgctcgccgccgtcgccttcgaggccacgcgcctcgtcctcatccagatcctccttttatccaagggcacctccctcaaccccatcacctcgctctactacggggcgccgtgctgcctcgccttcctcgtcgtgccctgggtcttcgtcgagctgcccaggctccgcgccgtcgccaccttccagccggacctcttcgtcttcggcacgaactccctctgcgccttcgcgctcaacctcgccgtcttcctgctcgtcggcaagacgtccgcgctcaccatgaacgtcgccggcgtcgtcaaggactggctgctcatcgccttctcgtggtccgtcntccgcgacaccgtcacccccatcaacctcttcggctacgggatcgccttccttggcgtgggctacaacaaccacgtcaagctgcaggcgctcaaggccaaggaggcgcagaagaaggcggcgcaggccgacgaggaggctggctcgctgctgcaggagcgcgactcgcacggcgagcgcaagactgacaaccaggcctagcgagtgtgacggatctgaagatccaaccctctcgcatgattcggtcggttctgaatccactgcccccactagcgtactccaattgtgtgatccaatccacaagtttgatgcaaaatttgttcatttcttgtcttggtctggtggtagcaaggcaaataagcacgggaaagatgcgggctttgtgtcgaacatgtgaaaaatatatgagcaatttttggccttttgtcca

SEQ ID NO: 356 - DNA, 1828 bp, Zea mays
cgattctccacgtggccaccgcgcccagtccacgctcccccaaccagcccacctaaacccccgacccatcccgacctcttcctcaaatcctcagatccgccccctcctccacccttgcgccgcgctttcacagctctcccgcctccggatccagatccgccgccaccaacgcctgctcctccccctcccgctgcaccaccaccatcaagaggtccagcagggcggcagcggcagcggcggcggcggcgacatggggcgtgacggcggtggcggtgtcgccggcggcatgtctgactcggtgctccggaaggtgctcctctcctacttctacgtggcggtgtggatcttcctctccttctccgtcatcgtctacaacaagtacatcctcgacccaaagatgtacaactggcccttccccatctccctcaccatggtgcacatgggtttctgctcatccctcgccgtcgcgctcgtccgcgtcctccgcgtcgtcgacctccccacatcgccctccatgacgccgcagttctacacctcctccgtcgtccccatcggcgcgctctacgcgatgtcgctctggttctccaactccgcctatatctacctgtccgtgtcattcatccagatgctcaaggcgctgatgcccgtcgccgtctactccatcggcgtcctcttcaagaaggagaccttcaggtcctcctccatgctcaacatgctctccatctcattcggtgttgccatcgccgcctacggcgaggcgcgcttcgacgtgcgcggcgtcgcgctgcagctcgccgccgtcgccttcgaggccacgcggctcgtgctcatccagatcctgctcacgtccaagggcatctcgctcaaccctatcacctcgctctactatgtcgcgccgtgctgcttctgcttcctcctcgtgccctgggccttcgtcgagctgcccaggctgcgcgccgtcggtaccttccaaccggattttttcgtctttgggacgaactcactctgcgcctttgcgctcaaccttgccgtcttcctgctggtcggcaagacctcggcgctgaccatgaacgtcgcgggagtagtcaaggactggctgttgattgccttctcgtggtctgtgatccgtgacaccgtcacaccgatcaacctgttcgggtacgggatcgcgtttttaggggtgggctactacaatcatgtcaagctgcaggcgctcaaggctaaggaggcacagaagaaagccacacaggctgatgaggaggccgggtcgctcttgcaggagcgcgatggacacagtgatcgcaagagcgacaatcaggcctagagggccagatctgatcctggcttccccatattgggcatctgatgcaaggtgcaaagactggtgttaggtctgcggttgctttcaaggaggtgtgtgccggttgcttgcacatctttaactctgggtctgaagagcaaatcagaagtatttatggtttaggaaatatgcacctgctttgctggagaactttgtcctgctatttatttatagacacttctgatctacaggaaggcggccattcctcactacctctctttgcccattgtctacatttatttgttctactagtagattaggggactacagatgtactcctgcagatggttaatttggtggctattttcgatatataatgagcttacagtaatctacgagctgagtctttctgcctgcgaagtttctgtttattcgtggaccggtcggcgtgttgtgtggatcagctttgtagtactttagtttcatactccgctttgtggtaaaaaaaaatcaaagaacgtttgcttt

SEQ ID NO: 357 - DNA, 1490 bp, Avena sativa
ccgctccccagatctccccacgcgcacacgcaaaccccccagatccacaccgccgcctcgccgcacccgcatcgacagcagccatggcgaaggaggccggcggcgagggcgcgctgtcggagtcggtgctccgcaaggtgctggtctcctactgctacgtcgcggtgtggatcttcctctccttcaccgtcatcgtctacaacaagtacatcctcgaccccaagatgtacaactggcccttccccatctcgctcaccatggtgcacatggccttctgctcctccctcgccgtcgcgctcgtccgggtcttccgggtcgtcgacctcccggcctcacccgccatgacaccgcagctctactacacctccgtgctccccatcggcgcgctatactccctctccctctggttctccaactccgcatacatctacctctccgtctccttcatccagatgctcaaggcgctcatgcccgtcgccgtatactccattggggtgctattcaagaaggagacattcaggtcatccgccatgctcaacatgctctccatctccttcggggtcgccatcgcagcctacggcgaggccaggttcgacctccggggcgtggcgctgcagctcgccgcggtcgccttcgaggccacaaggctcgtgctcatccagatcctgctaacctccaaggggatctcgctcaaccccatcacctcgctctactacgtcgcgccctgctgcctctgcttcctcttcgtgccatgggtcttcgtcgagctgccaaggctgcaggccgtcggcatgtttgagccggacttcttcgtcttcggcaccaactcactctgcgccttcgcgctcaacctcgccgtcttcttgctcgtcggcaagacctccgcgctcaccatgaacgtcgcgggagtcgtcaaggactggctgctcatcgccttctcatggtccgtcatcagggacaccgtcacgcccatcaacctcttcggatacgggatcgccttcctcggcgtcgggtactacaaccacgtcaagctgcaggcgctcaaggccaaggaggcgcagaagaagctggcgcaggccgacgaggaggccggatcgctgctgcaggagcgggactcccacgccgaacgcaagaccgacacccagtcctagaagagctgctcatcctcatcctcatccaacaacagcccgtccaaacatttgtggtcggttctgaatccagttccccgatatgtcaagtttgatggtgatgatgatgcagcaaaaatatcttcgtttcttgtcctaatttgtggtaggaaggcaaataaacacaggaaattaaatcgcgatctcttgtactagtagtatcgggtcgggtcgggcgtgtgaaataccgagtgattcttttttgccacgattagtagttgttacttacgtacgtacttactagacagtaccagtatcaaaattgtaatggccggagtattgagcaatggatgatcaaacttt

SEQ ID NO: 358 - DNA, 2005 bp, Oryza sativa
tgatgatgagtctgcctgatatttggacctcacaaagtggatcgatcccacatagctagtaaaatcaaaatccttcatataaatcactgcaaataacagttcgtatctcgatatactcctagataacagctcaatttgctagcacaacaagaagttaaaagagattcataaaaaaaaatacaaaaaagaaagaacaaaagacaagtcaaagcgtcccgtcaagcccaaattaaataaaaaaaatccccaaccaaagccagtcgattttccacgtggccaacgcgaccagtccaagctccccctccttcacctaaacccccccaccccttccccacctcctcctccccccccaaaatcatcagatccgcctccgcctcctcctcctccacctcctcccaccccctcgccgatccagatccatcgccggggaggcgccagccatggccggcggcgggggcgccggcggcatgtcggagtcggtgctccgcaaggtgctcctctcctactgctacgtcggcgtctggatcttcctctccttcgccgtcatcgtctacaacaagtacatcctcgaccccaagatgtacaactggcccttcccgatctccctcaccatggtccacatggccttctgctcctccctcgccgtcgccctcgtccgcctcctccgcgtcgtcgagccgccctcgtcgcccgccatgaccccgcagctctacacctcctccgttgttcccatcggcgcgctctacgccatgtcgctgtggttctccaactcggcctacatctacctctccgtgtccttcatccagatgctcaaggcgctcatgcccgtcgccgtgtactccatcggggtgctcttcaagaaggagaccttcaggtcgtcctccatgctcaacatgctctccatctcgttcggcgtcgccatcgccgcatacggcgaggcgcgcttcgatgttcggggtgtcgcgctgcagctcgccgcggtggcgttcgaggccacgcggctcgtgctcatccagatcctgctcacctccaagggcatctcgctcaacccaatcacctctctgtactacgtcgcgccgtgctgcctcggcttcctgctcgtgccgtgggtgttcgtcgagctgcccaggctgcgcgccgtcggcacgttccgcccggacttcttcgtgttcgggaccaactcgctctgcgccttcgcgctgaatctggcggtgttcttgctcgtcggcaagacctccgcgctcaccatgaacgtcgccggggtggtcaaggactggctgctgatcgccttctcgtggtccgtgatccgggacacggtcacgccgatcaacctgttcggctacgggatcgccttcttgggggtggcatactacaaccacgtcaagctgcaggcgctcaaggcgaaggaggcgcagaagaagatcagccaggctgatgaggaggctggctcgctgttgcaggagcgcgatgggcacagtgatcgcaagagcgataaccaggcatagagccaccaccagatctgatcctggcacacacaaattgggtatctggtgcaaagtgcaaaagactgtagtttggttggtctacggttgctttcaaggaggtggacaccagtttgttctttcacttatttaactttagttggatctggagggcaaatcaagggaatttattggtttaggaaaatacttgcacttgcacctactttctggaggactagagtaaactttcatgttaccctgttatttattcagctatttttgttccagagaaagacagcctcgttgcctctctcgctcattgcctaaaatttatttgttctactagtagcctaggtactaaaaatgtacttctacatattggtattttggtggttatcttctatatataatgagcttactgtaatattataatctactgctgtgtatttctaccttttcaatttgaatggtttatcaacttgatgcatccatccgtcaactgtttcttggtcatttcatagatg

SEQ ID NO: 359 - DNA, 1565 bp, Hordeum vulgare
aagcctcctcgcctcgcctcacctcacctaaacccccaaccttaacccatccccaccgccaggcccaatccgtgtccccagccccaaatcctcagatccgcctccacccccgagtccaccagccccgagtctccccgcgcgcacgcacgcacgcaccccggccgccaccacccggatccagatccgcccggaggcggcggcgcaggaggaggaggaggaggaggaggaggagcgatggccggcggcgggggcgccggcggcttgtcggagtcggtgatgcggaaggtgctgctgtcctactgctacgtggccgtctggatcttcctctccttcgccgtcatcgtctacaacaagtacatcctcgaccccaagatgtacaactggcccttccccatctcgctcaccatggtgcacatgagcttctgctcctcgctcgccgtcggcctcgtccgcgtcctgcgggtcgtcgagccgccctcctccccgcccatgacgccccagctctacacctcctccgtcgtccccatcggcgcgctctacgccatgtccctctggttctccaactcggcatacatctacctctccgtctccttcatccagatgctcaaggcgctcatgcccgtcgccgtctactccatcggcgtcctcttcaagaaggagaccttccgctcctcctccatgctcaacatgctctccatctccttcggcgtcgccatcgctgcctacggcgaggccaggttcgacctccgcggcgtcgcgctccagctcgccgccgtcgccttcgaggccacgcgcctcgtcctcatccagatcctcctcacgtccaagggcatctcgctcaaccccatcacctcgctctactacgtcgccccctgctgcctctgcttcctgctcgtgccctggatcttcgtcgagctgcccaggctccgcgccgtcggcaccttccagcccgacttcttcatcttcgggactaactcgctctgcgcctttgcgctcaaccttgccgtgttcctgctcgttggcaagacctccgcgctcaccatgaatgtggcgggagtggtcaaggactggctattgattgccttctcctggtccgtcatccgggacacggtcacccccatcaacctcttcggctacggcatagccttcttaggggttgcctactacaaccatatcaagctgcaggcgctcaaggccaaggaggcacagaagaaatccgcgcaggccgacgaggaggccggctccctgttgcaggagcgcgatagccacagtgatcgcaagagcgataaccaggcatagagctccagatcggatccaggcatgcccacattgggaatctggttctaaaatccactcgtataatctttttcaattgcatccagaatatgcttgttgtttagtttgctttgccataggagaggaataaaactggagaaatgtgtgattttgactttgacaagacgaaatttgctatgcagtttgcccaagcatgctctttgttaagtacagaagttgtaaagatcaatggggatgcttttgcataattaaatcgatgtggttctact

SEQ ID NO: 360 - DNA, 1948 bp, Brachypodium distachyon
tccccatcggaacgacgcaattttccacgtggccaccgcacccagtccaagcttgccctcacctaaaccccccatccccacctcctctcccctcgcctgtccccaaatcctcagatccgcctctgcctcctcccctcctcctgcagagtccaccgcgtctcccccacgcgccccgaccccccggatccagatccgccgccgccaccacccggccgcgcaggagcaaccatggccggcggcgggggcgccggcggcatgtcggagtcggtgctccggaaggtgctcctctcctactgctacgtggccgtctggatcttcctctccttcgccgtcatcgtctacaacaagtacatcctcgaccccaagatgtacaactggcccttccccatctcgctcaccatggtgcacatgagcttctgctcctccctcgccgtcggcctcgtccgcgtcctccgcgtcgtcgagccgccctcctcgccgcccatgacgccgcagctctacacatcctccgtcgtccccatcggcgcgctctacgccatgtcgctctggttctccaactccgcatacatctacctctccgtgtcttttatccagatgctcaaggcgctcatgcccgtcgccgtctactccatcggcgtgctattcaagaaggagaccttcaggtcttcctccatgcttaacatgctctccatctcctttggggtcgccatcgccgcctatggcgaggctagattcgacgtccgcggcgtcgcgctacagctcgccgccgtcgcctttgaggccacgcggctcgtgctcatccagatcctgctcacctccaagggaatctcgctcaacccaatcacctcgctttactatgtcgcgccctgctgccttggcttcctgctcgtgccctggatcttcgtcgagctgcccaggctgcgtgcggtcgggacgttccagccggacttctttgtgttcgggacaaactccctctgcgcctttgcgcttaacttggccgtgttcctgctcgttggcaagacctctgcgctgaccatgaatgtcgccggagtagtaaaggactggctactgattgccttctcctggtccgtgatccgggacacggtcacccctatcaacctgttcggctacgggatcgccttcttgggggtggcttactacaaccatatcaagctgcaggccctcaaggccaaggaggcgcagaagaagtccgcgcaggctgatgaggaggctggctcgctgctgcaggagcgtgagcacagtgatcgcaagagcgacaaccaggcatagagcaccagactcgatcctggcatgcccacattgggaatctggtgcaaagtgcaaagactgtagtttggtctacggttgctttcaaggaggtggatgccggtttcgttcttttgctcctttaactttagttggatctgaagagcaaatcaagagaatttattggtttagggaatacttgcacttgaaacctgcttctggagggctagaagaaacagttatgttaccctgtcatttttgtttattttcgcttttctgtccaccgctcgctcattgcctatttatttgttcaagtagcctaggtaaaaatgtactgcgtatcggtattcactttggtggttatcttctatatataatgagcttactgtaatctatattctgtagttgcatctgttagatgtttgatctatgcattgtttttgttgcatctgtgtgaatctttgcttgatcattttacacctaacggtgcatctctagtggccagctgtttatacttgtttgtcactggattcggatacggtagcttcagttccattgtcacacattcagatttcagaagtatgacatgagaaagtagcatttggtatctagcaaagcattgtatttttgtatcaactgcatgtttacacgacttccttttctctagctcgcattgtatttg

SEQ ID NO: 361 - DNA, 1684 bp, Triticum aestivum
ccaaatcctcagatccgcctccgctcccccgagcccaagtccacccctccctccccaccgcggcgcgcacgcacgcacccggccaccacccacccggatccagatccgcgcggcggcggcgcaggtcagcaggagggagcgatggccggcggcgggggcgccggcggcttgtcggagtcggtgatgcggaaggtgctgctgtcctactgctacgtggcggtgtggatcttcctctccttcgccgtcatcgtctacaacaagtacatcctcgaccccaagatgtacaactggcccttccccatctcgctcaccatggtgcacatgagcttctgctcctcgctcgccgtggggctcgtccgcgtcctgcgggtcgtcgagccgccctcctccccgcccatgacgccgcagctctacacctcctccgtcgtgcccatcggcgcgctctacgccatgtcgctctggttctccaactcggcatacatctacctctccgtctccttcatccagatgctcaaggcgctcatgcccgtcgccgtctactccatcggcgtcctcttcaagaaggagaccttccgctcctcctccatgctcaacatgctctccatctccttcggcgtcgccatcgccgcctacggcgaggccaggttcgacctccgcggcgtcgcgctccagctcgccgccgtcgccttcgaggccacccgcctcgtgctcatccagatcctgctcacctccaagggcatctcgctcaaccccatcacctcgctctactacgtcgcgccctgctgcctctgcttcctgctcgtgccctggatcttcgtcgagctgcccaggctgcgcgccgtcggcaccttccagcccgacttcttcatcttcggcacaaactcgctctgcgcctttgcgctcaaccttgcggtgttcctgctcgttggcaagacctccgcgctcaccatgaatgttgcgggagtggtcaaggactggctgttgattgccttctcctggtccgtgatccgggacacggtcacccccatcaacctcttcggctacggcatcgccttcttaggggttggctactacaaccatatcaagctgcaggcgctcaaggccaaggaggcgcagaagaagtccgcgcaggccgatgaggaggctggctccctgttgcaggagcgcgatagccacagtgatcgcaagagcgagaaccaggcatagagctccagatcggatccgggcatgcccacattgggaatctggtgcaaagtgcaaagactatagtttggtctacagttgctttcaaggaggtggatgccggttctggtttatctttttaactttagttggatctgaggagcaaaccaaggcaatttgttgatctaggaaatacttgcatttgaacctgtttctggagggttagaaggaacacttatattaccctgttatttatttttgcgtttttgttctgaaaggcggccttgcttcctctctcgctcattccgtatttatttggtcgagtagcctaggtaaaaatgtactgcacattggtatcatttcggtgggtatcatctggtggttatcatctatatataatgagcttactgtaaactatattcaatacttgcctcttttagcttttaatatcgtgtgattatgtgtcggtttgttgcatcggtgggtgaatatttgccttgcc

SEQ ID NO: 362 - DNA, 1624 bp, Avena sativa
accacatctccccaaatcctcagatccgcctcctcctcctccccgagtccacccttccaccgcgtctgcccccccccacgcccctcccggctccgtgcccccggatccagatccaccgccagcaccgcctccccggccgcgcagcagagagaccatggccggcggcggcggcgccggcggcttgtcggagtcggtgctccgcaaggtgctcctctcctactgctacgtggccgtctggatcttcctctccttcgccgtcatcgtctacaacaagtacatcctcgaccccaagatgtacaactggcccttccccatctcgctcaccatggtgcacatgaccttctgctcctcgctcgccgtcggcctcgtgcgcgtcctccgcgtcgtcgagccgccatcctcgccgcccatgacgccgcagctctacacctcctccgtcgtgcccatcggcgcgctctacgccatgtcgctctggttctccaactcggcatacatctacctatccgtatccttcatccagatgctcaaggcgctcatgcccgtcgcggtctactccatcggggtgctcttcaagaaggagaccttcaggtccgcatccatgctcaacatgctctccatctccttcggggtcgccatcgccgcctacggcgaggccaggttcgacgtccgcggcgtggccctgcagctcgccgccgtcgccttcgaggccacgcgcctcgtgctcatccagatcctgctcacctccaagggcatctcgctcaaccccatcacctcgctctactacgtcgcgccctgctgcctctgcttcctcctcgtgccatggatcttcgtcgagctgcccaggctgcgtgccgtgggaaccttccagcccgacttctttatattcgggacgaactcgctctgcgcctttgcgctgaacctcgcggtgttcctgctcgtgggcaagacctccgcgctcaccatgaatgtcgccggagtggtcaaggactggctattgattgccttctcctggtccgtgatccgggacaccgtcacaccgatcaacctgttcggatacgggatcgccttcctaggagtggcctactacaaccacatcaagctgcaggcgctcaaggccaaggaggcacagaagaagaacgcccaggccgatgaggaggctggctcgctcttgcaggagcgtgatgggcacagtgatcgcaagagcgacaaccaggcatagagctacacatcggatcctggcgtgcccacattgggaatcaggtgcaaagtgcaaagactatagtatggtctgcaattgctttcaagaaggtggatgccggttccgtttacccttttaactttagtggacctgaggagcagatcaagagaagttattggtgtaggaaatatttgcaattgaacctgttcccggaaggctagaagaaacacttatatcaccctgttatttatttttgcttttttgttccattgaaaggcgaccttgcttccccgctcgctccattgcctatttatttgttcgagtagcctaggtaaaaatgtactctgcacactggtattatcatataatgagcttactgtaaactattcaatagttttgcctttatgtgtttaaattatgtgatta

SEQ ID NO: 363 - DNA, 1616 bp, Secale cereale
cgcccctcccatccatcccaccaccgcgcccccccgcgcgagcgcacccggccaccactacccggatccagatccgctcggcggcggcggcggcggcgaggcgcaggcgcaggagggagcgatggccggcgccggcggcttgtcggagtcggtgatgcggaaggtgctgctgtcctactgctacgtggcggtgtggatcttcctctccttcgccgtcatcgtctacaacaagtacatcctcgaccccaagatgtacaactggcccttccccatctcgctcaccatggtgcacatgagcttctgctcctcgctcgccgtggggctcgtccgcgtcctgcgggtcgtcgagccgccctcctcgccgcccatgacgccgcagctctacacctcctccgtcgtgcccatcggcgcgctctacgccatgtcgctctggttctccaactcggcatacatctacctctccgtctccttcatccagatgctcaaggcgctcatgcccgtcgccgtctactccatcggcgtgctcttcaagaaggagaccttcaggtcctcctccatgctcaacatgctctccatctccttcggcgtcgccatcgccgcctacggcgaggccaggttcgacctccgcggcgtcgcgctccagctcgccgccgtcgccttcgaggccacccgcctcgtgctcatccagatcctgctcacctccaagggcatctcgctcaaccccatcacctcgctatactacgtcgcgccctgctgcctctgcttcctgctcgtgccctggatcttcgtcgagctgcccaggctgcgcgcggtcggcaccttccagcccgacttcttcatcttcgggacaaactcgctctgcgcctttgcgctcaaccttgcggtgttcctgctcgttggcaagacctccgcgcttaccatgaatgtcgcgggagtggtcaaggactggctgttgattgccttctcctggtctgtgatccgggacacggtcacccccatcaacctgttcggctacggcatcgctttcttgggggttgcctactacaaccacatcaagctgcaggcgctcaaggccaaggaggcgcagaagaagtccgcgcaggccgatgaggaggctggctccctgttgcaggagcgcgacagccacagtgatcgcaagagcgagaaccaggcatagagctccagatcggatccggcatgcccacattgggaatctggtgcaaagtgcaaactgcaaagactatagtttggtctacagctgctttcaaggaggtggatgccggttctggtttatctttttaactttagttggatctgagaagcaaaccgaggcaatttgttggtctaggaattacttgcatttgaacctgcttctggagggttagaaggaacacttatattaccctgttatttatttttgtgcttttgttctgaaaggcggccttgcttcctctctcgctcattccgtatttatttgttcgagtagcctaggtaaaaatgtactgcacattggtatcatttcggtgggtatcatctggtggttatcatctatatataatgagcttactgtaaactatattcaatacttgcctttttagtcttttcatatcttgtag

SEQ ID NO: 364 - DNA, 1651 bp, Secale cereale
cccccccgcgcgagcgcacccggccaccaccacccggatccagatccgctcggcggcggcgaggcgcaggcgcaggagggagcgatggccggcgccggcggcttgtcggagtcggtgatgcggaaggtgctgctgtcctactgctacgtggcggtgtggatcttcctctccttcgccgtcatcgtctacaacaagtacatcctcgaccccaagatgtacaactggcccttccccatctcgctcaccatggtgcacatgagcttctgctcctcgctcgccgtggggctcgtccgcgtcctgcgggtcgtcgagccgccctcctcgccgcccatgactccgcagctctacacctcctccgtcgtgcccatcggcgcgctctacgccatgtcgctctggttctccaactcggcatacatctacctctccgtctccttcatccagatgctcaaggcgctcatgcccgtcgccgtctactccatcggcgtgctcttcaagaaggagaccttcaggtcctcctccatgctcaacatgctctccatctccttcggcgtcgccatcgccgcctacggcgaggccaggttcgacctccgcggcgtcgcgctccagctcgccgccgtcgccttcgaggccacccgcctcgtgctcatccagatcctgctcacctccaagggcatctcgctcaaccccatcacctcgctatactacgttgcgccctgctgcctctgcttcctgctcgtgccctggatcttcgtcgagctgcccaggctgcgcgcggtcgggaccttccagcccgacttcttcatcttcggcacaaactcgctctgtgcctttgcgctcaaccttgcggtgttcctgctcgttggcaagacctccgcgcttaccatgaatgtcgcgggagtggtcaaggactggctgttgattgccttctcctggtccgtgatccgggacacggtcacccccatcaacctcttcggctacggcatcgccttcttgggggttgcctactacaaccatatcaagctgcaggcgctcaaggccaaggaggcgcagaagaagtccgcgcaggccgatgaggaggctggctccctgttgcaggagcgcgatagccacagtgatcgcaagagcgagaaccaggcatagagcttcagatcggatccggcatgcccacattgggaatctggtgcaaagtgcaaactgcaaagactatagtttggtctacagctgctttcaaggaggtggatgccggttctggtttatctttttaactttagttggatctgagaagcaaaccaaggcaatttgttggtctaggaattacttgcatttgaacctgcttctggagggttagaaggaacacttatattaccctgttatttatttttgcgcttttgttctgaaaggcggccttgcttcctctctcgctcattccgtatttatttgttcgagtagcctaggtaaaaatgtactgcacattggtatcatttcggtgggtatcatctggtggttatcatctatatataatgagcttactgtaaactatattgaatagttgcctcttttagcttttcatatcttgtgattatgcatcggtctgtttcatggttgggtgaatatttgcctgatcaattttcacccgcgatgtattgctaag

SEQ ID NO: 365 - DNA, 1521 bp, Pseudoroegneria spicata
  misc_feature (51)..(51): n is a, c, g, or t
  misc_feature (54)..(54): n is a, c, g, or t
  misc_feature (56)..(56): n is a, c, g, or t
  misc_feature (60)..(60): n is a, c, g, or t
  misc_feature (62)..(62): n is a, c, g, or t
  misc_feature (67)..(68): n is a, c, g, or t
  misc_feature (70)..(70): n is a, c, g, or t
  misc_feature (80)..(80): n is a, c, g, or t
  misc_feature (83)..(83): n is a, c, g, or t
  misc_feature (87)..(87): n is a, c, g, or t
  misc_feature (94)..(95): n is a, c, g, or t
  misc_feature (98)..(98): n is a, c, g, or t
  misc_feature (100)..(100): n is a, c, g, or t
  misc_feature (102)..(102): n is a, c, g, or t
  misc_feature (117)..(117): n is a, c, g, or t
  misc_feature (119)..(119): n is a, c, g, or t
  misc_feature (122)..(122): n is a, c, g, or t
  misc_feature (131)..(132): n is a, c, g, or t
  misc_feature (149)..(149): n is a, c, g, or t
  misc_feature (152)..(152): n is a, c, g, or t
  misc_feature (155)..(155): n is a, c, g, or t
  misc_feature (174)..(174): n is a, c, g, or t
  misc_feature (258)..(259): n is a, c, g, or t
  misc_feature (272)..(272): n is a, c, g, or t
  misc_feature (283)..(284): n is a, c, g, or t
  misc_feature (297)..(297): n is a, c, g, or t
  misc_feature (299)..(299): n is a, c, g, or t
  misc_feature (311)..(311): n is a, c, g, or t
  misc_feature (313)..(314): n is a, c, g, or t
  misc_feature (334)..(335): n is a, c, g, or t
  misc_feature (350)..(351): n is a, c, g, or t
  misc_feature (359)..(359): n is a, c, g, or t
  misc_feature (361)..(361): n is a, c, g, or t
  misc_feature (380)..(380): n is a, c, g, or t
  misc_feature (383)..(383): n is a, c, g, or t
  misc_feature (385)..(385): n is a, c, g, or t
  misc_feature (388)..(388): n is a, c, g, or t
  misc_feature (409)..(409): n is a, c, g, or t
  misc_feature (481)..(481): n is a, c, g, or t
  misc_feature (515)..(515): n is a, c, g, or t
  misc_feature (575)..(575): n is a, c, g, or t
  misc_feature (577)..(577): n is a, c, g, or t
  misc_feature (601)..(601): n is a, c, g, or t
  misc_feature (632)..(632): n is a, c, g, or t
  misc_feature (634)..(634): n is a, c, g, or t
  misc_feature (637)..(637): n is a, c, g, or t
  misc_feature (640)..(640): n is a, c, g, or t
  misc_feature (721)..(722): n is a, c, g, or t
  misc_feature (730)..(731): n is a, c, g, or t
  misc_feature (734)..(734): n is a, c, g, or t
  misc_feature (739)..(739): n is a, c, g, or t
  misc_feature (743)..(743): n is a, c, g, or t
  misc_feature (769)..(769): n is a, c, g, or t
  misc_feature (772)..(772): n is a, c, g, or t
  misc_feature (780)..(781): n is a, c, g, or t
  misc_feature (785)..(785): n is a, c, g, or t
  misc_feature (800)..(800): n is a, c, g, or t
  misc_feature (811)..(811): n is a, c, g, or t
  misc_feature (817)..(817): n is a, c, g, or t
  misc_feature (820)..(820): n is a, c, g, or t
  misc_feature (859)..(859): n is a, c, g, or t
  misc_feature (868)..(868): n is a, c, g, or t
  misc_feature (871)..(871): n is a, c, g, or t
  misc_feature (874)..(874): n is a, c, g, or t
  misc_feature (877)..(877): n is a, c, g, or t
agatcccccacgcaggcgaacgcgcgcgtaggcccagatccatccgcccgncgncncgcngngcagnngnagccatggcnggnggcnggggcgnnggngncntgtcggagtcggtgntncgnaaggtgctnntctcctactgctacgtngcngtntggatcttcctctccttcnccgtcatcgtctacaacaagtacatcctcgaccccaagatgtacaactggcccttccccatctcgctcaccatggtgcacatgnncttctgctcctcnctcgccgtcgnnctcgtccgcgtcntncgcgtcgtcgancnnccctcctccccgccatgacnncgcagctctacaccnnctccgtcntncccatcggcgcgctctacnccntntcnctctggttctccaactcggcntacatctacctctccgtctccttcatccagatgctcaaggcgctcatgcccgtcgccgtctactccatcggngtgctcttcaagaaggagaccttccgctcctccnccatgctcaacatgctctccatctccttcggcgtcgccatcgccgcctacggcgaggccngnttcgacctccgcggcgtcgcgctncagctcgccgccgtcgccttcgaggccaccngnctngtnctcatccagatcctcctcacctccaaggggatctcgctcaaccccatcacctcgctctactacgtcgcgccctgctgcctnngcttcctnntcntgccntggntcttcgtcgagctgcccaggctgcgngcngtcggcannttcnagcccgacttcttcntcttcggcacnaactcnctntgcgcctttgcgctcaaccttgcggtgttcctgctcgtnggcaagacntcngcnctnaccatgaacgtggccggcgtcgtcaaggactggctgctcatcgccttttcctggtccgtgatccgggacacggtgaccccgatcaacctcttcggctacgggatcgccttcctgggcgtgggctactacaaccacgtgaagctgcaggcgctcaaggccaaggaggcgcagaagaaggtggcgcaggcggacgaggaggccggctcgctgctgcaggagcgcggcgactctcacggcgagcgcaagaccgagacccagtcatagagctgctcatctgatccgatctgatccaacaacaccaacagcacgcccaatttggttggttctgaatccggcctagcaggttccccaaaatgtgatccttacatgtttgatggtgcagaatctgttcatttcttgccttaatttgtggtaggaaggcaaataaatacaggaagtatgcaatttttgtgtcgggcgtgtgcaaatacgatagttcttagacactaccaccagtatcaaaaaaattgtattcgtattcggttgtctattgtatcatcatgtttgtactagtaccaagcattgcatcgagtaaatttggtgccgtagagatgtggcgatcgagcagcagctagtaataaaagattcagttttcgaaaaaaaaa

SEQ ID NO: 366 - DNA, 1697 bp, Musa acuminata
gctacgcttaggggtatccgctccgccaccgagatctcgaggtttcttggatcgatccggcgaattatatacgcctcatattatctaatctgcagagtcccagtcgtgtttcccgtctcctacgactcggaatagtgtggtcttcctcttctctcaactgcgctctctcagatccaccaatctcctccccccctctcccaccagcccccaacccctcttttcccatctttcttctaaacccacgcccaatctcctacattctcaggcgaatccctcccattcacctcttcctactgatctgatcccgatctcctaccagagaaggaaggtggaagaatagtaatcagatatatagttgtagatcggacatagaggaggaggagagatgggacgagaagggagcggcggcggagcagaggggggaggaggagacggcggggtggtgcggaaggtgctgctttcgtacgcatatgtggcgatctggatcttcctcagcttcacggtgatcgtgtacaacaagtacatcctcgaccccaagatgtacaactggcccttccccatcagccttaccatggttcacatggccttctgctcctccctcgccgtcctcctcgtccgcgtgctccgcctggtcgacccgccgtcctcgccgcccatgactcgcgacctctatgtcgcctccgtcatccccatcggcgcgctctactccctctccctctggttctccaactccgcctacatctacctctccgtctccttcatccagatgctcaaggctctcatgcccgtcgccgtctactccatcggtgtcctcctcaaaaaggagtcgtttaagacctcctccatgctcaacatgctctccatctccttgggcgtcgccgtcgccgcttacggcgaggcccgcttcgtcgcctggggggtcgccctccaactcggcgccgtcgccttcgaggccacccgcctcgtcctcatccagatcctcctcacctccaagggcatctccctcaaccccatcacctccctttactacgtcgccccctgctgctttgccttcctcctcgtcccctggttcgtcgtcgagctgcccctcctccgtaacaggtcctccttccacccggacctcctcgtcttcatcaccaactccttctgcgccttcgctctcaacctcgccgtcttcctcctcgtcggaaagacctccgccctcaccatgaacgtcgccggcgtcgtcaaggactggctcctcatcgccttctcctggtccgtcatccgcgacaccgtcacccccatcaacctcttcggttacgggatcgccttcctcggcgtcgcctactacaatcatgtcaagctgcaggctctcaaggccaaggaggcggagaaaaaggctcagcaagctgatgaggaggccgggaaacttctacaggagatgaaaggtgatcggcagaacgactcttgactcgtgatctgtatccatcagacccgatctacttacctattttatcatgcaatcaggttgatttcacagatattagggcaaaaatataataagaagtgtttttttcctgcctggttattgacatttcatcaacggaaatggacgcagaggatcgatttatgatgtggagaaggttattcttatgagattgtctttatatttatttggaagtaaccaaagaaaaaatagcagatcaaaagagagc

SEQ ID NO: 367 - DNA, 1650 bp, Hordeum vulgare
gcgcgcccagtccaagcctcctcgcctcgcctcacctcacctaaacccccaaccttaacccatccccaccgccaggcccaatccgtgtccccagccccaaatcctcagatccgcctccacccccgagtccaccagccccgagtctccccgcgcgcacgcacgcacgcaccccggccgccaccacccggatccagatccgcccggaggcggcggcgcaggaggaggaggaggaggaggaggaggagcgatggccggcggcgggggcgccggcggcttgtcggagtcggtgatgcggaaggtgctgctgtcctactgctacgtggccgtctggatcttcctctccttcgccgtcatcgtctacaacaagtacatcctcgaccccaagatgtacaactggcccttccccatctcgctcaccatggtgcacatgagcttctgctcctcgctcgccgtcggcctcgtccgcgtcctgcgggtcgtcgagccgccctcctccccgcccatgacgccccagctctacacctcctccgtcgtccccatcggcgcgctctacgccatgtccctctggttctccaactcgctctacaccagctccgtcctccccatcggcgcgctctactccctctccctctggttctccaactcggcatacatctacctctccgtctccttcatccagatgctcaaggcgctcatgcccgtcgccgtctactccatcggcgtcctcttcaagaaggagaccttccgctcctcctccatgctcaacatgctctccatctccttcggcgtcgccatcgctgcctacggcgaggccaggttcgacctccgcggcgtcgcgctccagctcgccgccgtcgccttcgaggccacgcgcctcgtcctcatccagatcctcctcacgtccaagggcatctcgctcaaccccatcacctcgctctactacgtcgccccctgctgcctctgcttcctgctcgtgccctggatcttcgtcgagctgcccaggctccgcgccgtcggcaccttccagcccgacttcttcatcttcgggactaactcgctctgcgcctttgcgctcaaccttgccgtgttcctgctcgttggcaagacctccgcgctcaccatgaatgtggcgggagtggtcaaggactggctattgattgccttctcctggtccgtcatccgggacacggtcacccccatcaacctcttcggctacggcatagccttcttaggggttgcctactacaaccatatcaagctgcaggcgctcaaggccaaggaggcacagaagaaatccgcgcaggccgacgaggaggccggctccctgttgcaggagcgcgatagccacagtgatcgcaagagcgataaccaggcatagagctccagatcggatccaggcatgcccacattggttggttctaaaatccactcgtataatctttttcaattgcatccagaatatgcttgttgtttagtttgctttgccataggagaggaataaaactggagaaatgtgtgattttgactttgacaagacgaaatttgctatgcagtttgcccaagcatgctctttgttaagtacagaagttgtaaagatcaatggggatgcttttgcataattaaatcgatgtggttctactttttctggtg

SEQ ID NO: 368 - DNA, 3471 bp, Musa acuminata
taagaatgcaatttttagggtgctcgtgtcgagaagtgtgcgcgttaaccgcgtgtcggtgtgaaattatcaccaatatttcacgacgccgacaacgactactcctctccccaacgcatttagctcttctacacccacactccttttgttattgtcactctcccttcatcaataagtaccggtcttcctccttcctcacctccgccccacgccaccccctcttcttcctcctctctctctctctctctctctctctctttctcagatccaacccaccttctctctcatatcaatccccgttctccccatctcctacgcgtttccctctcctctcctctcctctccagatctgtatcgaaggaggataactgagcagaggaggaggagaagggggagagcatcgtttttgtcggcatcatgggtcgggagggcagcggcggcggcggaggggcggtgtcggagggggttctgaagaaggtgctgctgtcctacgcctatgtcgcgatctggatcttcctcagcttcacggtgatcgtgtacaacaagtacatcttggatcccaagatgtatggctggcccttccccatcagcctcaccatgatccacatggccttctgctccaccctcgccatcctcctcgtccgcgtgctccgcctcgtcgacccgccctcgtcgccgcccatgacccgcgccctctacctctcctccgtcgtccccatcggcgccctctactccctctccctctggttctccaactccgcctacatctacctctccgtctccttcatccagatgctcaaggccctcatgcccgtcgccgtctattccatcggcatcctcttcaagaaggagtctttccgcacctcctccatgctcaacatgctctccatctcttttggcgtcgccatcgccgcctacggcgaggcccgcttcaacggcactggcgtcggccttcagctcggcgccgtcgccttcgaggccacccgcctcgtcctcatccagatcctcctcacctccaagggcatctccctcaatcccatcacctccctttactacgtcgccccctgctgcctcgccttcctcctcgtcccctggtccgtcgtcgagctccccattctccgcgcccgctccgcctcctccctccgccctgacctactcatcttcggcaccaactccctctgtgccttcgccctcaacctcgccgtcttcctcctcgtcggcaagacctccgccctcaccatgaacgtcgccggcgtcgtcaaggactggctcctcatcgccttctcctggtccgtcatccgtgacaccgtcaccgcgatcaacctcttcggttacgccattgccttcctcggcgtcgcctactacaaccacgtcaagctacaggcgctcaaggccaaggaggcgcagaagaaggccgcccaggccgacgacgaggcagggaagctcctcgatcaagtcgacggctcgggtggcgaccgcaagggtgactcgcaggcttgatccatccgtccacccctctgcgttctgccacgatttcatcggttcgtctttagcatttctgatggatctcttcattcgttagctattttatctttagcagtacatttctacatcaagaaggaggaggtttgacggagcaaataccaaaatgaaaaaaaaaagtaaaaatggaacttttattgtcttcctttctttgtttgatcctatagttgtcttggggttggattctgtttttgagcacacggtgcatcagatccggaaatgcttatggtagatcacctgggtcagatctgagaagaggaagctggaaggattttagtggcagttcttgctgtgggtggaggactgtggatggatcacactaggttggcttgtttgttacttggatcactgttagctgtctatcctcttgtcaaagagggatgattgttgttatttatttgttggatcatgtaggagctttcttttgcctcctccctaatgagattgaaagtgctatttaatttagtatgtctggtatattatgtccttcattcgtgtggtttcattgcatttgctattttcctatggaaccttcggatgcatgttgaacccatttcacatgatgcaaactctatgcctgatgatctcacatatttgtgttaatgctctgttttgttgcatgttgtgctaacatttaattttatttttcatatgattgaagaagttgttatgtgtgtccatgtgttgaagaatttgatgtttgaagtttgatctttgtggatgatgtttcttgttttatgagattagatattgcattgggaatcttctgttttgtgcatgcatcattgcttttagagttgtgttattgtgagaatttatgcatatctatgtagttagcaagttgcttagttgcattgaggttaacaaagaagacatggttttctgtaatttactctattactttcaagaatcactgtaatttgtgatatctatatgtcaagtgtttttctttatacgaaatactaaaggaggattcttgaaaccagaaaaatgacaagatcagccaaaaggtattaccaatgaatgcacataagaggaacttagtgtttgaccaggagacgagaattaagacatgtttggtacatttgaggactgggtatttaggtgcgacggaaaaactggcagaaagataaagaatgtagcttaacatgagatgcttcatcattttgtcatttgcataatttggtaaataatggtgcttttaaggataccaccctacattgagagcgaggattatgaagtatgatccgacttctggagtctgatgtgaattctgaagaacatagagtgaggattatgcattatttctggaatctgatgtaaagaatatacaggtctcatgtgagttgtaaaatgttaaagatcaaagtaagcaccaacctagaattgagaggaagtctgaaaagagttttgtacattaatctagcaatgttttttgtgtgtagagttttatttgaaagcaattgaagtaatggcattttagtggatatgtagtgtttcatgattttgttagtaatgtagtttagtaatgctgcttattggacttatcaaatttaaaggaggaaatctaatgtggcttcttaaacatttgaaggattaagattgggattgagagaagaaggaaggaaagtgggaattattaattcaaaaatggttttcctctgaagcaataataccttaccatgttactggtggacatgttgtgtttcatgattttgtaattgtgtaatttgggaatggtgctgtgcttaaatgacatacagttattgaagagaggaagggtcatatccattatttcttgaatctgatgtgggtttagaagcacgtttggaggataaaaattcacattggactgtgatagagagaaaagacagaaaagagactcttcttttactagatttaactgaaaagattgaagtgcaaactcag

SEQ ID NO: 369 - DNA, 1793 bp, Arabidopsis lyrata
gtggatagacaagaatttaaatagaatgaagaggcgaccatgcaagtgttgtactaggccaaattttggagacgctctttctctttcatagagagagagtgagaaagttctgatacggcggcttctcactgtcatctagctgtaccactgacgataaatctctctcttcctctaaatcgttaacttatacttgcagattctcgcgttgatagtaaaaagatggtgaagcttttggagctgttcataacttcatcaaaaccagtcgttgagattctgttgataacatcagtcggattttatatggctctcgatggagtcaatcttcttggtcatgatgctcgtaaatatctgaacaacattgtcttctatgtgtttagtccttcgcttattggaagccgtttagctgatagtgttacatacgaaagcttggtcaaaatgtggttcatgccggtgaatgttctgcttacattcatcattggttcattacttggctggattgttattgtcatcactaagcctccttcacaccttcgtggtctcattcttggttgttgtgctgctgggaatttggggaatatgccactgattataatcccagctgtttgtaaagaaaaaggaggtccctttggagatcctgagagttgccagaaatatggaatgggttatgttgctctctccatggctatgggatctatttacatatggacttatgtatacaatcttatgcgtgtgctatcgaactctcccgttgaaacccctccctctgttgaatctaactacgacagctacaaagttccacttatttcttctaaggaagaagaaaacaaccaaaaggctgggaggtgggaaaaagtcaagcggagattggtttcactgtcacaaaaagtcaaccttaagacaatttttgctccatcaactattgctgcgatgattgcacttgtgatcgggctcattactcctttaaggaagctaataatcggcacggaagctcctctccgggtgcttcaagactcagtaactctagtgggagatggggcagttcctgcaatgaccatgattataggaggaaacctactcaaaggtttgaggagttcaggaatgaaaatgtccagtattatcggcgtcttggttgcgcgttacgttttactgcctatgagcggtgttttaatcgtaagaggagcatataagttggatttagttacatcagagcccttataccaattcgttcttcttcttcaatatgctgtcccaccagccatgaatctaggtacaattactcagttatttggaactggggagagtgaatgctcagtgattatgctctggacttactctttggcttcgattgcactcactgtttggccaacattcttcatgtggcttgtagcttagaatagacccccatactcatcatgttacatgtattgttttgttccattgattcaagaattgttcttggacttccagatgattggatcaagtataatagagaacatatacttataagtcttttgatacgaactttggacttacagtctgtaacttacagatagaagatcaagtccagcctcatcaagaatctgctattttgatcctcattgtcttgggatccatcaagagattgtgaggcttaaaatctctgttatgatacccaaatcattctctcttgaaacagggtaaaaccagagaacaatctacttgactacttgtgactgtggccatggcagaaagctattcctttgtttagtttggtacacctgagaaaaatttcagattgttacatttggtttaat

SEQ ID NO: 370 - DNA, 1218 bp, Arabidopsis lyrata
ttcgagcgttaataataaaaagatggtgaagcttttggagctgttcataacttcatcgaaaccagtcgtggagattctgttgataacatctgtcggattttatatggctcttgacggtgtcaatcttcttggtcaagatgctcgcaaatatttgaacaacattgtcttctatgtgtttggtccttcgcttattggaagtcgtttagctgatagtgttacatatgaaagcttggtcaaaatgtggtttatgccggttaatgttctgttgacattcatcattggttcgttattaggctggattgttattgtcatcactaagcctccttcacatcttcgtggtctcattcttggttgttgtgctgctgggaatttggggaatatgccactgattataatcccagccgtctgtaaagaaaaaggaggtccctttggagatccagagagttgtcagaaatatggaatgggttatgttgctctctccatggcaatgggatcgatatacatttggacttacgtatacaatctaatgcgtgtgctatcgaactctcccgttgaaacccctccctctgttgaatctaactatgacagctacaaagttccacttatttcttctaaggaagaagaagaagacaaccaaaaggctgggaggtgggaaatagtcaagcggagattggtttcactgtcagagaaagtcaaccttaagacaatatttgctccatcaagtattgctgcgatgatcgcgcttgtgatcgggctcattactcctttaaggaagctgataattggcacggaagctcctctccgggttcttcaagattcagtaactctagtgggagatggggcagttcctgctatgaccatgatcataggaggaaacctactcaaaggtttgaggagttcaggaatgaaaatgtccagtattatcggtgtcttggttgcacgctacgttttgctgcctatgagcggtgttttaatcgtaagaggagcatataagttggatttagttacctcagaaccattgtaccaattcgttcttcttcttcagtatgctgtcccaccagcaatgaatctaggtacaattacacaattattcggaaccggggagagtgaatgctcagtgattatgctctggacttactctttggcttcgatttcactcactgtttggccaacattcttcatgtggcttgtggcttaaacccccgcactctttcatgt

SEQ ID NO: 371 - DNA, 1742 bp, Brassica rapa
aggcgacaatgcaagtgtaagagcagcatctcctgataacaaccgttggagaaataaaagttggaagcagagatgatgaagcttttgaatttgttcataacttcatcaaaaccagtagtggagattctcctgataacaatagttggattctatttggctcttgatggagtcaatcttcttggtcaagatgctcgcaaatatttgaacaatattgtcttctatgtgtttagtccttcacttattggaagccgtttagctgatagtgttacatatgaaagcttggtgaaaatgtggttcatgccagttaatgttctgctaacattcatcattggttcgttattaggctggattgttattgtcatcactaagcctccttcccatcttcgtggactcattgttggttgttgtgctgctgggaacttgggaaacatgccactaatcatagtcccagctatttgtaaagaaagaggaggtccttttggagatcctgagaattgccagaagtatggaatgggttatgttgcactctccatggctatgggatcagtttatatatggacttacgtctacaatcttatgcgggtactaaactctcccattgaaacacaaccttctattgaatccaactatgatacctgcaaagtcccactgattccctctaaagaagaagaagataaccaaaaggctgggaggtgggacagaatcaagagaagaatagtttcactgtcggagaaagtcaacttaaggacgatatttgctccatcaactattgctgcgatgatcgcgcttgtgatcggtctcattactccattaaggaagctaataatcggcaacggagctcctcttggagtgcttcaagactcagtaactctagtgggagatggagccattcctgctatgaccttgatcattggaggaaacctactcaaaggtatgaggagctcaggaatgaaaaaatcctccatcatcggcgttttggttgcacgttacattctcctacctataagtggtgtgttaatcgtaagaggagcatacaagttggacttgattacctcagaacccttgtaccagttcgttctgcttattcagtatgctgtcccaccagcaatgaatctaggtacaattactcaattattcggagctggggaaagtgaatgctcagtgattatgttatggacttatgctttggcttctgtttcactcactgcttggcctacgttcttcatgtggcttgtggcttaaaaccaccacactagatcatgttatatattgtatactgttttgaacatcttagatcattggatcatttatcattatagaatagataagttttcttaaaaacgttggaagctaataaagtcttagatacaaacttgggaacagaaagaaacacaatcaaagaagcacactagagatatgcttgaaagaagcactaactcaaagatcaaaatcctcctcagagagaggacttgtcctgcagatcatcgaagtaaggatgctccatagccatctttgctgagatccgtttagctggctcatactgcagcattttctgttccaggaagatgattataacatgtttagttcgtggtgttgagtgagttctgataactagttaaagatctttgaaacttacagagagaagatcaagtccagcctgatcgagttttggaacagatgtggagagagacaacggcttccactgtggatactcgtgccagttcttgagcgtgctcacacct

SEQ ID NO: 372 - DNA, 1372 bp, Eutrema halophilum
ttcatatgcaaaaaccaaaatcattatggattatgttttgcagataatctagctttggaaaaaaaaaaattggaagtagagatgatgaagcttttggatctgttcataacttcatcgaaaccagttgtggagattctgttgataacatcagttggattttacatggctctagatggagtcaatcttcttggtcaagatgctcgcaagtatttgaacagcattgtcttctatgtgtttagtccttcgcttattggaagccgtttagctgatagtgttacatatgaaagcttagtgaaaatgtggttcatgccggttaatgttctgttcacattcatcattggttcgttattaggctggattgttattgtcatcactaaacctccttcgaatcttcgtggtctcattcttggttgctgtgctgctgggaatttggggaatatgcctttgatcataatcccagccgtttgtaaagaaaaaggaggtccctttggagatcctgagagttgccagaaatatggaatgggttatgctgcactctccatggctatgggatcagtttacatatggacttacgtatacaatcttatgcgggtgctatcaaactctcccattgaaacccaaccttctattgaatccaactacgacagctgcaaagtcccactgatttcttccaaacaagaagaagacaaccataaggttgggaggtgggaaaaagtcaagcggagatgggtttcactgtctgagaaagtcaatttgcggacaatatttgctccttcaactattgctgcgataatcgcgcttgtggtcgggctcgttactccttttaggaagcttataattggcaacgtagctcctctccgggtgcttcaagactctgttactctagtgggagatggggccattcctgctacgacactgataattggagggaacctactcaaaggtatgaggagctcaggaatgaaaaaatccagtatcattggcgtcttggttgcacgttacattttcctgcctataagtggtgttttactcgtaagaggagcctataagttggatcttattacctcagagcccttgtaccagttcgttcttcttattcagtatgttgtcccaccagcaatgagtctaggtacaataactcagttatttggagccggggaaaatgaatgctcagtgattttgctctggacttatgctttggcttcgatttcactcactgtctggcccacattcttcatgtggcttgtggcttaaatccccacactcagaatgtttgttacatgtattattgttttgttccatttattcaagaattgtctccctggacttccaggtgattggatcatcatttactgaacaccgtcattagaga

SEQ ID NO: 373 - DNA, 1505 bp, Brassica rapa
aagtgtaacgccagacgcattttctctttcatatagagaaaatagtgtaaaggtttcgtttcttttctggagtttccggcggaatattccaaaaaaaattatttatttgtcaccggacatatattttcagatattagctttgaggaaggagagatgatgaagcttttgcatctgttcataacttcatcaaaaccagttgtggagattctgctgataacaacagttggattctatatggctcttgacggagtcaatcttcttggtcaagatgctcgcaaatttttgaacaacattgtcttctatgtgtttagtccttcccttattggaagccgtttagctaatagtgttacatatgaaagcttgatgcaaatgtggttcatgccggttaatgttctgcttacattcatcattggttcgttcctaggctggattgttattctcatcactaaacctccttcccatcttcgtggtctcattgttggttgttgtgctgctgggaatctgggaaacatgccactaatcattgttccagctgtttgtaaagagaaaggaggcccctttggagatcctgagaattgtcagaagtatggagttggttatgttgcactctccatggctatggggtcaatttacatatggacatacgtatacaatcttatgcgggtgctaacaaactctcccattgaaactcaaccttctattgaatccagctgcaaagtcccactgatttcttctaaagaagaagaagataaccaaaaggttgggaggtgggacaaagtcaagagaagaatggtttcactgtctgggaaagtcaatttaaggacaatatttgctccatcaactattgctgcgatgatcgcgctcgtggtcgggctaattactcctataaggaagctaatcatcggtaatggagctcctctaggagtgcttcaagactcagtaactttagtgggagatggggccattcctgctatgacattgatcattggaggaaacctactcaaaggtatgagaagttcaggaatgaaaaaatcaagcattgttggcgtcttggttgcacgttacatattcttgcctataagtggtgttttaatcgtaagaggagcatacaagtttgatttgattacctcagagcctttgtaccagttcgttcttcttctacagtatgctgtcccaccagcaatgaatctaggtacaataactcagttgtttggagctggggaaagtgaatgctcagtgattctgctctggacttacgctttggcttcagtttcactcactgtttggcccacattcttcatgtggcttgtggcttagttcactcttcaccacaccttgagcttgcaatatgtattgttttattccattcattcaagatctgaacttgtagatgattggatcatgtattgaagaccatcattatagaatagatatatttccttgaaaacgttgaaagctagaaaagcctttgatacgcaaatcagaaataataataatatgctaaa

SEQ ID NO: 374 - DNA, 1400 bp, Brassica napus
aaaataattatttatttgttaccggagatatattttcagatattagctttgaggaaggagagatgatgaagcttttgcatctgttcataacttcatcaaaaccagttgtggagattctgctgataacaacagttggattctatatggctcttgacggagtcaatcttcttggtcaagatgctcgcaaatttttgaacaacattgtcttctatgtgtttagtccttcccttattggaagccgtttagctaatagtgttacatatgaaagcttgatgcaaatgtggttcatgccggttaatgttctgcttacattcatcattggttcgttcttaggctggattgttattctcatcactaaacctccttcccatcttcgtggtctcactgttggttgttgtgctgctgggaatctgggaaacatgccactaatcattgttccagctgtttgtaaagagaaaggaggtccctttggagatcctgagaattgtcagaagtatggagttggttatgttgcactctccatggctatggggtcaatttacatatggacatacgtatacaatcttatgcgggtgctaacaaactctcccattgaaactcaaccttctattgaatccagctgcaaagtcccactgatttcttctaaagaagaagaagataaccaaaaggttgggaggtgggacaaagtcaagagaagaatggtttcactgtctgggaaagtcaatttaaggacaatatttgctccatcaactattgctgcgatgatcgcgcttgtggtcgggctaattactcctataaggaggctaatcatcggcaatggagctcctctaggagtgcttcaagactcagtaactttagtgggagatggggccattcctgctatgacattgatcattggaggaaacctactcaaaggtatgagaagttcaggaatgaaaaaatcaagcattgttggcgtcttggttgcacgttacatattcttgcctataagtggtgttttaatcgtaagaggagcatacaagtttgatttgattacctcagagcctttgtaccagttcgttcttcttctacaatatgctgtcccaccagcaatgaatctaggtacaataactcagttgtttggagctggggaaagtgaatgctcagtgattctgctctggacttacgctttggcttcagtttcactcactgtttggcccacattcttcatgtggcttgtggcttagttcactcttcaccacaccttgagcttgctatatgtattgttttattccattcattcaagatctgaacttgtagatgattagatcatgtattgaagaccatcattatagaatagatatatttccttgaaaacgttgaaagctaggacagccttgatacgcaaagcagaactctcg

SEQ ID NO: 375 - DNA, 1574 bp, Raphanus sativus
  misc_feature (605)..(605): n is a, c, g, or t
gggaacgccagcctctagaagcatattttctctttttttttggaaaactcatattttctttttcatatagagagaaaatagtataaaggtttcgtttttctggattctccggcggaatatttcctaaaagattatttatttgttgccggagatatattttcagatttactagagagtattttcgagctctgttttggtcaaattcatatgcaacaaccgaaaatcatgtttatttatatttgcagatattagcgttggagaaagcagagatgatgaaacttttgcatctgttcataacttcatcgaaacctgttgtggaaattctgctgataacaaccgttggattctatatggctcttgacggagtcaatcttcttggtcaagatgctcgaaaagttttgaacaacattgtcttctatgtgtttagtccttcccttattggaagccgtttagctaatagtgttacatatgaaagcttgatgcaaatgtggttcatgccggttaatgttctgctcacattcatcattggttcgttcttgggctggattgttattctcatcaccaagcctccttcccatcttcgtggtctcattgttggttgttgngctgctgggaatctgggaaacatgccattaatcattgttccagctctttgtaaagagaaaggaggtccatttggagatccagagaattgtcagaagtatggagttggttatgttgcactctccatggctatgggagcagtttacatatggacttacgtatacaatcttatgcgggtgctatcaaactctcccattgaaactcaaccttctattgaatccaacagctgcaaagtcccactgatctcatctagagaagaagaggctaaccaaaaggttgggaggtgggacaaagtcaagttaagaatggtttcactggctgacaaagtcaacttaaggacaatatttgctccatcaactattgctgcgatgatcgcgcttgtggtcgggctcattactcctataaggaagctaatcatcggcaacggagctcctctaggagtacttcaagactctgcaactttagtgggagatggagccattcctgctatgacactgatcattggaggaaacttactcaaaggcatgaggagttcaggaatgaaaaaatcaagtattatcggtgtattggttgcacgttacattttcttgcctataagtggtgttttgatcgtaagaggagcatacaagtttgatttgattacctcagagcctttgtaccagttcgttcttcttctacagtatgctgtcccaccagcaatgaatctaggtacaataactcagttgtttggagctggggaaagtgaatgctcagtgattctgctctggacttacgcttttgcttcgatttcactcactgtttggcctacatacttcatgtggcttgtggcttagaatcctcaccaccacacgcttgagcttgctatatgcattgttttgttccattcattcaagattgaactttgttgatgattgagtcatcatgtattgaacatcatcattatagaatagatatattttcttgaataaaga

SEQ ID NO: 376 - DNA, 1651 bp, Brassica rapa
tcttacaaatatttatttatttgctaccaaagaaatatttttcaggtttactagaatatttttcaagctctgttttcgttttctgttttcttggagtcccactaattcatatgcaacaaccgaagttatgggtatatggattatgtttgcaggtattagctttggagaaataaaaagtggaagtagagatgttgaagcttttgcatctgttcataacttcatcaaaaccagtggtggagattctgctgataacatcagttggactttatatggctctggatggagtcaatcttcttggtccagatgctcgcaaatatttgaacgacattgtcttttatgtgtttaatccatcgcttgttggaagccgtttagctgatagtgttacatatgacagcttggtgaaaatgtggttcatgccgattaatcttctgctcacattcatcattggttcgttattaggctggattgttattctcatcactaagcctccatccaatcttcgtggtctcattgttggttgttgtgctgctggtaacttgggaaacatgccattaatcataatcccagctgtttgtaaagataaaggaggtccatttggagatcctgagaactgcaacaagtatggaatgggttatgttgcactctccatggcgatgggatcagtttacatttggacttacgtttacaatattatgcgtgtgctatcaaactctgtcattgaaacccaaccttctattgaatccaactgcaaagtccccctgatctcttccagagaagaagaagaagataaccataaggttgggaggtgggacagattcaagagaagaatggtttcactgtcagagaaagtcaacttaagtacaatatttgctccaacaactattgctgcgataatcgcgcttgtgattggtctcattaatcctgtaagggagctaataatcggcaacgtagctcctcttggagtgcttcaagactcagttactctagtgggagatggagccattcctgctacgaccctgatcattggaggaaacctactcaaaggtatgaggagttcaggaatgaaaagatccagcattgttggcgtcttggttgcacgttacattctcctgcctataagtggtgttttaatcgttagaggagcatacaagttggatttgattacctcagaaccgttgtaccagtttgttctgctcattcagtatgctgtcccaccagcaatgagtctaggtacgataactcagttatttggagctggggaaagtgaatgctcagtgattatgctatgggcttatggtttggcttcggtttcactcactgcttggcctacatttttcatgtggcttgtggcttaagtccccacagttgctatgtgtatgtttttttccatttatttaacatttgaatttccatcatgtattattgaagaccatgattatagaatagatatatgctaaaggtaagagggttcatagtgcgagaagcacactagagatatgctttaaattgtgttatgtttgtcaaagtaagtgggtgacaagtgaagacaaaatacttacctgaaaatatggaggagctgttggagctcagagtcctcaccaaagattgcttgattggtcataagttcagctcttaatggtaaagaaacaaa

SEQ ID NO: 377 - DNA, 1354 bp, Raphanus sativus
  misc_feature (304)..(304): n is a, c, g, or t
  misc_feature (381)..(381): n is a, c, g, or t
  misc_feature (442)..(442): n is a, c, g, or t
  misc_feature (474)..(474): n is a, c, g, or t
  misc_feature (518)..(518): n is a, c, g, or t
  misc_feature (570)..(570): n is a, c, g, or t
  misc_feature (952)..(952): n is a, c, g, or t
  misc_feature (968)..(968): n is a, c, g, or t
  misc_feature (991)..(991): n is a, c, g, or t
  misc_feature (1338)..(1338): n is a, c, g, or t
ggacaagttaacgtattagctttggggaaataaaaagtggaagtagagatgatgaagcttttgcatctgttcataacttcatcgaaaccagttgtggagattctgatgataacatcagttggattttatatggctctggatggtgtcaatcttcttggtccagattctcgcaaatatttgaacgacattgtcttttatgtgtttaatccttcgctcgttgggagccgtttagctgatagtgttacatatgaaagcttggtgaaaatgtggttcatgccggttaatcttctgctcacattcatcnttggttcgttcttaggctggattgttatcctcatcactaagcctcctccgcatctccgtggtctcatcgttggttgntgtgctgctggtaacttgggaaacatgccattaatcataatcccagctgtttgtaaagacntagaaggtccatttggagatcctgagaactgncacaagtatggaatgggttatgttgcattctccatggccattgnatcagtttacatatggacttacgtatacaatcttatgcgtgtgctatcaaantctcccactgaagcacaaccttctattgaatccagctataaagtccctctgatatcttccaaagaagaagaagaagaagaagataaccataaggtcgggaggtgggacagattcaagagaagaatggtttcactgtcggagaaagtaaacttaagtataatatttgctccaacaactattgctgcgataatcgcgcttgtgatcggtcttattaatcctttaagggagctaataattggcagcgtagctcctcttggagtgcttcaagactcagtaactctagtgggagatggagccatccctgctacgaccctgatcattggaggaaacctactcaaaggtatgagagctcaggaatgaaaaaatcaagcattgccggtgncttggttgcacgttanattctcctgcctataagcggtgntttaatcgtaagaggagcatacaagttggatctgattacctcagagccgttgtaccaattcgttctgcttattcagtatgctgtaccaccagcaatgagtctaggtacgataactcagttatttggaactggggaaagtgaatgctcagtaataatgctatgggcttacggttttgcttctgtttcactcactgcttggcccacatttttcatgtggcttgtggcttaaacccccacacttgatcttgataaatgtattattttgttccatttatttaagatttgaacttctagactatttgatcatgtgtattacttaagaccatcaatacctgtagttttattanatagtttggctaacca

SEQ ID NO: 378 - DNA, 1434 bp, Arabidopsis lyrata
aaaaaacctgcttactccgtaaatcaaagctagatccaattttagttttatttccttttttgactctctctctatctctctctctctctctccgagatttggctgacccttttatttctcttcttctcctaagctcattcacacaactctcaacatttccggattttttttttctttctaaagaaggaaaacaaaacaaagaagaaaaaaagttgaaaactttgcatctgggtttgtcgaatttagattcagatcttgaaagtttcgattgaatctctggcaatggtaatggaaacagagtcaaagttccatgttttagctgttgatgatagtctttttgatcggaaaatgatagagagattgctccaaaagtcttcatgtcaagtaactacagttgattcaggctctaaagctcttgaatttctgggtttaagagtagatgacaacaacccaaatgcactctctacatcaccccaaattcatcaggaagttgaaataaatcttataataacagattactgtatgcctggcatgactggttatgatttgctcaagaaagttaaggaatcagcggcattaagaagcatacctgtcgttataatgtcatctgagaacgttccagctagaatctccagatgtttggaagaaggagctgaagagtttttcttgaaaccagtaaagttggctgatcttactaagttgaaacctcatatgatgaaaaccaaattgaagaatgaaagtgagaaaccagttgccatagaagagattgtagtttctaaaccggagatagaaaaagaagaagcttcatcagtgattgagatcttgcctctccaccaagaacttgaaccaatgttgagtagtaataagcggaaagcaatggaagaagtgatatctactgatcgatcacgtcctaaatacaatgatatcacaacctcagtctgacaaactactgacgcaaatcgagcacctgctagacgaccaatatggagaatctgaatatgaggcaaacaacaacgccttgcaaggagtaataccgcaacaacagcgtcatccttatcatcaggaacaagagacaaaccagacacaaggagatccactgaatcgaatacttgttcaattagaagctttaaaccattcagatagtggtgatagcacattaacaatggctcagaaccagcatggtctccaaagtagtggatttattattatctgtcaatttacttctctcctctagattagctttcttagttttttttttctttttcatggggtgataaacccacaagatttttagaaagtttcttgctactagcttaataatccaaaactattgcaaagatcggatttttcgagaattagaattgaatcttatcaaaactaacaactacattcactagcttaagaaccatcaaacgaattataaaattctctcat

SEQ ID NO: 379 - DNA, 938 bp, Eutrema parvulum
tttcaacaatgggtatggtaacagagtcacagttccatgttttggctgttgatgatagtctctttgatcgaaaaatgattgagagattgctgcaaaagtcttcgtgtcaagtaacaacagttgattcaggctctaaagctctcgaatttctgggtttgagagaaagcgatgagatcgacgacccaaatgcgccttcttcatcacccgaaacccatcaggaagttgaaatcaatctcataatcacagattactgtatgcctggcatgactggttatgatttgctcaagaaagttaaggaatcagctgcatttaaaagcataccagtagtaataatgtcatcggagaacgttcctgctagaatctccagatgtctggaagaaggagctgaagagtttttcttgaaaccagtaaaactggctgatcttaccaagttgaaacctcatatgatgaaaaccaaattgaagaaagaaagtgagaaaccagtagaagaagagaatgcagctttgaaaccaaagatagaagaagaatcacaggtaaatgaaaccttgcctcttcatcaagaacttgtatccgaacaagatgaaccaattttgagtaataataaaaggaaagcaatggaagaagtgatatctactgatcggtcacgtcctaaatacaacgatatcacaacgccggtgtgacccgttctttctttcgttgttctgcaagaggttttttttcaaaactttgtttcagagtttttttttataggttctttgtaggaatgcttcttctggtaaatacagggttgctatagaatgaagaggggagatatatgtagatgatgataatggctgctcgttttgtttattattcattaaatgaagactctataaattcccggttttgtttatgtttcttattttttgggtatcaaaccaatttgagaagtaaataaa

SEQ ID NO: 380 - DNA, 978 bp, Brassica rapa
tttaattcctcaaaacttgcttggtccgtaactcaaagctagatgcagttttaattttattttccttttcgaatataacccccttttttacttctcctccatttgcaagctcatagacaactctcaccatagagaattaatcttataagaaaaagaacacaaaacaatccaatgggtgtggtaacagagtcacagttccatgttttggcggttgatgatagtctctttgatcggaaaatgatagagagattgctgcaaaagtcttcctgtcaagtaactacagttgattcaggctctaaagctctcgagcttcttggtttgagagaaagcaatgagagtgacgacccaaatgctacttctacatcacctgaagttgaaataaatcttataattacagattactgtatgcctggcatgactggttatgatttgctcaagagagttaaggaatcagctgcatttagaagcattcccgttgtaataatgtcatctgagaacgttcctgctagaatctccagatgtctggaagaaggagctgaggagtttttcttgaaaccagtaaagttagctgatctcaccaagttgaaacctcatatgatgaaaaccaagttgaagaaagaaagtgaaaaaccagcagaagaagtgaaaccggagatagaagaagaagaatcgccagtgattgaaatcttgactctccatcaagaacttgaatccgagcaacaagaaccaatgttgagtaataataagaggaaagcaatggaagaagcgatatctactggtcgatcacgtcctaaatacaacgatatcacaacatcagtctgactgggtgtgatctgataagttttttctcaaaactttgcttcagagtttttgttaggttatttgtaggaatgcttcttctggtagtggggtgggggtgggggggagatatatatatgtagatgatgataaagtactattatcgagcacaagatgacg

SEQ ID NO: 381 - DNA, 1143 bp, Brassica napus
accctctcgttgtcgttctttagtaacaacttactttaaactttacgcttagtcgtaactcaaagctagatccaatcttagtttatttttcttgttcgtctctctgtcctctctcttgatctcattgacaactctcaacatttcctgaaataaacgagcatagagaatcttttatatataagagaacgaaaaacaacaagaagctggaaactttgcatatgggtatggcaacagagtcacagttccatgttttggctgttgatgatagtctagttgatcggaaaatgatagagagattgctgcaaaagtcttcatgtcaagtaactacagttgattcagggtctaaggctcttgagtttctgggtttgagagaaagcaatgagagcaacgacccaaatgcaccctcttcatcacctgtaacacatcaggaaattgaaataaatcttataattacagattactgcatgcctggcatgactggttatgatttgctcaagagagttaaggaatcagcagcatttagaagcattcccgtagtgataatgtcatctgagaacgttcctgctagaatctccagatgtctggaagaaggagctgaggagttcttcttgaagccagtaaagttggctgatcttaccaagttgaaacctcatatgatgaaaaccaaactgaagaaagaaagcgagaactcagcaaaagaagataatgcagttttgaaacatgagataagaaaagaagaagaaccatccgtgattgaaatcttgcctctacatcaagacgttgaacaagaaccaatgttgagtaataataagaggaaagcaatggaagaagtgatatctactgatcgatcacgtcctaaatacaatgatatcacaaccttggtttgaccctttctctcattcggtgtcctgccgaagtttctataaaacaaactttgcttcagagttttttcacttgggtttgttgtaggaatgcttcttctggtaagtacagggctggcatagagaattaagaggagagatatatgtagataatgatggtaatggacctaatggtagtggttttaatttagtattgttcattatgaaaaatcagtagtttcccagttttgtttattttcttagttttctggtatcaaaacaa

SEQ ID NO: 382 - DNA, 694 bp, Eutrema halophilum
ttccacaatgggtgtggtaacagagtcacagttccatgttttggctgttgatgatagtctcttcgatcggaaaatgatagagagattgcttcaaaagtcctcatgtcaagtaactacagttgattcaggctctaaagctctcgaatttctgggtttgagagaaagtaatgatgagagcgaggacccaaatgtgctctctacatcaccagtaactcatcaggaagttgaaataaatcttataattacagattattgtatgcctggcatgactggttatgatttgctcaagagagttaaggaatcagcagcatttaaaagcataccagtagtaattatgtcatctgagaacgttcctgctagaatctccagatgtctggaagaaggagctgaagagtttttcttgaaaccggtaaagctggctgatgttaccaagttaaaacctcatatgatgaaaaccaaattgaagaaagagactgagaaaccaggtaaagaagagatcgcagctttgaaaccggagatagaagaagattcatcggtaattgaaatcttgcctctccatcaagaacttgaatccgaacaacacgaagcaatgttgagtagtaataagaggaaagcaatggaagaagtgatttctactgatcggtcacgtcctaaatacagtgaaatcacaacttcagaccagttttttttatag

SEQ ID NO: 383 - DNA, 726 bp, Brassica napus
acttctcctccatttgcaagctcatagacaactctcaccatagagaattaatcttataagaaaaagaacacaaaacaaaccaatgggtgtggtaacagagtcacagttccatgttttggcggttgatgatagtctctttgatcggaaaatgatagagagattgctgcaaaagtcttcctgtcaagtaactacagttgattcaggctcttaaagctctcgagtttcttggtttgagagaaagcaatcagagtgacgacccaaatgctacctctacatcacctgaagttgaaataaatcttataattacagattactgtatgcctggcatgactggttatgatttgctcaagagagttaaggaatcagctgcatttagaagcattcccgttgtaataatgtcatctgagaacattcctgctagaatctccagatgtctggaagaaggagctgaggagtttttctgaaaccagtaaagttagctgatctcaccaagttgaaacttcatatgatgaaaaccaagttgaagaaagaaagtgaaaaaccagcagaagaagtgaaaccggagatagaagaagaagaagaatcgccagtgattgaaatcttgactctccatcaagaacttgaatccgaacaacaagaaccaatgttgattaataataagagaaaagcaatggaagaagtgatatctactggtcgatcacgtcctaaatacaatgatatcacaac

SEQ ID NO: 384 - DNA, 1249 bp, Brassica rapa
ctttgccagccttctaaaacaactaaactatctgtgggcggtaaaataacaatgcatgtggttgtggtagtatacacattaatcaaatccctcatcttcttatctttaatcctttaaaatcttcatatagatttctttccattattttaatccattaaccaaagtttctttatttccttcctcgttgtctacttatcagaacattactttaatccctcaaaacttgcttagtccgtaactcaaagctagatccaaactttagttttattctctatctctctccctctctttctctccatcttttatttcccgtccatttctaagctcattcaaaacaaaaaaaaatataaaagttagaaacttagcacaatgggtatggtaagagagtcacagttccatgttttggctgttgatgatagtcaattggatcgggaaatgatagagagattgctgcaaaagtcttcatgtcaagtaactacagttgattccggctccaaagctctagagtttctaggtttgagagaaagtaacgacccaaattcactcgaaactcatcaggaagttgaaataaatctcataatcacagactattgtatgcctggcatgactggttatgatctgctcaagaaagttaaagaatcagcagcgtttagaagcattcctgtagtaataatgtcatcagagaacgttcctgctagaatctccagatgtctggaagaaggagctgaagagtttttcttgaaaccagtaaagttggctgatgttaccaagttgaaacctcatatgatgaaaaccaagttgaagaaagaaggtgagaaggtagctgaagaagagaatgcaacttcgaaaccagaagaatcattggtggttgaaatgatcttgcctctgaatcaagaacttgagttggaacaacaagaaccaatgttgagtagtaataagaggaaagcaatggaagaagtgatatctgctgaccgatcacgtcctaaatacaatgacattacaacctcggtctgacccgttcggtgtcctcaatgcttcagagtttcttttcataggaatgcttcttctggtaaatacagagagaatgaagatggaagataaatgtagatgatgatggtaatggtaacggtaacagttgttacttgtatttcattatatgaaaaatcagcaaattctcagttttgatacttattagtttcctggtttaaaacaatctcaagagtaaataaaatctactaagttttcttgt

SEQ ID NO: 385 - DNA, 915 bp, Brassica napus
ctctttctctccatcttttatttcccgtccatttctaagctcattcaaaacaaaaaaaaatataaaagttagaaacttagcacaatgggtatggtaagagagtcacagttccatgttttggctgttgatgatagtcaattggatcggaaaatgatagagagattgctgcaaaagtcttcatgtcaagtaactacagttgattccggctccaaagctctagagtttctaggtttgagagaaagtaacgacccaaattcactcgaaactcatcaggaagttgaaataaatctcataatcacagactattgtatgcctggcatgactggttatgatctgctcaagaaagttaaagaatcagcagcgtttagaagcattcctgtagtaataatgtcatcagagaacgttcctgctagaatctccagatgtctggaagaaggagctgaagagttttttttgaagccagtaaagttggctgatgttaccaagttgaaacctcatatgatgaaaaccaagttgaagaaagaaggtgagaaggtaggtgaagaagagaatgcaacttcgaaaccagaagaatcattggtggttgaaatgatcttgcctctgaatcaagaacttgagttggaacaacaagaaccaatgttaagtagtaataagagaaaagcaatggaagaagtgatatctgctgaccgatcacgtcctaaatacaatgacatcacaacctcggtctgacccgttcggtgtcctcaatgcttcagagtttcttttcataggaatgcttcttctggtaaatacagagagaatgaagatggaagataaatgtagatgatgatggtaatggtaacgtacagttgtacttgtattcattatatgaaaaatcagcaaattctcagttttgatacttattagtttcctggt

SEQ ID NO: 386 - DNA, 1013 bp, Brassica napus
aaaacaaaaaaaaatataaaagttagaaacttagcacaatgggtatggtgagagagtcccagttccatgttttggctgttgatgatagtcacttggatcggaaaatgatagagagattgctgcaaaagtcttcatgtcaagtaactacagttgattccggctccaaagctcttgagtttctaggtttgagagaaagtaacgaccaaaatgcactcgaaactcatcaggaagttgaaataaatctcataatcacagactactgtatgcctggcatgactggttacgatttgctcaagaaagttaaagaatcagtagcgtttagaagcattcctgtagtaataatgtcatcagagaacgttcctgctagaatctccagatgtctggaagaaggagctgaagagtttttcttgaagccagtaaagttggctgatgttaccaagttgaaacctcacatgatgaaaaccaagttgaagaaagaaggtgagaaaccatcagaagaagagaatgcaactttgaaacctgaagaatcattggtggttgaaatgatcttgcctctgaatcaagaacttgagttggaacaaaaagaaccaatgttgagtagtaataagaggaaagcaatggaagaagtgatatctgctgaccggtcacgtcctaaatacaatgacatcacaacctcggtctgacccgttcggtgtcctcaatgcttcagagtttctttgcataggaatgcttcttctggtaaatacagagagaatgaagatggaagataaatgtagatgatggtaatggtaacagttgttacttgtatttcattatatgaaaaatcagcaaattctcagttttgatacttattagtttcctggtttaaaacaatctcaagagtaaataaaagtctactaagttttcttgtttaatttatttatccaagttttgtctgagtttttgttgttttgaagcaaaagaaaatataattaagctctataagacgttctagaagcattaaacatgaatac

SEQ ID NO: 387 - DNA, 828 bp, Raphanus sativus
ggatgataacagagtcaaagttccatgttctggctgttgatgatagtctctttgatcggaaaatgatagagagattgctgcaaaagtcttcttgtcaagtaaccacagttgattcaggctccaaagctctagagtttctggggttgagagaaagtaacgacccaaatgcagttgaaacccatcaggaagttgagatcaatctcataatcacagattactgtatgcctggaatgactggttatgacttgctcaagaaagttaaagaatcatcagcatttaaaagcattcccgtagtgataatgtcatcagagaacgttcctgctagaatctctagatgtctggaagaaggagctgaggagtttttcttgaagccagtaaagttggctgatgttaccaagttgaaacctcatatgatgaaaaccaagttgaagaaagaaggtgagaaaccatcagaagaagagaatgcaactttgaaaccggtgattgaaatcctgcctctccaccaagaacttgagtctgaacaacatgaatcatcaacgttgagtagtaataagaggaaagcaatggaagaagtgatatctactggccgatcacgtcctaaatacaatgatatcacaacctcggtctgaccggttcggtgtcctgcagaagtttttgaaagtttgaaaactttggtttcagagtttgttttcataggaatgcttcttccggtaatacagagagaatgaagataatatgtagatgatgatggtaatggtaacagttcttgaattgttattactgtatttcattatatgaaaaaaaatcagcaaattctcagttttgaca

SEQ ID NO: 388 - DNA, 2539 bp, Eutrema parvulum
gcgtctacgctgctcataattaatatctcctctctttggtagcccgctaatatctcgacacctgtgttcactctttttgtagtttcttcatcttcttcttcttcttcttccctaagttttgagacgaggagattctcagtttccaaggattttctttttctttgcttacggaatctctctcgctgtctctcagatccatcagaaaggttcttgctcttcttgaagatggacagggcagacacgtggggatttgtcagtggtgggagatgtttatatctcaagttgcttttatgtttataatttacgaggtgttctaagtattgtttttttgggcattctatttcatcctcttgcatccttctttcttcttcatatggatttgaacgagaatgtcgttcacttttctcgtgccaacggcattgcaaagcttgacaatttcggtgatactgctctcagcttgaaatgccttggaagcagccaagggagattactagggagctctcaccacaaccataagctttgttctgatgtttctaattgtcctgatgatggttgccgcttggttctcggtttgggtcctacaccgtcctcgtattattacaatgtcagggttaacaataaaaacaaagtctcagcttcttctgggactgttcaggaactctcatcaggaggtaactcaattttgcaactcggccctcccgctgtgagcatggacagtttcagcggacttgattgttcgatgttgacatatgcagagactaatgtatcccaagctgatgagggttctacctctgcaaaacgatcaggtggctatatgccatcgcttcttttcgctccaaggacggaaaacgttagaaaaccttcaagaatgcaagagtgcagtactaactttggaactgatgcttataattcacagctaagccatgagtcagaattttctgcaggcgctgctttctctgacaggacggcatctgctacatcttctcagcacaggacgaccaacccaaagaagtgcaaattcatgggatgtgtgaaaggagctagaggagcatcgggactctgcattggccatggaggtgggcagagatgccaaaaagcaggctgcaacaaaggtgctgagagcaaaactactttctgcaaagcccatggtggaggaaagagatgccaacacctgggatgtacaaaaagcgctgaaggaaaaactgatttctgtatatctcatggtggtggaagacggtgtgggttccctgagggatgcgctaaggctgcacgtggcaaatccgggctctgcatcaagcacggtggtggtaaaaggtgtaggattgaaggctgtacacgaagtgctgagggacaagctgggctttgtatttcccatggtggtgggaggcgttgtcagtcttcaggttgtacaaaaggtgctcaagggagcacaaactactgcaaagctcatggtggagggaaacgctgcatatttgcgggatgtacaaagggagcagaaggtagtactccgctgtgtaaagcacacggtggaggaaaacgctgtatgtttgatggaggtgggatttgtcctaaaagtgtgcacggtggaacgagtttctgtgtagctcatggtggcgggaagagatgtgttgtgacagggtgcacaaagagcgctcgtggccggactgattgttgtgtgaagcacggtggggggaaacggtgcaagtctctcgggtgtgagaagagtgcacaaggtagcactgatttctgcaaggctcatggtggaggtaaacgctgctcgtggggaggagattggaaatgcgagaaattcgctagaggaaagagcggtttatgtgccgcgcataacagtatgtctcaggacaaagctggaagcaagatcggtttgattggaccgggacttttccgtggccttgtctctacctcttcccaaaccacaacaactgcaactactactaccaccaccactgaccattctcagtctggagtcagcgcggtctctgattgcacagactccattgatcgctcgctgcagcggcatcaccatcctgagaaaagacagaagctgatgataccaatgcaggttcttgtgcctccatcaatgaaatccctaagcttctcaaacactgagagaccggaaactgaaacaaacaagaacagtagcaacagcaatgggaggaatatctttgactttatgattccagaggagagagttcatggcggcgggcttatgtctctgcttaatggtagcctgaaacagacactccattgatggaatttgaaagctttctgtattggtgagagtgaggtcatcaccaacaagctatagaatctgtgtaaagcgtatgtaatatgtatagttttctgggttattttctttttccttctctctttggtcctttgtatgtatatattcatgggtctctgttttttgtttgttcctttgacccatctagtcgatggctcgaaccaagtctttgcttatttgattatactaatttggaatgttgcaatgtagtataagcgtttttattgttttgtt

SEQ ID NO: 389 - DNA, 3873 bp, Arabidopsis lyrata
ttctctctcttttgtagccccgctaatatttcgacacctgtttcagtctcttttgtttcttcttcttcttcttcttcttcgtcttcctcgatgttttagacgaagcagagattctcagtttacgaggcttttgcttacggaatctctctctgtctcagatccatcagaatattttaactgctgcagaaaagtttctcttgaagatggacagggcagatacatggggatttgtcagtggtgggagatgtttatatctcaagttgcttttatgtttatagctcttcaaagtgttctaagtatttgttgttttggtcattctgtttcctccgctgcattgttctgtcttctcttcatatggatttgaaccagagtgttgttcacttttctcgtggcaatggtattgcaaagcttgacaatttcggcgatactgctcttagcttgaaatgtcttggaagcagtgcaggaagattcattggaagctctcaccataaccataagctttgttctgatgtttctaattgtcctgatggtggctgccggttggttctcggtttgggtccaacaccgccttcgtattattacaatgtcacgggtaatgataataacatcaaaggctcagcttcttctgggagtgttcaggaactctcatcaggaggcaactcaatcctgcaacttggtcctccagctgtgaccatggatactttcagcggacttgattgttcgttgttgacatacacggatactaatgtgtcccaagctgttgttgacgagggttctacctcagcaaggcgatcaggtggctatatgccatcgcttcttttcgctccaaggacggaaaatgttagaaaaccttcaagaatgcaagagtgtagtacgaattttggaactgatgcttataattcacagctgagccatgagtcagagttctctgttggcgctttctctgacaggtcggcatctgctacgtcttctcagcaaagattgagcaacccgaagaagtgcaagtttatgggatgtgtgaaaggagctagaggagcttcgggactctgcattggccatggaggtggccagagatgccaaaagctaggttgcaacaaaggtgctgagagcaaaactactttctgcaaagcccatggcggaggaaagagatgccaacacttaggatgtacaaagagtgcggaaggaaaaaccgatctctgcatatcacatggtggtggaagacggtgtggattccctgagggatgtgctaaggctgcacgtggcaaatccgggctctgcatcaagcatggtggtggtaaaaggtgtaggatcgaaagctgtacacgaagtgctgagggacaagctggactctgtatttcccatggtggtggacggcgttgtcagtcttcaggctgtacaaaaggtgctcaaggaagtacaaactactgcaaagctcatggtggtgggaaacgctgcatatttgcgggatgtacaaaaggagcggaaggtagtactccgctgtgtaaagcacatggtggaggaaaacgctgtatgtttgatggtggtggtatttgtcctaagagtgtgcatggtgggacgagtttctgtgtagctcacggtggtgggaagaggtgtgttgtggccgggtgcacaaagagcgctcgtgggaggactgattgttgtgtgaagcacggtggtgggaaacggtgtaagtctgatggttgtgaaaagagtgcgcaaggtagcactgatttctgtaaggcacacggtggtgggaagcgctgctcatggggaggagattggaaatgcgagaaattcgctagaggaaagagcggtttatgcgctgcgcataacagtatgtcccaggataaagctggaagcaaggttggtttgattggaccgggacttttccgtggccttgtctctacttcttcacaaaccacaacaactgcaactactactaccactgatcattcacaatctggagtcagcgcggtctctgattgcacggagtccattgatcgcccgctgccaccgctgcttcatcaaccagagaaaagacagaagctgatgataccaatgcaggttcttgtgcctccatcaatgaaatccttaagcttctcaaacaccgagagacccgaaatcgaaacaaacaacaacagtagtggcagcaatgggaggaacatctttgactttatgattcctgaggagagagttcacggcggcgggcttatgtctttgcttaatggttttgtgattttacgatcggaaatttcggttcttcttcttcgttttatagttcaatcgttctcgattttgatttcttcaagctgtgatgatgattctcgttttatcggaaagctttagcggctgagagaaacagtgaataagtcgagacttctctgtctggtgatacaaggatccacaaaggaatctcagattctcctactgtagcggtatgttggacaaagacgagccgtttgtctacaacgaggtggattacaagacgccgaagcagagtccccaaacttggccgatggataagatccggcagagccgttttcaacataaaatgtcatctcttttgagtccggtgactcctaaaaggaattacaacatcagcaatgcaaagtcactcttgctgcaatgcttacgggacgctaaatcagatccactccctcgtaggcgctttccggtttcatgcacagatgaaggaatcttgatggatggtgttctggtcacatcagccactaaaaagaaggtgtctgagtctccttcaagctgtcccggacgatcagcgcgttcttcaatcttccggagtcagcacaagaagaatacagagtttagcagccctataagcgaatcaggccgtaaccaggaaaccactctgtctcagcaatcttcttcagctggcgagggaaagattttagcaaatagtccttgtacaccaaaggctgctaatccttcaaaactgcaagcttctgctgaaccattcatcctcacaccaagacaagctgcttctccttttccaccacagcaactgccatatgatcattataatccgcagtttccatgcgctaatcccctgcacctgcagccatacccgtacttgcaccggcctcggcctctgatctacgtttatcagagaccaccacttcttccgctcttaccccatgggcctgacccctatacgctaaatagtcaaaaggactttcctccaattctctctggcaaccaaacaccaaccaccagtccacattcacttcccacaacaccttcttctagccagcccaacacaaccaccagcgactcaccagtccacactcccatatctactacttttacagccaatctcaataccagtactaccacctccacacatggcccctcaccttctgttgatagagtcgacacagtggcgaaaataccagacttgtcgtcgtcaccttctgatggactcgaaacagtgacgcagaaaccagacttggcttcaccttctactggacgtgaaacagtgacgcaaaaaccagacttggcttcaccttctgctggacttggaaccatgacgataaataaagactggtcaccctctgatgatggactcccaacattcacacaagatcaacttgattttatgaaatcacataacaggctcttcccagactatgttttcgggcgttacaaatacaaaaagagaatgtcagctttcaaacatcaggaggagcaccggtaaaacaaaaaggtaaaattctgttcataaaaagaaaaacttctattcaccactatatttcttcccatacatcaaactttttttcagcttttcataggattgttaaaaactctttgattactacatatacatagaaagctaatagatatttagataacaaacca

SEQ ID NO: 390 - DNA, 2407 bp, Eutrema halophilum
ggagattctcagtttccaagaatttatttttctttgcttacgaaatctctctctcactctgtctctcagatccatcagataaggttcttgctcttccccgttattgaaagatggacagggcagacacatggggatttgtcagtggtgggagatgtttatacctcaagttgcttttatgtttatagtttacaaggtgttccaagtattcttgttttgggcgttctgtttcttcccttttgccatccttctgtcttcttcacatggatatgaacgagagtgtcgttcacttgtctcgtgccaatggtattgcaaagcttgacaatttcggtgatactgctctcagcttgaaatgccttggaagcagcgcagggagattaatggggagctctcaccacaaccataagctttgttctgatgtttctaactgtcctgatggtggttgccggttggttctcggtttgggtccaacaccaccttcctattattacaatgtcagtgttaatagtaacaaaggctcagcttcttctgggattgttcattctgggattgttcaagaactctcgtcaggtggtaattcaattctgcagctcggtcctcccgctgtggccatggatactttcagtggacttgattgttcattgttgacatatacagagaccaatgtgtcccaagctgttgttgatgagggttctacctctgcgaagcgatcaggtggctatatgccgtcgcttcttttcgctccaaggacggaaaacgttagaaaaccttcaagaatgcaagattgtagcactgattttggacaaactgatgcttcacagctgagccatgagtcagagctctctgacaggacggcatcttctcagcaaaggacgaccaacccgaagaagtgcaaattcatgggatgtgcgaaaggagctagaggagcttcagggctctgcattggccatggaggtgggcagagatgtcaaaaggcaggctgcaacaaaggtgctgagagcaaaactactttctgcaaagcccatggtggaggaaagagatgccaacacttgggatgtacaaaaagcgctgaagggaaaacggatttctgtatatctcacggcggtggaagacggtgtgggttccctgagggatgcaccaaggcggcacgtggcaaatcagggctctgcatcaagcacggtggtggcaaaaggtgtaggatcgaaggctgtacacgaagtgctgagggacaagctgggctttgtatttcccacggtggtgggaggcgttgtcagtcttcagggtgtacaaaaggtgctcagggaagtacaaactactgcaaagctcatggtggaggaaaacgctgcatatttgcgggatgtacaaagggagcggaaggtagcactccgctgtgcaaagcgcacggaggaggaaaacgctgtatgtttgatggaggtgggatttgtccaaagagtgtgcacggtgggacaagtttctgtgtagctcatggtggagggaagagatgtgttgtggaagggtgcacgaagagcgctcgagggaggactgattgctgtgtgaagcacggtggtgggaaacggtgtaagtctttagggtgtgagaagagtgcgcaaggtagcactgatttctgcaaggctcatggtggagggaaacgttgctcttggggaggggattggaaatgcgagaaattcgctagaggaaagagcggtttatgcgctgcgcataatagtatgtctcaggacaaagctggaagcaagattggtttgattggaccaggacttttccgtggccttgtctccacttcttcccaaaccacaacaactgcgactactactacgaccactgatcattctcaatctggagtcagcgcggtttctgactgtacagactccattgaccaccacccgccgcagctgcatcatcatcatcatcctgagaaaagacagaagctgatgataccaatgcaggttcttgtgcctccatcaatgaaatccttgagcttctcaaacagtgagagaccggaaaccgagacaaacaacaacagtagcagcaacgggaggaacatctttgactttatgattcctgaggagagagttcacggcggcgggcttatgtctctgcttaatggcagcctgaaacaaactctccattgatggattttgaaagctttctctatcgagctcatcaccaaaaagctagaatccgtgtaaagctttatgtaatatgtatagttttctgggtttttttttttgttttgcctctctcgttggtcctttgtatatttatgggtctttgtttttgctttgtctttgtcttgactttgaccatctagtcgatggttcgaacccaagtctttgtttatttgattattgtttggaatgctacagtgtagtaaagtgttttacgctatgta

SEQ ID NO: 391 - DNA, 2376 bp, Brassica rapa
gctcttataaataatatctctcctctctctctttttgttgcccgataatatttcgacacctgtgttcactctctttgtgtcttcttcttcttcttcagagtttgagacgaggagattctcagtttccaaggggtttctttgcttacgtaacctcactctctccgtccgtctgtctctcagatccatcaggaaggttcttgctcattcttgaatatggacagggcagacacatgggggtttgtcagtggtgggagatgtttatatctcaaattgcttttatgattgtagcttacaaagtcttcttaagtattattgttctaagcatattctgtttcctcccgtcttcttcatatggatttgaacgagagtggccttcacttttctcgtaccaacggtattacaaagcttgacaattacggtgacactgctctcagcttgaaatgccttggaagcactcgctacaaccataagctttgttctgacgtttctaattgtcctgatggtggttgcggcttggttctcggtttaggtccaacaccgccctcttactattacaatgtcaacaaagtgtcagcttcttctgggacttttcaagaactctcatcaggaggcaactcaattctgcaactcggtcctcccgcagtcaccaccatggatgctttcagcagccttgattgctcgttgctgacatatacagagactaatatgtcacaagctgatgagggttccacctctgcaaagcgatcaggtggctatatgtcatcgcttctcttcgctccaaggactgaaaccgttagaaaaccttcaagaatgcaagagtgtagtaataattcacagctgagccatcatgagtcagagttctctgaaagaacggtatccgccacatcttctcagcacaggacgaccaaccccaaaaagtgcaagttcatgggatgcaccaaaggagccagaggcgcatcagggctctgcattggccacggaggtgggcagagatgtcaaaaagcaggctgcaacaaaggcgccgagagcaaaactacattctgcaaagcccacggtggaggaaagagatgccagcacttgggatgtacaaaaagcgctgaaggaaaaactgattattgtatatctcacggcggtggaagacgctgtgggttccctgagggatgcggtaaagctgcgcgaggcaaatcagggctatgcatcaaacacggtggtggtaaaaggtgtaggatcgaaggatgcacaagaagcgctgagggacaagccgggctttgtatctcccacggtggtgggaggcgttgtcagtctccagggtgtacaaaaggtgctcaagggagtacaaactactgcaaagctcacggtggtgggaagcgctgcatattcgctgggtgtactaaaggagcagaaggtagtactccgctgtgcaaagctcacggtggagggaaacgttgtatgtttgatggaggtgggatttgtcctaagagtgtccacggtgggacgagtttctgcgtagctcacggtggtgggaagaggtgtgtggttgcagggtgtacgaagagcgctcgtgggaggactgattgttgtgtgaagcatggtggtgggaaacggtgtaagtctattgggtgtgagaagagtgcgcaagggagtactgacttctgcaaggcgcatggtggaggtaagcggtgctcgtggggaggagattggaagtgcgagaagttcgctagagggaagagcggtttatgcgctgcgcataatagcatggctcaggagaaaggtggaagcaagattggtttgattgggcctggacttttccgtggacttgtctctacctcttctcaaactactgctactactactacaactgatcattctcagtctggagtcagtgcggtctctgattgcacagactccattgatcgctcgctacatcatcagcctgagaaaaggcagaaggtgatgataccaatgcaggtgcttgtgcctccatcgatgaaatctttaagctttacggaggctgagagaccagaaacagaaacaaacaacaacagcagtggaaggaacatctttgactttatgattccggaggagagagttcatggcggtgggctaatgtctctgcttaatggcagcatgaaccagacactccgttgatggaacttgaaagctttctctggctcatcagcaaaaaagctaaagaatctgtgtaaagcttatgtaatatgtatagtttaccttgtctctttgaacctttgtatattcatgggtctgtgtttttgtatggtcttgactctaccatctagtcgatggctcgaacccgagtcttatgtttatttgattattaatttggaattgcaatgtagtataatcagtgttcaaaaa

SEQ ID NO: 392 - DNA, 1572 bp, Secale cereale
gcctcctctcggttccttcttctccttcattgggagctaagctctttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtatgcgtgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggtccccttcgtccccatctctgggtttgagggtgacaacatgattgagaggtccaccaaccttgactggtacaagggccctaccctgcttgaggcgcttgaccagatcaacgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgttggcttcaacgtcaagaatgttgctgtgaaggatctgaagcgtgggtttgttgcatccaactccaaggatgaccctgccaaggaggccgccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgatgctggtatcgtgaagatgattcccaccaagcccatggttgtggagaccttcgccacctaccctcctcttggccgcttcgctgtgcgtgacatgagacaaacagttgctgttggtgtcatcaagggcgtggagaagaaggaccccaccggtgccaaggttaccaaggccgccatcaagaagaaataggcttctatctagcagaaggtttttgttcatggtcattgctttcgttgcttcagactcttatcccgggcgagcaatgatcctgtctgtcgtttaattactgtatttctattcctgcgtaaactcctgtgccctgagactgatttgttgtgaaatgcaagctattagattgcaactta

SEQ ID NO: 393 - DNA, 1685 bp, Secale cereale
ccttcttctccttccttggagctaagctctttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtatgcgtgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggtccccttcgtccccatctctgggtttgagggtgacaacatgattgagaggtccaccaaccttgactggtacaagggccctaccctgcttgaggcgcttgaccagatcaacgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacagttgctgttggtgtcatcaagggcgtggagaagaaggaccccaccggtgccaaggttaccaaggccgccatcaagaagaaataggcttctatctagcagaaggtttttgttcatggtcattgcttttgttgcttcagactcttatcccgggcgagcaatgatcctgtctgtcgtttaattactgtatttctattcctgcttaaactcctgtgccccgagactgatttgttgtgaaatgcaagctattagattgcaacttatgtcacactgtttctccaactatgtttctttttacttaaacttaaaaaaaaaaaaaaaaagaaaaaaaaaagtaaaactactcgtagtcgtatactactactctctctagactacgcgacgacgacac

SEQ ID NO: 394 - DNA, 1620 bp, Secale cereale
tcctctcctcggctccttctccttcattcgagtttcagccatgggtaaggagaagactcacatcaacattgtggtcattggccatgttgactctggcaagtcgaccaccactggccatctgatctacaagcttggaggtatcgacaagcgtgtgatcgagaggtttgagaaggaagccgctgagatgaacaagaggtcgttcaagtacgcctgggtgcttgacaagctgaaggccgagcgtgagaggggtatcacaattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtccctcctggaggcgcttcctggtgacaacgttggcttcaacgtcaagaatgttgctgtgaaggatctgaagcgtgggtttgttgcatccaactccaaggatgaccctgccaaggaggccgccaacttcacctcccaggtcatcatcatgaaccaccctggtcagattggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggtgccaaggttaccaaggccgccatcaagaagaaatgagtgctcttgtctcggccatcgagttatctagcagaagttttagtgtcaagtcttttttggagaatcttagtgtatgttaagtgttgttcctgggcgttgttgcactttgactcctgcacttgtgtgcgagctatgatgtgtcgtttgaatactctattccgattccattattgtgctcttatcccatttgtgattttgtctgcttgtgttgaatgccagtagcgctagatggttat

SEQ ID NO: 395 - DNA, 1733 bp, Secale cereale
cgtagggcgctccacgtcccccgccaccgcccgccgcctcctctcggttccttcttctccttcattggagctaagctctttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtatgcgtgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtgtcttcgtacctgaagaaggtcggctacaaccctgacaaggtccccttcgtccccatctctgggtttgagggtgacaacatgattgagaggtccaccaaccttgactggtacaagggccccaccctgcttgaggcgcttgaccagatcaacgagcccaagaggccctcagacaagcccctccgacttcccctccaggatgtttacaagattggtggcattggaactgtgcctgttggccgtgttgagactggtgtcatcaagcctggtatggttgtcacctttggtcccactggtctgacaactgaggtcaagtccgttgagatgcaccacgagtctctgctggaggcgcttcctggtgacaatgttggcttcaacgtgaagaacgttgctgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtcaccaagattgacaggcgatctggtaaggagctggaagccctgcccaagttcctcaagaatggtgatgctggcatagtgaagatgattcccaccaagcccatggttgtggagacctttgccacctaccctcctcttggtcgatttgctgtccgtgacatgaggcaaactgtggctgttggtgtcatcaagggcgttgagaagaaggacccaaccggcgccaaggtgaccaaggctgccatcaagaagaaatagaggcttttacctgaatccatctatgtctgcttttgagatctctagtagtttagtgcctattaagttttgctactgttagcgccgtgtgatatgcgccctgttgatgtgtcatttgagtactctggtgttatttcggcttttggaggaacatggatgattctgagactaatcatttttatcctctgtatgctttgggatgttatctgtaggctccttttatactcctagctgcggtttgcatttgaaactgttggtggctttctcaaattattcaattttagtatcacttacgtttgaattgtt

SEQ ID NO: 396 - DNA, 1696 bp, Secale cereale
gatctagggtttcctgctagggttttggtccttcgttttcggcggcgcaagatggggagagggtcaagggaaccgtgaagtggttcaacgtcaccaaggggttcggcttcatctccccggaggacggcagcgaggatctcttcgccgcctcctcctctcctcggctccttctccttcattcgagtttcagccatgggtaaggagaagactcacatcaacattgtggtcattggccatgttgactctggcaagtcgaccaccactggccatctgatctacaagcttggaggtatcgacaagcgtgtgatcgagaggtttgagaaggaagccgctgagatgaacaagaggtcgttcaagtacgcctgggtgcttgacaagctgaaggccgagcgtgagaggggtatcacaattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggttccctttgtccccatctctgggtttgagggtgacaacatgatcgagaggtccaccaaccttgactggtacaagggccctaccctgcttgaggcgcttgaccagatcaacgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccatgagtctctcctggaggcgcttcctggtgacaacgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggtgtggagaagaaggaccccaccggtgccaaggttaccaaggccgccatcaagaagaaataggcttctatctagcagaaggtttttgttcatggtcattgcttttgttgcttcagactcttattccgggcgagcaatgatcctgtctgtcgtttaattactgtatttctattcctgcttaaactcctgtgccccgagactgatttgttgtgaaatgcaagct

SEQ ID NO: 397 - DNA, 1601 bp, Secale cereale
ggggcaaaagggggattttgagagaaagaaaacagcagcggggggagaggcgaggtcgccgcctcctctcggttccttcttctccttccttggagctaagctctttcagccatgggtaaggagaagactcacatcaacatcgtggtcattggccatgtcgactctggcaagtcgaccaccactggccatctgatctacaagcttggaggtattgacaagcgtgtgatcgagaggttcgagaaggaagccgctgagatgaacaagaggtctttcaagtatgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcatgccctcctcgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggttccctttgtccccatctctgggtttgagggtgacaacatgattgagaggtccaccaaccttgactggtacaagggccctaccctgcttgaggcgcttgaccagatcaatgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacagttgctgttggtgtcatcaagggcgtggagaagaaggaccccaccggtgccaaggttaccaaggccgccatcaagaagaaataggcttctatctagcagaaggtttttgttcatggtcattgcttttgttgcttcagactcttatcccgggcgagcaatgatcctgtctgtcgtttaattactgtatttctattcctgcttaaactcctgtgccccgagactgatttgtt

SEQ ID NO: 398 - DNA, 1504 bp, Secale cereale
tccttctccttcattcgagtttcagccatgggtaaggagaagactcacatcaacattgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtacgcctgggtgcttgacaagctgaaggccgagcgtgagaggggtatcacaattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtccctcctggaggcgcttcctggtgacaacgttggcttcaacgtcaagaatgttgctgtgaaggatctgaagcgtgggtttgttgcatccaactccaaggatgaccctgccaaggaggccgccaacttcacctcccaggtcatcatcatgaaccaccctggtcagatcggcaacggctacgccccagtgctggactgccacacctcccacattgctgtcaagtttgctgagctggtgaccaagatcgacaggcggtctggtaaggagctggaggccctgcccaagttcctgaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggtgccaaggttaccaaggccgccatcaagaagaaatgagtgctctggtctcagccattgagttatctagcagtaagttttagtgtcaagttctttttggagtaatcttagtgtatgttaagtgttgttcctggtcgttgttgtctactttgactcctgctacttgtgtgcg

SEQ ID NO: 399 - DNA, 1562 bp, Secale cereale
ttcattcgagtttcagccatgggtaaggagaagactcacatcaacattgtggtcattggccatgttgactctggcaagtcgaccaccactggccatctgatctacaagcttggaggtatcgacaagcgtgtgatcgagaggtttgagaaggaagccgctgagatgaacaagaggtcgttcaagtacgcctgggtgcttgacaagctgaaggctgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcaaatgatctgctgctgcaacaagatggatgccaccactcccaagtactcgaaggcccgttatgaggaaattgtcaaggaagtctcttcctacctgaagaaggtcggctacaaccctgacaaggttcccttcgtccccatctctgggtttgagggtgacaacatgattgagaggtccaccaaccttgactggtacaagggccctacccttctcgaggctcttgaccagatcaacgagcccaagaggccctcagacaagcccctgcgtcttccccttcaggatgtttacaagattggtggcattggaactgtgcctgttggacgtgttgagactggtgtcatcaagcctggtatggttgtaacctttggtcccactggtctgacaactgaagtcaagtctgttgagatgcaccacgagtctctcctggaggcgcttcctggtgacaatgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagacctttgccacctaccctcctcttggccgcttcgctgtgcgtgacatgagacaaacggttgctgttggtgtcatcaagggtgtggagaagaaggaccccaccggtgccaaggttaccaaggccgccatcaagaagaaatgagtgctctggtctcagccatggagttatctagcagaagttttagtgtcaagtcttttttggagaatcttagtgtatgttaagtgttgttcctgggcgttgttgcactttgactcctgcacttgtgtgcgagctatgatgtgtcgtttgaatactctattccgattccattattgtgctcttatcccatttgtggttttgtc

SEQ ID NO: 400 - DNA, 1637 bp, Secale cereale
cgagtttatacatcagccatgggtaaggagaagactcacatcaacatcgtggtcattggccatgtcgactctggcaagtcgacgaccactggccatctgatctacaagcttggaggcattgacaagcgtgtgatcgagaggttcgagaaggaagccgcggagatgaacaagaggtctttcaagtacgcctgggtgcttgacaagctcaaggctgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggttttgaggctggtatctccaaggatggccagacacgtgagcacgctctccttgctttcactcttggagtgaagcagatgatttgctgctgcaacaagatggacgccaccactcccaagtactcaaaggctcgttacgaagaaattgttaaggaggtgtcttcctacctgaagaaggttggctacaaccctgacaaggttccctttgtccccatctctgggttcgagggtgacaacatgatcgagaggtccaccaaccttgactggtacaagggccccaccctgcttgaggcgcttgaccagatcaacgagcccaagaggccctcagacaagcccctccgacttcccctccaggatgtttacaagattggtggcattggaactgtgcctgttggccgtgttgagactggtgtcatcaagcctggtatggttgtcacctttggtcccactggtctgacaactgaggtcaagtccgttgagatgcaccacgagtctctgctggaggcgcttcctggtgacaatgttggcttcaacgtgaagaacgttgctgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtcaccaagattgacaggcgatctggtaaggagctggaagccctgcccaagttcctcaagaatggtgatgctggcatagtgaagatgattcccaccaagcccatggttgtggagacctttgccacctaccctcctcttggtcgatttgctgtccgtgacatgaggcaaactgtggctgttggtgtcatcaagggcgttgagaagaaggacccaaccggcgccaaggtgaccaaggctgccatcaagaagaaatagaggcttttacctgaatccatctatgtctgcttttgagatctctagtagtttagtgcctattaagtttttgctactgttagcgccgtgtgatatgcgccctgttgatgtgtcatttgagtactctggtgttatttcggcttttggaggaacatggatgattctgagactaatcatttttatcctctgtatgctttgggatgttatctgtaggctccttttatactcctagctgcggtttgcatttgaaactgttggtggctttctcaaattattca

SEQ ID NO: 401 - DNA, 1669 bp, Secale cereale
attcgagtttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtacgcctgggtgcttgacaagctgaaggccgagcgtgagagggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtttcttcgtacctgaagaaggtcggctacaaccctgacaaggttccctttgtccccatctctgggtttgagggtgacaacatgattgagaggtccaccaacctcgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtccgttgagatgcaccacgagtctctcctggaggcgcttcctggtgacaatgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacagttgctgttggtgtcatcaagggcgtggagaagaaggaccccaccggtgccaaggttaccaaggccgccatcaagaagaaataggcttctatctagcagaaggtttttgttcatggtcattgctttcgttgcttcagactcttatcccgggcgagcaatgatcctgtctgtcgtttaattactgtatttctattcctgcttaaactcctgtgccctgagactgatttgttgtgaaatgcaagctattagattagaaacaaaaaaaaaaagaaaaaaaaagaaaaaaaaagaaaaaaaagaaaaaaagaaaaagaaaagaaagaagaagagaagagagagagagagagatagagagagtacatagagacgtagacgagacgagagagacagcag

SEQ ID NO: 402 - DNA, 1733 bp, Secale cereale
gcctcctctcggttccttcttctccttcattgggagctaagctctttcagccatgggtaaggagaagactcacatcaacatcgtggtcattggccacgtcgactctggcaagtcgacgaccactggccacctgatctacaagcttggaggcattgacaagcgtgtgatcgagaggttcgagaaggaagccgctgagatgaacaagaggtctttcaagtacgcgtgggtgcttgacaagctcaaggccgagcgtgagagaggtatcaccatcgatattgctctctggaagttcgagaccaccaagtactactgcaccgtcatcgatgcccctggtcaccgtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtaaagcagatgatctgctgctgcaacaagatggacgccaccactcccaagtactcaaaggcgcgttatgaagaaattgttaaggaggtctcttcctacctgaagaaggtcggctacaaccctgacaaggttcccttcgtccccatctctgggtttgagggtgacaacatgattgagaggtccaccaaccttgactggtacaagggcccaaccctgcttgaggcgcttgaccagatcaacgagcccaagaggccctcagacaagcccctccgtcttcccctccaggatgtttacaagattggtggcattggaactgtgcctgttggccgtgttgagactggtgtcatcaagcctggtatggttgtcacctttggtcccactggtctgacaactgaggtcaagtctgtggagatgcatcatgagtctctcctggaggcgcttcctggtgacaacgttggcttcaatgtcaagaacgttgccgtgaaggatctgaagcgtgggtttgttgcatccaactccaaggatgaccctgccaaggaggcagccaacttcacctcccaggtcatcatcatgaaccaccctggtcagattggcaatggctatgccccagtgctggactgccacacctcgcacattgctgtcaagtttgctgagctggtgaccaagatcgacaggcgatccggcaaggagctggaggccctgcccaagttcctcaagaatggtgatgctggcatagtgaagatgattcccaccaagcccatggttgtggagacctttgccacttaccctcctcttggtcgttttgctgtccgtgacatgaggcagactgtggctgttggtgtcatcaagggcgtcgagaagaaggacccaaccggcgccaaggtgaccaaggctgccatcaagaagaagtaactccacaattgatatccaaatcactgtttcagacaccaagcagttattagtgttggctgagttttgttaagggcattgttcgtactgggtatattttagctgttcagctgttagcgctgcatttcgtgcccttagtggtgtctgtcttgtgccttttacatactgtcctaatgtaagcttcggtgaaacctggatgttatgagacttggttgtgtcttttaatctgttggctgagtttattgaattttatctgtgtagagctttatctagtgcatttttgaaagacacaaatgaatctaaaccatttgttcttatatgtttaaggtgttattttatt

SEQ ID NO: 403 - DNA, 1550 bp, Secale cereale
cgggaccgccgccgcctcctctcggttccttcttctccttcattgggagctaagctctttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtatgcgtgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcaaatgatctgctgctgcaacaagatggatgccaccactcccaagtactcgaaggcccgttatgaggaaattgtcaaggaagtctcttcctacctgaagaaggtcggctacaaccctgacaaggttcccttcgtccccatctctgggtttgagggtgacaacatgattgagaggtccaccaaccttgactggtacaagggccctacccttctcgaggctcttgaccagatcaacgagcccaagaggccctcagacaagcccctgcgtcttccccttcaggatgtttacaagattggtggcattggaactgtgcctgttggacgtgttgagactggtgtcatcaagcctggtatggttgtaacctttggtcccactggtctgacaactgaagtcaagtctgttgagatgcaccacgagtctctcctggaggcgcttcctggtgacaatgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggtgccaaggttaccaaggccgccatcaagaagaaatgagtgctcttgtctcggccatcgagttatctagcagtaagttttagtgtctaagttcgtttttggagtaatcttagtgtatgttaagtgttgttccgtgggtcgttgttgctactttgactcctgctacttgtgtgcgagcta

SEQ ID NO: 404 - DNA, 1549 bp, Secale cereale
gttccttcttctccttccttggagctaagctctttcagccatgggtaaggagaagactcacatcaacatcgtggtcattggccatgtcgactctggcaagtcgaccaccactggccatctgatctacaagcttggaggtattgacaagcgtgtgatcgagaggttcgagaaggaagccgctgagatgaacaagaggtctttcaagtatgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcatgccctcctcgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtccctcctggaggcgcttcctggtgacaacgttggcttcaacgtcaagaatgttgctgtgaaggatctgaagcgtgggtttgttgcatccaactccaaggatgaccctgccaaggaggccgccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacagttgctgttggtgtcatcaagggcgtggagaagaaggaccccaccggtgccaaggttaccaaggccgccatcaagaagaaataggcttctaactagcagaaggtttttgttcatggtcattgctttcgttgcttcagactcttatcccgggcgagcaatgatcctgcctgtcgtttaattactgtatttctattcctgcgtaaactcctgtgccctgagactgatttgttgtgaaatgcaagctattag

SEQ ID NO: 405 - DNA, 1572 bp, Secale cereale
gactcctctcggttccttcttctccttccttgggagctaagctctttcagccatgggtaaggagaagactcacatcaacattgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtatgcctgggtgcttgacaagctgaaggccgagcgtgagaggggtatcaccattgatattgccctgtggaagtttgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggacgccaccactcccaagtactcaaaggcccgttatgaggaaattgttaaggaagtctcttcgtacctgaagaaggttggctacaaccctgacaaggttcccttcgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccatgagtccctcctggaggcgcttcctggtgacaacgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaatggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgccgtgcgtgacatgagacaaacagttgctgttggtgtcatcaagggcgtggagaagaaggatcccaccggtgccaaggttaccaaggccgccatcaagaagaaataggcttctatctagcagaaggtttttgttcatggtcattgcttttgttgcttcagactcttatcccgggcgagcaatgatcctgtctgtcgtttaattactgtatttctattcctgcttaaactcctgtgccctgagactgatttgttgtgaaatgcaagctattagattgcaactta

SEQ ID NO: 406 - DNA, 1850 bp, Triticum aestivum
gtgtgctggatcggctttcgagcggccgcccgggcaggtcccgccgccgcctcctcctctccgctccttctccttccttcgagtttcagccatgggtaaggagaagactcacatcaacatcgtggtcattggccatgtcgactctggcaagtcgaccaccactggccatctgatctacaagcttggaggtattgacaagcgtgtgatcgagaggttcgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccacccccaagtactcgaaggcccgttatgaggaaattgtcaaggaagtctcttcctacctgaagaaggtcggatacaaccctgacaaggttccctttgtccccatctctgggtttgagggtgacaacatgattgagaggtccaccaaccttgactggtacaagggccctacccttcttgaggctcttgaccagatcaacgagcccaagaggccctcagacaagcccctccgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgctgtgaaggatctgaagcgtggctttgttgcatccaactccaaggatgaccctgccaaggaagcggccaacttcacctcccaggtcatcatcatgaaccaccctggtcagatcggcaacggctacgccccagtgttggactgccacacctcccacattgctgtcaagttcgccgagctggtgaccaagatcgacaggcgatctggtaaggagctggaggcgctgcccaagttcctgaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggtgccaaggttaccaaggccgccatcaagaagaaatgagtgctctggtgtctgccatcgagttatctagcagaagttttagtgtcaagtcttttttggagaatcttagtgtatgttaagtgttcctgggcgttattgcactttgactcctgcacctgtgtgcgagctatgatgtgtcgtttaaatactctatttcgattccattattgtgctcttatcccatttgtggttttgttttcctgtggtgaatgctagtactagaacctgctttcccatttgctagtactctgctatcatactatggttaatactttctttgtgataagtttgtttcctgccatatattacagtaattttgctaggagccatttgattttatgtgtgcgcctctctcacctttggcttcttgaggtagacctttctcaaagttgcccagtcatagaggcgcatagtg

SEQ ID NO: 407 - DNA, 1533 bp, Triticum aestivum
cagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctgtggaagttcgagaccaccaagtactactgcaccgtcattgatgctcctggtcaccgtgacttcatcaagaacatgattactggtacctcccaggctgactgtgctgtgctcatcattgactccaccactggtggttttgaggctggtatctccaaggatggccagacccgtgagcatgccctccttgctttcactcttggagtgaagcagatgatctgctgctgtaacaagatggacgccaccactcccaagtactcaaaggcccgttatgaggaaattgtcaaggaagtctcttcgtacctgaagaaggtcggctacaaccctgacaaggttccctttgttcccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtccgttgagatgcaccacgagtccctcctggaggcgcttcctggtgacaatgttggcttcaacgtgaagaacgttgctgttaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtgaagtttgctgagctggtgactaagatcgacaggcgatctggtaaggagctggaggcgctgcccaagttcctgaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggcgccaaggttaccaaggctgccatcaagaagaaataggcatctatctagcagaaggtttttgttcatggtcattgcttttgttgctgcagactcttatcccgggcgagcaatgatcctgtctgtcgtttaattactgtatttctattcctgcttcggctaaactcctgtgccttgagactgatctgttgtgaaatgcaagttattagattgcaacttgtta

SEQ ID NO: 408 - DNA, 1812 bp, Triticum aestivum
tcgagcggccgcccgggcaggtgccgcctcctcctctccgctccttctccttccttcgagtttcagccatgggtaaggagaagactcacatcaacatcgtggtcattggccatgtcgactctggcaagtcgaccaccactggccatctgatctacaagcttggaggtattgacaagcgtgtgatcgagaggttcgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccacccccaagtactcgaaggcccgttatgaggaaattgtcaaggaagtctcttcctacctgaagaaggtcggatacaaccctgacaaggttccctttgtccccatctctgggtttgagggtgacaacatgattgagaggtccaccaaccttgactggtacaagggccctacccttcttgaggctcttgaccagatcaacgagcccaagaggccctcagacaagcccctccgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgctgtgaaggatctgaagcgtggctttgttgcatccaactccaaggatgaccctgccaaggaagcggccaacttcacctcccaggtcatcatcatgaaccaccctggtcagatcggcaacggctacgccccagtgttggactgccacacctcccacattgctgtcaagttcgccgagctggtgaccaagatcgacaggcgatctggtaaggagctggaggcgctgcccaagttcctgaagaacggtgacgctggtatcgtgaagatgattcccaccaagcccatggttgtggagacctttgccacctaccctcctcttggccgcttcgctgtgcgtgacatgagacaaacggttgctgttggtgtcatcaagggcgtggagaagaaggaccccaccggtgccaaggttaccaaggccgccatcaagaagaaatgagtgctctggtgtctgccatcgagttatctagcagaggttttagtgtcaagtcttttttggagaatcttagtgtatgttaagtgttcctgggcgttattgcactttgactcctgcacctgtgtgcgagctatgatgtgtcgtttaaatactctatttcgattccattattgtgctcttatcccatttgtggttttgtttcctgtggtgaatgctagtactagaacctgctttcccatttgctagtactctgctatcatactatggttaatactttctttgtgatgagtttgtttcctgccatatattacagtaattttgctaggagccatttgattttatgtgtgcgcctctctcacctttggcttcttgagattgacctttctcaaagttgcccagtcat

SEQ ID NO: 409 - DNA, 1692 bp, Triticum aestivum
ccgccgccgcctcctcgtcctctcggtcccctctccttccttcgagtttgcttcagccatgggtaaggagaagactcacatcaacatcgtggtcattggccacgtcgactctggcaagtcgacgaccactggccacctgatctacaagcttggaggcattgacaagcgtgtgatcgagaggttcgagaaggaagccgctgaaatgaacaagaggtctttcaagtacgcctgggtgcttgacaagctcaaggccgagcgtgagagaggtatcaccatcgatattgccctctggaagtttgagacaaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtgaagcagatgatctgctgctgcaacaagatggacgccaccactcccaagtactcgaaggctcgttacgaagaaattgttaaggaggtctcttcgtacctgaagaaggtcggctacaaccctgacaaggttcccttcgtccccatctctgggttcgagggtgacaacatgattgagaggtccaccaaccttgactggtacaagggcccaaccctgcttgaggcacttgaccagatcaacgagcccaagaggccctcagacaagcccctccgtcttcccctacaggatgtttacaagattggtggcattggaactgtgcctgttggccgtgttgagactggtgtcatcaagcctggtatggttgttacctttggtcccactggtctgacaactgaggtcaagtccgttgagatgcaccatgagtctctcctggaggcgcttcctggtgacaacgttggcttcaacgtcaagaacgttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcacacattgctgtcaagtttgctgagctggtgaccaagatcgacaggcggtctggtaaggagctggaggccctgcccaagttcctcaagaatggtgatgctggcatagtgaagatgattcccaccaagcccatggttgtggagacctttgccacttaccctcctcttggtcgttttgctgtccgtgacatgaggcagactgtggctgttggtgtcatcaagggcgttgagaagaaggacccaaccggggccaaggtgaccaaggctgccatcaagaagaagtaattccacaattgatatccaaatcactgtttcagacaccaagcagtttttagtattggctgagttttgttaagggcattgttcgtactgggtatattttagctgttcagctgttagcgctgcatatcgtgcccttggtggtgtctgtcttgtgccttacatactgtcctaatgtaagctttggtgaaacctggatgttatgagacctggtttgtgtcttttaatactagcttgttgcattttatctgtgtagatgctttatctagtgcatttttgaaagacacaaatgcatc

SEQ ID NO: 410 - DNA, 1566 bp, Triticum aestivum
cagccatgggtaaggagaagactcacatcaacatcgtggtcattggccatgtcgactccggcaagtcgaccaccactggccatctgatctacaagcttggaggtattgacaagcgtgtgatcgagaggttcgagaaggaagccgctgagatgaacaagcggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcctaagtactcgaaggctcgttatgaggaaattgtcaaggaagtctcttcgtacctgaagaaggttggctacaaccctgacaaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccacgagtctctgctggaggcgcttcctggtgacaacgtcggcttcaatgtcaagaacgttgctgttaaggatctgaagcgtgggtttgttgcatccaactccaaggatgaccctgccaaggaggcggccaacttcacctcccaggtcatcatcatgaaccaccctggtcagatcggtaacggctatgccccagtgctggactgccacacctcccacattgctgtcaagtttgctgagctggtgaccaagatcgacaggcgatctggtaaggagctggaggcgctgcccaagttcctcaagaatggtgacgccggtatcgtgaagatgattcccaccaagcccatggttgtggagaccttcgccacctaccctcctcttggccgctttgctgtgcgtgatatgagacaaacggttgctgttggtgtcatcaagggcgtggagaagaaggaccccaccggtgccaaggttaccaaggctgccatcaagaagaaatgagtgctctggtgtctgccatcgagttatctagcagaagttttagtgtcaagtcttttttggagaatcttagtgtatgttaagtgttattcctgggcgttgttgcactttgactcctgcacctgtgtgcgagctatgatgtgtcgtttaaatactctatttcgattccattattgtgctctcatcccatttgtggttttgtctgcctgtgttgaatgct

SEQ ID NO: 411 - DNA, 1598 bp, Triticum aestivum
tcttcttcgagttgggtagtttagctctacccaccagccatgggtaaggagaagactcacatcaacatcgtggtcattggccacgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaccatcgatattgctctctggaagtttgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggacggccagacacgtgagcatgccctccttgctttcactcttggagtgaagcagatgatctgctgctgcaacaagatggacgccaccactcccaagtactcgaaggcgcgttatgaagaaattgtcaaggaggtctcttcctacctgaagaaggtcggctacaaccctgacaaggttcccttcgtccccatctctgggtttgagggtgacaacatgattgagaggtccaccaaccttgactggtacaagggcccaaccctccttgaggcgcttgaccagatcaacgagcccaagaggccgtcagacaagcccctccgccttcccctccaggacgtttacaagattggtggcattggaactgtgccagttggccgtgttgagactggtgtcatcaagcctggtatggttgttacctttggtcccactggtctgacaactgaggtcaagtccgttgagatgcaccatgagtctctcctggaggcgcttcccggtgacaacgtcggcttcaacgtcaagaatgttgccgtgaaggatctgaagcgtgggtttgttgcatccaactccaaggatgaccctgccaaggaggcagccaacttcacctcccaggtcatcatcatgaaccaccctggtcagattggcaacggctatgccccagtgctggactgccacacctcgcacattgctgtcaagtttgctgagctggtgaccaagatcgacaggcgatctggtaaggagctggaggccctgcccaagttcctcaagaatggtgatgctggcatagtgaagatgattcccaccaagcccatggttgtggagacctttgctacttaccctcctcttggtcgttttgctgtccgggacatgaggcaaactgtggctgttggtgtcatcaagggtgtggagaagaaggacccaaccggcgccaaggtgaccaaggctgccatcaagaagaaatgaggcgtttacctgaatccatctatgtctgcttttgagatctgtagtagtttagtgcctattaagttttgctactgttagcgccgtgtgatatgcgccctgttgatgtgtcatttgagtactgtcgtgttaatttcggcttttggcaaaacatggaagcttctgagactactcatttttatcctctgctttggaatgttaggctgctacttttagtc

SEQ ID NO: 412 - DNA, 1520 bp, Triticum aestivum
cagccatgggtaaggagaagactcacatcaacatcgtggtcattggccatgtcgactctggcaagtcgacaaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcacccttggagtgaagcagatgatctgctgctgcaacaagatggacgccaccactcccaagtactcaaaggcccgttatgaggaaattgtcaaggaagtctcttcgtacctgaagaaggtcggctacaaccctgacaaggttcccttcgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggttaagtctgttgagatgcaccatgagtctctcctggaggcgcttcctggtgacaacgttggcttcaacgtcaagaacgttgctgtgaaggatctgaagcgtgggtttgttgcatccaactccaaggatgaccctgccaaggaggcggccaacttcacctcccaggtcatcatcatgaaccaccctggtcagatcggcaatggctacgccccagtgctggactgccacacctcccacattgctgtcaagtttgctgagctggtgaccaagatcgacaggcgatctggtaaggagctggaggcgctgcccaagttcctgaagaacggtgacgctggtatcgtcaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggcgccaaggttaccaaggctgccatcaagaagaaataggcgtgctatctagcagaatgtttttgttcacggtcattgcttttgttgcttcagactcttatcccgagcgagcaatgatctgtctgtcgtttaattactgtatttctattcctgcgtcggctaaactcctgtgcccctgagactgatttgttgtgaaatgcaagttattag

SEQ ID NO: 413 - DNA, 1721 bp, Triticum aestivum
gaggaattcggcacgaggctttcttccccccgaccgccgccgccgcctcctcctctcggttccctctccttccttcgagtttgcttcagccatgggtaaggagaagactcacatcaacatcgtggtcattggccacgtcgactctggcaagtcgacgaccactggccacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagtttgagaccaccaagtactactgcaccgtcattgatgcccctggtcaccgtgacttcatcaagaacatgatcaccggtacctcccaggctgactgtgctgttctcatcattgactccaccactggtggttttgaggctggtatctccaaggatggccagacacgtgagcacgccctccttgctttcactcttggagtgaagcagatgatctgctgctgcaacaagatggacgccaccactcccaagtactcgaaggctcgttacgaagaaattgttaaggaggtctcttcgtacctgaagaaggtcggctacaaccctgacaaggttcccttcgtccccatctctgggtttgagggtgacaacatgattgagaggtccaccaaccttgactggtacaagggcccaaccctgcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaatgttggcttcaatgtcaagaacgttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggtaaggagctggaggccctgccaaagttcctcaagaatggtgatgctggcatagtgaagatgattcccaccaagcccatggttgtggagacctttgctacttaccctcctcttggtcgttttgctgtacgtgacatgaggcaaactgtggctgttggtgtcatcaagggcgtcgagaagaaggacccaaccggggctaaggtgaccaaggctgccatcaagaagaagtaatttgacaatcgatatccaaatcactgtttcaggcaccaagcagtttttagtattggctgagttttgttaagggcattgctcgtactgggtatattctagctgttcagctgttagcgctgcatatcgtgcccttagtggtgtctgtcttgtgccttctacatactgtcctaatgtaagcttcggtgaaacctggatgttatgagacttggttgtgtcttttaatactagtttgttgaattttatctgtgtagatgctttatctagtgcatttttggatgcatctaaa

SEQ ID NO: 414 - DNA, 1578 bp, Triticum aestivum
cccatccccgccgccgcctcctctcggttccttctccttcctcggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctgtggaagttcgagaccaccaagtactactgcaccgtcattgatgctcctggtcaccgtgacttcatcaagaacatgattactggtacctcccaggctgactgtgctgtgctcatcattgactccaccactggtggttttgaggctggtatctccaaggatggccagacccgtgagcatgccctccttgctttcactcttggagtgaagcagatgatctgctgctgtaacaagatggacgccaccactcccaagtactcaaaggcccgttacgaggaaattgtcaaggaagtctcttcgtacctgaagaaggtcggctacaaccctgacaaggttccctttgttcccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtccgttgagatgcaccacgagtccctcctggaggcgcttcctggtgacaatgttggcttcaacgtgaagaacgttgctgttaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtgaagtttgctgagctggtgactaagattgacaggcgatctggtaaggagctggaggcgctgcccaagttcctgaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggcgccaaggttaccaaggctgccatcaagaagaaataggcatctatctagcagaaggtttttgttcatggtcattgcttttgttgctgcagactcttatcccgggcgagcaatgatcctgtctgtcgtttaattactgtatttctattcctgcttcggctaaactcctgtgccttgagactgatttgttgtgaaatgcaagttattagattgcaaac

SEQ ID NO: 415 - DNA, 1877 bp, Triticum aestivum
tgacggtgcagtagtacatggggatcctcaatctcctcccgccgccgcctcccctcccttcgttcttcttcttcgagttgggtagtttacctctacccaccagccatgggtaaggagaagactcacatcaacatcgtggtcattggccatgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtgaagcagatgatctgctgctgcaacaagatggacgccaccactcccaagtactcaaaggcgcgttatgaagaaattgtcaaggaggtctcttcctacctgaagaaggtcggctacaaccctgacaaggttcccttcgtccccatctctgggtttgagggtgacaacatgattgagaggtccaccaaccttgactggtacaagggcccaacccttcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaacgttggcttcaatgtcaagaatgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagatcgacaggcgatctggtaaggagctggaggccctgcccaagttcctcaagaatggtgatgctggcatagtgaagatgattcccaccaagcccatggttgtggagacctttgctacttacccacctcttggtcgttttgctgtccgtgacatgaggcaaactgtggctgttggtgtcatcaagggtgtggagaagaaggacccaaccggcgccaaggtgaccaaggctgccatcaagaagaaatgaggcgtttacctgaatccatctatgtctgcttttgagatctctagtagtttagtgcaagttttgctactgttagcgccgtgtgatatgcgccctgttgatgtgtcatttgagtactgtcgttaattttggcttttggcaaaacatggaagcttctgagactactcatttttatcctctgctttggaatgttaggctgctacttttagtcttagctgctgtttctctttgaagcctttggtgttcttttgtcgtgataatagcaggttgttttcattctcagatctgcttggattgatccccatctaggcctaccaaaatatgttcggccaatagaggcatgaccaaaatgttggggcttgcttggattgtaactacgaaaattttggcaaaaaatcataggctttgatctgttttcaagccaaaagata

SEQ ID NO: 416 - DNA, 1565 bp, Triticum aestivum
gcccgccgccgcctcctctcggctccttcttccttcgagtttcagccatgggtaaggagaagactcacatcaacatcgtggtcattggccatgtcgactccggcaagtcgaccaccactggccatctgatctacaagcttggaggtattgacaagcgtgtgatcgagaggttcgagaaggaagccgctgagatgaacaagcggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcctaagtactcgaaggctcgttatgaggaaattgtcaaggaagtctcttcgtacctgaagaaggttggctacaaccctgacaaggttcccttcgtccccatctctgggtttgagggtgacaacatgattgagaggtccaccaaccttgactggtaccagggcccaacccttcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaacgttggcttcaatgtcaagaatgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagatcgacaggcgatctggtaaggagctggaggccctgcccaagttcctcaagaatggtgatgctggcatagtgaagatgattcccaccaagcccatggttgtggagacctttgctacttacccacctcttggtcgttttgctgtccgtgacatgaggcaaactgtggctgttggtgtcatcaagggtgtggagaagaaggacccaaccggcgccaaggtgaccaaggctgccatcaagaagaaatgaggcgtttacctgaatccatctatgtctgcttttgagatctctagtagtttagtgcaagttttgctactgttagcgccgtgtgatatgcgccctgttgatgtgtcatttgagtactgtcgttaattttggcttttggcaaaacatggaagcttctgagactactcatttttatcc

SEQ ID NO: 417 - DNA, 1603 bp, Secale cereale
acggccgagaagaaaccctagcgcccatcgctgtccatatatagggccattcctctcgtccgaacccctcctctcagtccccccctcaccgccgccgcctcctctcggttccttcttctccttccttgggagctaagctctttcagccatgggtaaggagaagactcacatcaacatcgtggtcattggccatgtcgactctggcaagtcgaccaccactggccatctgatctacaagcttggaggtattgacaagcgtgtgatcgagaggtttgagaaggaagccgctgagatgaacaagaggtctttcaagtatgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccacttggtggttttgaggcgggtatctccaaggatggccagacccgtgagcaagccctcctcgctttcactcttggagtgaagcaaatgatctgctgctgcaacaagatggatgccaccactcccaagtactcgaaggcccggttatgaggaaattagtcaaggaagtctcttcctacctgaagaaggtcggctacaaccctgacaaggttcccttcgtccccatctctgggtttgagggtgacaacatgattgagaggtccaccaaccttgactggtacaagggccctacccttctcgaggctcttgaccagatcaacgagcccaaagaggccctcagacaagcccctgcgtcttccccttcaggatgtttacaagattggtggcattggaactgtgcctgttggacgtgttgagactggtgtcatcaagcctggtatggttgtaacctttggtcccactggtctgacaactgaagtcaagtctgttgagatgcaccacgagtctctcctggaggcgcttcctggtgacaatgttggcttcaacgtcaagaatgttgctgtgaaggatctgaagcgtgggtttgttgcatccaactccaaggatgaccctgccaagggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacagttgctgttggtgtcatcaagggtgtggagaagaaggaccccaccggtgccaaggttaccaaggccgccatcaagaagaaatgagtgctctggtctcagccatggagttatctagcagtaagttttagtgtctaagttctttttggagtatcttagtgtatgttagtgttgttcctgggtcgttgttgtc

SEQ ID NO: 418 - DNA, 1456 bp, Triticum aestivum
agccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcatgccctccttgctttcactcttggagtgaagcagatgatctgctgctgtaacaagatggacgccaccactcccaagtactcaaaggcccgttatgaggaaattgtcaaggaagtctcttcgtacctgaagaaggtcggctacaaccctgacaaggttccctttgttcccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgtacctttggtcccactggtctgacaactgaggtcaagtccgttgagatgcaccacgagtccctcctggaggcgcttcctggtgacaatgtcggcttcaacgtgaagaacgttgctgttaaggatctgaagcgtgggtttgttgcatccaactccaaggatgaccctgccaaggaggcagccaacttcacctcccaggtcatcatcatgaaccaccctggtcagattggcaacggctatgccccagtgctggactgccacacctcgcacattgctgtcaagtttgctgagctggtgaccaagatcgacaggcgatctggtaaggagctggaggccctgcccaagttcctcaagaatggtgatgctggcatagtgaagatgattcccaccaagcccatggttgtggagacctttgctacttaccctcctcttggtcgttttgctgtccgggacatgaggcaaactgtggctgttggtgtcatcaagggtgtggagaagaaggacccaaccggcgccaaggtgaccaaggctgccatcaagaagaaatgaggcgtttacctgaatccatctatgtctgcttttgagatctgtagtagtttagtgcctattaagttttgctactgttagcgccgtgtgatatgcgccctgttgatgtgtc

SEQ ID NO: 419 - DNA, 1662 bp, Triticum aestivum
ctcgtcctctcggtcccctctccttccttcgagtttgcttcagccatgggtaaggagaagactcacatcaacatcgtggtcattggccacgtcgactctggcaagtcgacgaccactggccacctgatctacaagcttggaggcattgacaagcgtgtgatcgagaggttcgagaaggaagccgctgaaatgaacaagaggtctttcaagtacgcctgggtgcttgacaagctcaaggccgagcgtgagagaggtatcaccatcgatattgccctctggaagtttgagacaaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtgaagcagatgatctgctgctgcaacaagatggacgccaccactcccaagtactcgaaggctcgttacgaagaaattgttaaggaggtctcttcgtacctgaagaaggtcggctacaaccctgacaaggttcccttcgtccccatctctgggttcgagggtgacaacatgattgagaggtccaccaaccttgactggtacaagggcccaaccctgcttgaggcacttgaccagatcaacgagcccaagaggccctcagacaagcccctccgtcttcccctacaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggtaaggagatagaggccgcgcccaagttcctcaagaatggtgatgctggcatagtgaagatgattcccaccaagcccatggttgtggagacctttgccacttaccctcctcttggtcgttttgctgtccgtgacatgaggcagactgtggctgttggtgtcatcaagggcgtcgagaagaaggacccaaccggggccaaggtgaccaaggctgccatcaagaagaagtaattcgacattgatatccaaatcactgttcagacaccaagcagtttttagtattggctgagttttgttaagggcattgttcgtactggtatattttagctgttcagctgttagcgctgcatatcgtgcccttggtggtcgtctgtcttgtgccttttacatactgtgtcctaatgtaagcttcggtgaaacctggatgttatgagacctggttgtgtcttttaatactagcttgttgcattttatctgtgtagatgctttatctagtgcattttt

SEQ ID NO: 420 - DNA, 1549 bp, Secale cereale
cgccgccgcctcctctcctcggctccttctccttcattcgagtttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcaaatgatctgctgctgcaacaagatggatgccaccactcccaagtactcgaaggcccgttatgaggaaattagtcaaggaagtctcttcgtacctgagaaggtcggctacaaccctgacaaggttcccttcgtccccatctctgggtttgagggtgacaacatgattgagaggtccaccaaccttgactggtacaagggccctacccttctcgaggctcttgaccagatcaacgagcccaagaggccctcagacaagccctgcgtctccccttcaggatgtttacaagattggtggcattggaactgtgcctgttggacgtgttgagactggtgtcatcaagcctggtatggttgtaacctttggtcccactggtctgacaactgaagtcaagtctgttgagatgcaccacgagtctctcctggaggcgcttcctggtgacaatgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgatgctggtatcgtgaagatgattcccaccaagcccatggttgtggagaccttcgccacctaccctcctcttggccgcttcgctgtgcgtgacatgagacaaacagttgctgttggtgtcatcaagggcgtggagaagaaggaccccaccggtgccaaggttaccaaggccgccatcaagaagaaataggcttctatctagcagaaggttttgttcatggtcattgctttcgttgcttcagactcttatcccgggcgagcaatgatcctgtctgtcgtttaattactgtatttctattcctgcttaaactcctgtgccctgagactgatttgttgtgaaatgcaag

SEQ ID NO: 421 - DNA, 1390 bp, Secale cereale
ctcggctccttctccttcattcgagtttcagccatgggtaaggagaagactcacatcaacattgtggtcattggccatgttgactctggcaagtcgaccaccactggccatctgatctacaagcttggaggtatcgacaagcgtgtgatcgagaggtttgagaaggaagccgctgagatgaacaagaggtcgttcaagtacgcctgggtgcttgacaagctgaaggctgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcaaatgatctgctgctgcaacaagatggatgccaccactcccaagtactcgaaggcccgttatgaggaaattgtcaaggaagtctcttcgtacctgaagaaggtcggctacaaccctgacaaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacgtttggtcccactggtctgacaactgaggtcaagtctgttgagatgcaccacgagtccctcctggaggcgcttcctggtgacaacgttggcttcaacgtcaagaatgttgctgtgaaggatctgaagcgtgggtttgttgcatccactccaaggatgaccctgccaaggggccgccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgatgctggtatcgtgaagatgattcccaccaagcccatggttgtggagaccttcgccacctaccctcctcttggccgcttcgctgtgcgtgacatgagacaaacagttgctgttggtgtcatcgaagggcgtggagaagaaggaccccacggtgccaaggttaccaaggccgccatcaagaagaaataggcttctatctagcag

SEQ ID NO: 422 - DNA, 1676 bp, Triticum aestivum
gccgccgcctcctcctctcggttccctctccttccttcgagagcttcagccatgggtaaggagaagactcacatcaacatcgtggtcattggccacgtcgactctggcaagtcgacgaccactggccacctgatctataagcttggaggcattgacaagcgtgtgatcgagaggttcgagaaggaagccgctgaaatgaacaagaggtctttcaagtacgcctgggtgcttgacaagctcaaggccgagcgtgagaggggtatcaccatcgatattgccctctggaagttcgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgctctccttgctttcactcttggagtgaagcagatgatctgctgctgcaacaagatggacgccaccactcccaagtactcaaaggcgcgttacgaagaaattgtgaaggaggtctcttcctacctgaagaaggtcggctacaaccctgaaaaggttcccttcgtccccatctctgggttcgagggtgacaacatgattgagaggtccaccaaccttgactggtacaagggcccaaccctgcttgaggcgcttgaccagatcaatgagcccaagaggccctcagacaagcccctccgtcttcccctccaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggtaaggagatagaggccgcgcccaagttcctcaagaatggtgatgctggcatagtgaagatgattcccaccaagcccatggttgtggagacctttgccacttatcctcctcttggtcgttttgctgtccgtgacatgaggcagactgtggctgttggtgtcatcaagggcgtcgagaagaaggacccaaccggggccaaggtgaccaaggctgccatcaagaagaagtaattcgacattgatatccaaatcactgttcagacaccaagcagtttttagtattggctgagttttgttaagggcattgttcgtactggtatattttagctgttcagctgttagcgctgcatatcgtgcccttggtggtcgtctgtcttgtgccttttacatactgtgtcctaatgtaagcttcggtgaaacctggatgttatgagacctggttgtgtcttttaatactagcttgttgcattttatctgtgtaggtgctttatctagtgcatttttgaaagaca

SEQ ID NO: 423 - DNA, 1646 bp, Triticum aestivum
cacgcgtcggccgccgcctcgctcggttccttctccttcctccgagcttcagccatgggcaaggagaagactcacatcaacatcgtggtcattggccatgtcgactctggcaagtcgaccaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgacgcccctggtcaccgtgacttcatcaagaacatgattactggtacctcccaggctgattgtgctgtgctcatcattgactctaccactggtggttttgaggctggtatctccaaggatggccagacccgtgagcacgccctccttgctttcactcttggagtgaagcagatgatctgctgctgcaacaagatggacgccaccactcccaagtactcaaaggcccgttacgaggaaattgtcaaggaagtctcatcgtacctgaagaaggttggctacaaccctgagaaggttccctttgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaagcctggtatggttgttacctttggccccactggtctgacaactgaggtcaagtccgttgagatgcaccacgagtccctcctggaggcgcttcctggtgacaatgtcggcttcaacgtgaagaacgttgctgtcaaggatctgaagcgtgggtttgttgcatccaactctaaggatgaccctgccaaggaggcagccaacttcacctctcaggtcatcatcatgaaccaccctggtcagatcggcaacggctacgccccagtgctggactgccacacctcccacattgctgtcaagtttgctgagctggtgaccaagattgacaggcgatctggtaaggagattgaggctgcgcccaagttcctgaagaacggtgacgctggtattgtgaagatgattcccaccaagcccatggttgtggagaccttcgccacctacccacctcttggccgcttcgctgtgcgtgacatgagacaaacggttgctgttggtgtcatcaagggcgttgagaagaaggaccccaccggcgccaaggttaccaaggctgccatcaagaagaaatgagtgctctggtgtctgccatcgagttatctagcagaagttttagtgtcaagtcttttttggagaatcttagtgtatgttaagtggtgttcctgggcgttgttgcacttccgactcctgcacctgtgtgcgagctatgatgtgtcgtttaaatactctatttcgattccattattgtgctcttatcccatttgtggttttgtctgcctgtgttgaatgctcttaatagatggatatgattacctgctaaa

SEQ ID NO: 424 - DNA, 1711 bp, Triticum aestivum
gcgtggtcgcggccgaggtcgcccatatatagagccacccctctcgccctaaccccttcgtaccattcccctcgcccgccgccgccgcctcctcctcctcctctcggctccttctccttccttccagtttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtccttcaagtacgcctgggtgcttgacaagctgaaggccgagcgcgagaggggtatcaccattgatattgccctgtggaagtttgagaccaccaagtactactgcaccgtcattgatgcccctggtcaccgtgacttcatcaagaacatgatcaccggtacctcccaggctgactgtgctgtgctcatcatcgactccaccactggtggttttgaggctggtatctcgaaggacggccagacccgtgagcacgccctccttgctttcactcttggagtgaagcagatgatctgctgctgcaacaagatggatgccaccactcccaagtactcgaaggcccgttatgaggaaatcgtcaaggaagtctcttcgtacctgaagaaggtcggctacaaccctgagaaggttcccttcgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaagcctggtatggttgttacctttggccccactggtctgacaactgaggtcaagtccgttgagatgcaccacgagtccctcctggaggcgcttcctggtgacaatgtcggcttcaacgtgaagaacgttgctgtcaaggatctgaagcgtgggtttgttgcatccaactctaaggatgaccctgccaaggaggcagccaacttcacctctcaggtcatcatcatgaaccaccctggtcagatcggcaacggctacgccccagtgctggactgccacacctcccacattgctgtcaagtttgctgagctggtgaccaagattgacaggcgatctggtaaggagattgaggctgcgcccaagttcctgaagaacggtgacgctggtattgtgaagatgattcccaccaagcccatggttgtggagaccttcgccacctacccacctcttggccgcttcgctgtgcgtgacatgagacaaacggttgctgttggtgtcatcaagggcgttgagaagaaggaccccaccggcgccaaggttaccaaggctgccatcaagaagaaatgagtgctctggtgtctgccatcgagttatctagcagaagttttagtgtcaagtcttttttggagaatcttagtgtatgttaagtggtgttcctgggcgttgttgcacttccgactcctgcacctgtgtgcgagctatgatgtgtcgtttaaatactctatttcgattccattattgtgctcttatcccatttgtggttttgtctgcctgtgttgaatgctcttaatagatggat

SEQ ID NO: 425 - DNA, 1623 bp, Triticum aestivum
cagccatgggcaaggagaagactcacatcaacatcgtggtcattggccatgtcgactctggcaagtcgaccaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgacgcccctggtcaccgtgacttcatcaagaacatgattactggtacctcccaggctgattgtgctgtgctcatcattgactctaccactggtggttttgaggctggtatctccaaggatggccagacccgtgagcacgccctccttgctttcactcttggagtgaagcagatgatctgctgctgcaacaagatggacgccaccactcccaagtactcaaaggcccgttacgaggaaattgtcaaggaagtctcatcgtacctgaagaaggttggctacaaccctgagaaggttccctttgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaagcctggtatggttgttacctttggccccactggtctgacaactgaggtcaagtctgttgagatgcaccacgagtccctcctggaggcgcttcctggtgacaatgtcggcttcaacgtgaagaacgttgctgtcaaggatctgaagcgtgggtttgttgcatccaactccaaggatgaccctgccaaggaggcagccaacttcacctctcaggtcatcatcatgaaccaccctggtcagatcggcaacggctacgccccagtgctggactgccacacctcccacattgctgtcaagtttgctgagctggtgaccaagattgacaggcgatctggtaaggagattgaggctgcgcccaagttcctgaagaacggtgacgctggtatcgtgaagatgattcccaccaagcccatggttgtggagacctttgccacctaccctcctcttggccgcttcgctgtgcgtgacatgagacaaacggttgctgttggtgtcatcaagggtgtggagaagaaggaccccaccggcgccaaggttaccaaggctgccatcaagaagaaataggcgcgctatcttgcagaaggattttgttcacggtcattgcttttgttgcttcagactcttatcccgagcgagcaatgatctgtctgtcgtttaattactgtatttctattcctgcttcggctaaactcctgtgcccctgagactgatttgttgtgaaatgcaagttattagattgcaacttgttagcttgtttttctgcttcttttgccaaatggttgcctgttgttctttttatagaactttagtttgcatctgttagtattgtggattcttt

SEQ ID NO: 426 - DNA, 1396 bp, Triticum aestivum
ccgaccgccgccgccgcctcctcctctcggttccctctccttccttcgagtttgcttcagccatgggtaaggagaagactcacatcaacatcgtggtcattggccacgtcgactctggcaagtcgacgaccactggccacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagtttgagaccaccaagtactactgcaccgtcattgatgcccctggtcaccgtgacttcatcaagaacatgatcaccggtacctcccaggctgactgtgctgttctcatcattgactccaccactggtggttttgaggctggtatctccaaggatggccagacacgtgagcacgccctccttgctttcactcttggagtgaagcagatgatctgctgctgcaacaagatggacgccaccactcccaagtactcgaaggctcgttacgaagaaattgttaaggaggtctcttcgtacctgaagaaggtcggctacaaccctgacaaggttcccttcgtccccatctctgggtttgagggtgacaacatgattgagaggtccaccaaccttgactggtacaagggcccaaccctgcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaatgttggcttcaatgtcaagaacgttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcacacattgctgtcaagtttgctgagctggtgaccaagatcgacaggcggtctggtaaggagctggaggccctgcccaagttcctcaagaatggtgatgctggcatagtgaagatgattcccaccaagcccatggttgtggagacctttgccacttaccctcctcttggtcgttttgctgtccgtgacatgaggcagactgtggctgttggtgtcatcaagggcgtggagaagaaggacccaaccggggccaaggtgaccaaggctgccatcaa

SEQ ID NO: 427 - DNA, 1537 bp, Secale cereale
ggcaagtcgggtaagtcaaaccgacgagacgtacactggggcgtccccgactccccaccccgtccgcgccgcaggctctcactcctcttcgtccccggacagccaggtagttatcagccatgggtaaggagaagatccacatcagcattgtggtcattggccatgtcgactctggcaagtcaaccacgactggtcacctcatctacaagcttggaggcattgacaagcgtgtgatcgagaggttcgagaaggaagccgctgagatgaacaagaggtcgttcaagtacgcctgggtgcttgacaagctcaaggctgagcgtgagagaggtatcaccattgatattgctctgtggaagttcgagaccaccaagtactcctgcaccgtcattgatgctcctggtcaccgtgatttcatcaagaacatgatcactggtacctcccaggctgattgtgctgtgcttatcattgactccaccactggtggttttgaggctggtatctccaaggatggccagacccgtgagcatgctctccttgctttcactcttggtgtgaagcagatgatctgctgctgcaacaagatggacgccaccactcccaagtactcaaagtcccgttatgaagaaattgttaaggaagtctcttcatacctgaagaaggtcggttacaaccctgacaaggttcccttcgtccccatctctgggttcgagggtgacaacatgattgagaggtccaccaaccttgactggtacaagggccctaccctgcttgaggcgcttgaccagatcaacgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgttggcttcaacgtcaagaatgttgctgtgaaggatctgaagcgtgggtttgttgcatccaactccaaggatgaccctgccaaggaggccgccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggtgccaaggttaccaaggccgccatcaagaagaaatgagtgctcttgtctcggccatcgagttatctagcagaagttttagtgtcaagtctttttggagaatcttagtgtat

SEQ ID NO: 428 - DNA, 1595 bp, Triticum aestivum
ttcgggttgggtagtttacgtctacccaccagccatgggtaaggagaagactcacatcaacatcgtggtcattggccacgtcgactctggtaagtcgacgaccactggccacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggatttgaggctggtatctccaaggatggccagacacgtgagcatgctctccttgctttcactcttggagtgaagcagatgatctgctgctgcaacaagatggacgccaccactcccaagtactcaaaggcacgttacgaagaaattgttaaggaggtctcttcctacctgaagaaggtcggctacaaccctgaaaaggttcccttcgtccccatctctgggttcgagggtgacaacatgattgagaggtccaccaaccttgactggtacaagggcccaaccctgcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgttacctttggtcccagtggtctgacaactgaggtcaagtctgttgagatgcaccacgagtctctcctggaggcgcttcctggtgacaacgtgggcttcaacgtcaagaatgttgccgtgaaggatctgaagcgtggttttgttgcatccaactccaaggatgaccctgccaaggaggcagccaacttcacctcccaggtcattatcatgaaccaccctggtcagattggcaacggctacgccccagtgctggactgccacacctcacacattgctgtcaagtttgctgagctggtgaccaagattgacaggcgatctggtaaggagatagaggccgcgcccaagttcctcaagaacggcgatgctggcatagtgaagatgattcccaccaagcccatggttgtggagacctttgccacttaccctcctcttggtcgttttgctgtccgtgacatgaggcaaactgtggctgttggtgtcatcaagggtgtggagaagaaggacccaactggcgccaaggtgaccaaggctgccatcaagaagaaatgaggcgtttacctgaatccgtctatgtctgctttttgagatctctagtagtttagtgcctattaagttttgctactgttagcgccgtgtgatatgcgccctgttgatgtgtcatttgagtactgtcgttaatttcggcttttgacaaaacatggaagcttctgagactactcatttttatcctctgctttggaatgttaggctgctacttttagtcata

SEQ ID NO: 429 - DNA, 1558 bp, Avena sativa
cttcccacccccttccgccgccacctgctcctctcggtccgttcttcatccttcgagtttgttagctgacacttcagccatgggtaaggagaagacgcacattaacatcgtggtcattggccatgtcgactctggcaagtcgaccaccactggccacctgatttacaagcttggaggaattgacaagcgtgtgatcgagaggttcgagaaggaagctgctgagatgaacaagaggtcgttcaagtacgcgtgggtgcttgacaagctgaaggccgagcgtgagagaggtatcaccattgatattgctctctggaagtttgagacaacgaaatactactgcacggtcattgacgcccctggtcaccgtgacttcatcaagaacatgatcaccggtacctcccaggctgactgtgctgtcctcatcattgactccaccactggtggatttgaggctggtatctccaaggatggccagactcgtgagcatgctctccttgctttcacccttggagtcaagcagatgatctgctgctgcaacaagatggatgccaccactcccaagtattcaaaggcacgttatgaagaaattgtgaaggaagtctcttcttacctgaagaaggtcggctacaaccctgacaaggtgccatttgtccccatctctgggtttgagggtgacaacatgattgagaggtcgaccaaccttgactggtacaagggccccaccttgcttgaggcgctcgaccagatcaacgagcccaagagaccctcagacaagcccctccgtcttcccctccaggatgtttacaagattggtggcattggaactgtgcctgttggccgtgttgagacaggtgtcatcaagcctggtatggttgtgacctttggccccactggtctcaccactgaggtaaagtctgttgagatgcaccatgagtctctcctggaggcgctccctggtgacaatgttggcttcaacgtcaagaatgttgccgtaaaggatctcaagcgtgggttcgtggcatccaactccaaggatgaccctgccaaggaggcggccaacttcacctcccaggtcatcatcatgaaccaccccggtcagatcggcaacggctatgccccagtgctggactgccacacgtctcacattgctgtgaagtttgctgagctggtgaccaagatcgacagacgatctggcaaggagattgagaaggagcccaagttcctgaagaatggtgatgctggtatagtgaagatgattcccaccaagcccatggttgtggagaccttctctacctaccctcctcttggtcgtttcgccgtgcgtgacatgagacaaacggttgctgttggtgtcatcaagggcgtggagaagaaggaccccaccggtgccaaggttaccaaggctgctgccaagaagaaatgagtggttcagtttgtgtgatatctagcttaagttttagtattaagttttgttcgtgcgcattgctcttattgctgaagactgtctaaacctgcaagcaatgatctggtctgttgtttaaataccgtattcctattt

SEQ ID NO: 430 - DNA, 1359 bp, Secale cereale
ctcggctccttctccttcattcgagtttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcaaatgatctgctgctgcaacaagatggatgccaccactcccaagtactcgaaggcccgttatgaggaaattgtcaaggaagtctcttcctacctgaagaaggtcggctacaaccctgacaaggttcccttcgtccccatctctgggtttgagggtgacaacatgattgagaggtccaccaaccttgactggtacaagggccctacccttctcgaggctcttgaccagatcaacgagcccaagaggccctcagacaagcccctgcgtcttccccttcaggatgtttacaagattggtggcattggaactgtgcctgttggacgtgttgagactggtgtcatcaagcctggtatggttgtaacctttggtcccactggtctgacaactgaagtcaagtctgttgagatgcaccacgagtctctcctggaggcgcttcctggtgacaatgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggtgccaaggttaccaaggcc

SEQ ID NO: 431 - DNA, 1596 bp, Avena sativa
gtccccctccgcgccgccgccgtctccttccaccaccgagtttgctagataaagagttcaaccatgggcaaggagaagactcacatcaacattgtggtcattggccatgtcgactctggcaagtcgaccaccactggtcatctgatctacaagcttggaggtattgacaagcgtgtgatcgagaggtttgagaaggaagccgctgagatgaacaagaggtcattcaagtatgcgtgggtgcttgacaagctcaaggctgagcgtgagaggggtatcaccattgatattgccttgtggaagttcgagaccaccaaatactactgcacggtcattgatgcccctggacaccgtgacttcatcaagaacatgattactggtacctcacaggctgactgtgctgtcctcatcattgactccaccactggtggttttgaggctggtatctccaaggatggccagacccgtgagcacgcactccttgctttcactcttggagtcaagcagatgatctgctgctgtaacaagatggatgccaccactcccaagtactcaaagggccgttatgaggaaattgttaaggaggtctcttcatacctcaagaaggtcggttacaaccctgacaaggtgccgtttgtccccatctctggatttgagggtgataacatgattgagaggtccaccaaccttgactggtacaagggccctaccctgcttgaggcgcttgaccagatcaacgagcccaagagaccctcagacaagcccctgcgtcttcccctccaggatgtttacaagattggtggcattggaactgtgcctgttggccgtgttgagacaggtgtcatcaagcctggtatggttgtgacctttggtcctactggtctgaccactgaggtaaaatctgttgagatgcaccacgagtctctcctggaggcgctccctggtgacaatgttggcttcaacgtcaagaatgttgccgtgaaggatctcaagcgtgggtttgtggcatccaactccaaggatgacccagccaaggaggcggccaacttcacctcccaggtcatcatcatgaaccaccctggtcagatcggcaacggctatgccccagtgctggactgccacacgtctcacattgctgtgaagtttgctgagctggtgaccaagattgacagacgatctggcaaggagattgagaaggagcccaagttcctgaagaacggtgatgctggtatagtgaagatgattcccaccaagcccatggttgtggagaccttctctacctaccctcctcttggtcggttcgccgtgcgtgacatgagacaaacggttgctgttggtgtcatcaagggcgtggagaagaaggaccccaccggtgccaaggttaccaaggctgctgccaagaagaaatgagtggttcagtttgtgtgatatctagcttaagttttagtatattaagttttgttcgtgcgcattgctcttattgctgaagactgtctaaacctgctagcaatgatctggtgtgtcgtttaaatactgtattcctatttgatgttcggctaaagtctaaagtctgagttgtggaatgcaagtctttaaatt

SEQ ID NO: 432 - DNA, 1738 bp, Avena sativa
ctccccctccccgccgcctccgccacctcctcctctcggtttccttctccttccgtcgagttcagccatgggtaaggagaagactcacatcaacattgtggtcattggccatgtcgactctggcaagtcgaccaccactggccatctcatctacaagcttggaggtattgacaagcgtgtgatcgagaggttcgagaaggaagccgctgagatgaacaagaggtcattcaagtacgcgtgggtgcttgacaagctcaaggctgagcgtgagaggggtatcaccattgatattgccctctggaagttcgagaccaccaaatactactgcactgtcattgatgcccctggacaccgtgacttcatcaagaacatgattactggtacctcacaggctgactgtgctgtcctcatcattgactccaccactggtggttttgaggctggtatctccaaggatggccagacccgtgagcatgcactccttgcgttcacacttggagtgaagcagatgatctgctgctgtaacaagatggatgccaccactcccaagtactcaaagggccgttatgaggaaattgttaaggaggtctcttcatacctcaagaaggtcggttacaaccctgacaaggtgccgtttgtccccatctctggatttgagggtgataacatgattgagaggtccaccaaccttgactggtacaagggccctaccctgcttgaggcgctcgaccagatcaatgagcccaagagaccttcagacaagcccctgcgtcttcccctccaggatgtttacaagattggtggcattggaactgtgcctgttggccgtgttgagacaggtgtcatcaagcctggtatggttgtgacctttggtcccactggcctgaccactgaggtgaaatctgttgagatgcaccacgagtctctcctggaggcgctcccaggtgacaacgttggcttcaacgtcaagaatgttgctgtgaaggatctcaagcgtgggtttgtggcatccaactccaaggatgaccctgccaaggaggctgccaacttcacctcccaggtcatcatcatgaaccaccctggtcagatcggcaacggctacgccccagtgctggactgccacacatctcacattgctgtgaagtttgctgagctggtgaccaagattgacagacgatctggcaaggagattgagaaggagcccaagttcctgaagaacggtgatgctggtatagtgaagatgattcccaccaagcccatggttgtggagaccttctctacctaccctcctcttggtcgttttgccgtgcgtgacatgagacaaacggttgctgttggtgtcatcaagggcgtggagaagaaggaccccaccggtgccaaggttaccaaggctgctgccaagaagaaatgagcggcttagtgtctgacgcctagcagcagttttagttaagtattctttggtgaatcttagtatatcctatgttttgatcttggttgtgttgctcgtattgcttgagactctgcatgatcctggttgtcgtttaagttctgaatttctgttactattctgcaaaacttgtaatatgtctcttgatgatttgtggcatctttggtgggagtgcaatagaatgttaggtgcatctgatggttctcttgtttcagtgactctgcaatcatgcctcttatttcaactgtcggcctttgaggtagtattgttattggtttcacaaaaaaaaaa

SEQ ID NO: 433 - DNA, 1840 bp, Avena sativa
agacccctgccactcctcgccgccgccacctcctcctggttccctctcctccttccttcgagtttgttagctgacacttcagccatgggtaaggagaagactcacattaacattgtggtcattggccacgtcgactctggcaagtcgaccactactggccacctgatttacaagcttggaggaattgacaagcgtgtgattgagaggttcgagaaggaagctgctgagatgaacaagaggtcattcaagtacgcgtgggtgcttgacaagctgaaggccgagcgtgagagaggtatcaccatcgatatcgctctctggaagtttgagacaacgaagtactactgcacggtcattgatgcacctggtcaccgtgacttcatcaagaacatgatcaccggtacctcccaggctgactgtgctgttctcatcattgactccaccactggtggatttgaggctggtatctccaaggatggccagactcgtgagcatgctctccttgctttcacccttggagtcaagcagatgatctgctgttgcaacaagatggatgccaccactcccaagtactcgaagggacgttatgaagaaattgtgaaggaagtctcttcttacctgaagaaggttggctacaaccctgacaaggtgccatttgtccccatctctgggtttgagggtgacaacatgattgagaggtcgaccaaccttgactggtacaagggccccaccttgcttgaggcgctcgaccagatcaacgagcccaaaaggccctcagacaagcccctccgtcttcctctccaggatgtttacaagattggtggcattggaactgtgcctgttggccgtgttgagaccggtgtcatcaagcctggcatggttgtcacctttggtccaactggtctgaccactgaggttaagtctgttgagatgcaccacgagtctctcctggaggcgctccctggtgacaatgtggggttcaatgtcaagaatgttgctgtgaaggatctcaagcgtgggtttgtggcgtccaactccaaggatgaccctgccaaggaggctgccaacttcacctcccaggtcatcatcatgaaccaccctggtcagatcggcaacggctatgccccagtgctggactgccacacgtcacacattgccgtcaagttcgctgagctggtgaccaagattgacagacgatctggcaaggagattgagaaagagcccaagttcctgaagaatggtgatgctgggatagtgaagatgattcccaccaagcccatggttgtggagaccttctctacttaccctcctcttggtcgctttgctgttcgtgacatgagacaaacggttgctgttggtgtcatcaagggcgtagagaagaaggaccccaccggtgccaaggtgaccaaggctgctgccaagaagaaatgagggatcttgtctttgatcctttcagttaatatatctagctctcttttttgttacctgtcgtgatgcggtgaagagtcgttcagcatttagctctttctgcaatgtgctcttatcgtttaaaacactgtcgtgttatttgggtttcctggtaacctggaggatgtgtaagactcgtttgtgtttatcggctgtggaatgtggtttggtagttatgcatgtcaaattgtttcatcgttctgcttgctttcattgtacctctctgcccagtttggtctggcttagtatgtctgggattaattccttggctagtcaagcttttacagcgatttgtttgcctatggtagcaatgcttcatatatatgttaacatgctgaatttgcaatccattttgaggcaacaagtttgttctagt

SEQ ID NO: 434 - DNA, 1771 bp, Brachypodium distachyon
tcggtgcctgctgtcccactcgttcttgtgcttttccatctgactacccatctatttgtagttctgtatcttatataattttgttgacatgttgatggtgacgatatactgttttctaatccctgttacttcgatgcagtttcagccatgggtaaggagaagactcacatcaacatcgtggtcattggccatgtcgactctggcaagtcgaccaccactggccacctgatctacaagcttggaggtattgacaagcgtgtgatcgagaggttcgagaaggaggctgccgagatgaacaagaggtcattcaagtacgcgtgggtgcttgacaagctgaaggctgagcgtgagagaggtatcaccatcgatattgccttgtggaagttcgagaccaccaagtactactgcaccgtcattgatgcccctggacaccgtgacttcatcaagaacatgattaccggtacctcccaggctgactgtgccgtgcttatcattgactccacgactggaggttttgaggctggtatctccaaggatggccagacccgtgagcatgccctccttgctttcactcttggagtgaagcagatgatctgctgctgcaacaagatggatgccaccactcccaagtactcgaaggcccgttatgatgaaattgttaaggaagtctcttcctacctcaagaaggtcggctacaaccctgacaaggtccccttcgtccccatctctggttttgagggtgacaacatgattgagaggtccaccaaccttgactggtacaagggccctaccttgcttgaggcacttgaccagatcaatgagcccaagaggccctcggacaagcccctgcgtcttcccctccaggacgtgtacaagattggtggcattggaactgtgcctgttggccgtgttgagactggtgtcatcaagcctggtatgattgttaccttcggtcctactggtcttaccactgaggtcaagtccgttgagatgcaccatgaggctctccaggaggcccttcctggtgacaatgttggcttcaacgtcaagaacgttgctgtgaaggatctcaagcgtgggtttgttgcatccaactccaaggatgaccctgccaaggaggctgccaacttcacctcccaggtcatcatcatgaaccaccctggtcagattggcaacggctacgccccagtgctggactgccacacctcccacattgctgtgaagtttgccgagctggtgaccaagatcgacaggcgatctggtaaggagctggagaaggagcccaagttcttgaagaacggtgatgctggtatcgtgaagatgattcccaccaagcccatggttgtggagaccttcgccatgtaccctcctcttggtcgttttgctgtgcgtgacatgagacaaacagttgctgttggtgtcatcaagggtgtggagaagaaggacccaaccggcgccaaggtcaccaaggcggctgccaagaagaaatgatttgttctgtgttggggattgagatgtctggctgcagttttagtgtttactaagttttgtctatgtgcattgctcgtattgctgagactcttgaaactatgtaagcaatgttcatgtctgtcgtttaaatactgtattcctatttcggttcggttaaaacctgtgtgctatgatgcttgtgtccttttaacttctcagggatctgattgcttagattgaacttagttaactcatgttctgtttccttgatttcttcgcaatttgtttttgttctgctatt

SEQ ID NO: 435 - DNA, 1765 bp, Brachypodium distachyon
cgtctcggccaatataaggggccattccgcacgtccaaacccctttccctcacagttcccctctccccgccgccgcccctcgtcctctgtgttccttctccgagtttcagccatgggtaaggagaagactcacatcaacatcgtggtcattggccatgtcgactctggcaagtcgaccaccactggccacctgatctacaagcttggaggtattgacaagcgtgtgatcgagaggttcgagaaggaggctgccgagatgaacaagaggtcattcaagtacgcgtgggtgcttgacaagctgaaggctgagcgtgagagaggtatcaccatcgatattgccttgtggaagttcgagaccaccaagtactactgcaccgtcattgatgcccctggacaccgtgacttcatcaagaacatgattaccggtacctcccaggctgactgtgccgtgcttatcattgactccacgactggaggttttgaggctggtatctccaaggatggccagacccgtgagcatgccctccttgctttcactcttggagtgaagcagatgatctgctgctgcaacaagatggatgccaccactcccaagtactcgaaggcccgttatgatgaaattgttaaggaagtctcttcctacctcaagaaggtcggctacaaccctgacaaggtccccttcgtccccatctctggttttgagggtgacaacatgattgagaggtccaccaaccttgactggtacaagggccctaccttgcttgaggcacttgaccagatcaatgagcccaagaggccctcggacaagcccctgcgtcttcccctccaggacgtgtacaagattggtggcattggaactgtgcctgttggccgtgttgagactggtgtcatcaagcctggtatgattgttaccttcggtcctactggtcttaccactgaggtcaagtccgttgagatgcaccatgaggctctccaggaggcccttcctggtgacaatgttggcttcaacgtcaagaacgttgctgtgaaggatctcaagcgtgggtttgttgcatccaactccaaggatgaccctgccaaggaggctgccaacttcacctcccaggtcatcatcatgaaccaccctggtcagattggcaacggctacgccccagtgctggactgccacacctcccacattgctgtgaagtttgccgagctggtgaccaagatcgacaggcgatctggtaaggagctggagaaggagcccaagttcttgaagaacggtgatgctggtatcgtgaagatgattcccaccaagcccatggttgtggagaccttcgccatgtaccctcctcttggtcgttttgctgtgcgtgacatgagacaaacagttgctgttggtgtcataaagggtgtggagaagaaggacccaaccggcgccaaggtcaccaaggctgctgccaagaagaagtgagtagttccctgtggtcgattgagatatctgtctgcagttttagtgttcgttaagttttctatgtgcattgctcttattgctgactctcgaaactatgcaagcagtgtgcatgcctgtcgtttaaatgctgtatttctatttctgttctgtcaaaacctgtgtgctctgaggctgttgcctcattgacattttgggaatgcaagttcgttggttgcaaattattttctgttttgtcttagtgttatctgctgcagcttgcagactattctgcatagttcgtcttcaactatttaggacgaactttacttt

SEQ ID NO: 436 - DNA, 1683 bp, Brachypodium distachyon
cttaagccccagcctctccattcccctctccctctcgccgccgccgtctccttctcctactcccttcgagtttcagccatgggtaaggagaaaactcacatcaacatcgtggtcattggccatgtcgactctggcaagtcgaccaccactggccacctgatctacaagcttggaggtattgacaagcgtgtgatcgagaggttcgagaaggaggctgccgagatgaacaagaggtcattcaagtacgcgtgggtgcttgacaagctgaaggctgagcgtgagagaggtatcaccatcgatattgccttgtggaagttcgagaccaccaagtactactgcaccgtcattgatgcccctggtcaccgtgacttcatcaagaacatgattaccggtacctcccaggctgactgtgccgtgcttatcattgactccacgactggaggttttgaggctggtatctccaaggatggccagacccgtgagcatgccctccttgctttcactcttggagtgaagcagatgatctgctgctgcaacaagatggatgccaccactcccaagtactcgaaggcccgttatgatgaaattgttaaggaagtctcttcctacctcaagaaggtcggctacaaccctgacaaggtccccttcgtccccatctctggttttgagggtgacaacatgattgagaggtccaccaaccttgactggtacaagggccctaccttgcttgaggcacttgaccagatcaatgagcccaagaggccctcagacaagcccctgcgtcttcccctccaggacgtgtacaagattggtggcattggaactgtgcctgttggccgtgttgagactggtgtcatcaagcctggtatgattgttaccttcggtcctactggtcttaccactgaggtcaagtccgttgagatgcaccatgaggctctccaggaggcccttcctggtgacaatgttggcttcaacgtcaagaacgttgctgtgaaggatctcaagcgtgggtttgttgcatccaactccaaggatgaccctgccaaggaggctgccaacttcacctcccaggtcatcatcatgaaccaccctggtcagattggcaacggctacgccccagtgctggactgccacacctcccacattgctgtgaagtttgccgagctggtgaccaagatcgacaggcgatctggtaaggagctggagaaggagcccaagttcttgaagaacggtgatgctggtatcgtgaagatgattcccaccaagcccatggttgtggagaccttcgccatgtaccctcctcttggtcgttttgctgtgcgtgacatgagacaaacagttgctgttggtgtcatcaagggtgtggagaagaaggacccaaccggcgccaaggtcaccaaggcggctgccaagaagaaatgatttgttctgtgttggggattgagatgtctggctgcagttttagtgtttactaagttttgtctatgtgcattgctcgtattgctgagactcttgaaactatgtaagcaatgttcatgtctgtcgtttaaatactgtattcctatttcggttcggttaaaacctgtgtgctatgatgcttgtgtccttttaacttctcagggatctgattgcttagattgaacttagttaactcatgttctgtttccttgatttcttcgcaat

SEQ ID NO: 437 - DNA, 1833 bp, Brachypodium distachyon
gcgccaccccgctactccgaccccttcctttcacagttcccatctcgccgccgccgcatccgccccctctctcctccttctcctccgagtttcagccatgggtaaggagaagactcacatcaacatcgtggtcattggccatgtcgactctggcaagtcgaccaccactggccacctgatctacaagcttggaggtattgacaagcgtgtgatcgagaggttcgagaaggaggctgccgagatgaacaagaggtcattcaagtacgcgtgggtgcttgacaagctcaaggcagagcgtgagagaggtatcaccatcgatattgccttgtggaagtttgagaccaccaagtactactgcacagtcatcgatgcccctggacaccgtgacttcatcaagaacatgattacgggtacctcccaggctgactgtgccgtgcttatcattgactccaccactggtggttttgaggctggtatctccaaggatggccagacccgtgagcatgcactcctcgctttcactcttggtgtgaagcagatgatctgctgctgcaacaagatggatgccaccactcccaagtactcgaaggcccgttatgatgaaattgttaaggaagtctcttcgtacctcaagaaggtcgggtacaaccctgacaaggtccccttcgtccccatctctggttttgagggtgacaacatgattgagaggtccaccaaccttgactggtacaagggccctaccttgcttgaggcccttgaccagatcaatgagcccaagaggccctcggacaagcccctgcgtcttcccctccaggacgtgtacaagattggtggcattggaactgtgcctgtgggccgtgttgagactggtgtcatcaagcctggtatgattgttaccttcggcccaaccggtctgaccactgaggtcaagtctgttgagatgcaccatgaggctcttcaggaggctcttcctggtgacaatgtcggcttcaatgtgaagaatgttgctgtgaaggatctcaagcgtgggtttgttgcatccaactccaaggatgaccctgccaaggaggctgccaacttcacctcacaggtcatcatcatgaaccaccctggtcagattggcaacggctacgccccagtgctggactgccacacctcccacattgctgtcaagtttgcggagctggtgaccaagatcgacaggcgatctggtaaggagctggagaaggagcccaagttcttgaagaacggtgatgctggtatcgtgaagatgattcccaccaagcccatggttgtggagaccttcgccatgtaccctcctcttggtcgttttgctgtgcgtgacatgagacaaacagttgctgttggtgtcatcaagggcgtggagaagaaggacccaaccggtgccaaggtcaccaaggctgctgccaagaagaaatgaggtgtccctgtgaggaaatatctagcagcagttttagtgttaaagttttgtctatggccattgcacttcttgcttgagactcctaaaacaatgcaagtagtgttcctgtttgtcgtttaagtacactgtatttctatttcagattcggcagaacatttgtgcgctgagtatgatttgtggtcaaacctacttttctgtaatgctagttctaagattgcaacttttataccctgctctttcttgtgcttggtgctgcctgctattccctgcttttcttccatagtttgcaaatttaattttctagtttgttgtttaatttgtttagcatgcatatttcgttcttagtatcttgttcattgtttttttacttaaaaattccagctttactctgt

SEQ ID NO: 438 - DNA, 1810 bp, Brachypodium distachyon
cttgcgccccccgaaacctatctcatttaaaacccccttccctgccctgcctctccattcccttccctctccccctcgccgccgccgccacctccgtctccttctcccttcgagtttcagccatgggtaaggagaagactcacatcaacatcgtggtcattggccatgtcgactctggcaagtcgaccaccactggccacctgatctacaagcttggaggtattgacaagcgtgtgatcgagaggttcgagaaggaggctgctgagatgaacaagaggtcgttcaagtatgcgtgggtgcttgacaagctcaaggccgagcgtgagagaggtatcaccattgatattgccctgtggaagttcgagaccaccaagtactactgcacggtcatcgacgcacctggacaccgggacttcatcaagaacatgattactggtacctcccaggctgactgtgccgtgctcatcattgactccacaactggtggttttgaggctggtatctccaaggatggccagacccgtgagcatgccctcctggctttcactcttggagtgaagcagatgatctgctgctgcaacaagatggatgccaccactcccaagtactcgaaggcccgttatgatgaaattgttaaggaagtctcttcgtacctcaagaaggtcggctacaaccctgacaaggtccccttcgtccccatctctggttttgagggtgacaacatgattgagaggtccaccaaccttgactggtacaagggccccaccttgcttgaggctcttgaccagatcaatgagcccaagaggccctcggacaagcccctgcgtcttcccctccaggacgtgtacaagatcggtggcattggaactgtgcctgttggccgtgttgagactggtgtcatcaagcctggtatgattgttaccttcggtcctactggtctgactactgaggtcaagtctgttgagatgcaccatgaggctctccaggaggcgcttccgggtgacaatgttggcttcaacgtcaagaatgttgctgtgaaggatctcaagcgtgggtttgtggcatccaactccaaggatgaccctgccaaggaggctgccaacttcacctcccaggtcatcatcatgaaccaccctggtcagattggcaacggctacgccccagtgctggactgccacacctcccacattgcagtcaagtttgctgagctggtgaccaagatcgacaggcgatctggtaaggagctggagaaggagcccaagttcttgaagaacggtgatgctggtattgtgaagatgattcccaccaagcccatggttgtggagaccttcgctatgtaccctccccttggtcgttttgctgtccgtgacatgagacaaacagttgctgttggtgtcatcaagggcgtggagaagaaggacccaactggcgccaaggtcaccaaggcggctgccaagaagaaatgatttgtcctgtgttgtggattgagatgtctggctgcagttttagtgtttcttaagttttgtctatgtgcattgctcttattgctgagactcttggaatgcaagcaatgttcatgtctgtcgtttaaatactgtactcctatttcggttcggttaaaacctgtgtgctctgatgcttgtgcccttgtttaacttctctgggatgcgagttcttagattgcaacttattatctgttctctcatgttcttgttcccttgatttgttcgcaattggtttttgttctgctacttcctattatatactctctctgtcccatataaaaatgacattctattacatgtatcta

SEQ ID NO: 439 - DNA, 1485 bp, Secale cereale
tcgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcaaatgatctgctgctgcaacaagatggatgccaccactcccaagtactcgaaggcccgttatgaggaaattgtcaaggaagtctcttcctacctgaagaaggtcggctacaaccctgacaaggttcccttcgtccccatctctgggtttgagggtgacaacatgattgagaggtccaccaaccttgactggtacaagggccctacccttctcgaggctcttgaccagatcaacgagcccaagaggccctcagacaagcccctgcgtcttccccttcaggatgtttacaagattggtggcattggaactgtgcctgttggacgtgttgagactggtgtcatcaagcctggtatggttgtaacctttggtcccactggtctgacaactgaagtcaagtctgttgagatgcaccacgagtctctcctggaggcgcttcctggtgacaatgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacagttgctgttggtgtcatcaagggcgtggagaagaaggaccccaccggtgccaaggttaccaaggccgccatcaagaagaaataggcttctatctagcagaaggtttttgttcatggtcattgcttttgttgcttcagactcttatcccgggcgagcaatgatcctgtctgtcgtttaattactgtatttctattcctgcttaaactcctgtgccccgagactgatttgttgtgaaatgcaagctattagattg

SEQ ID NO: 440 - DNA, 1384 bp, Brachypodium distachyon
gatgctgcagtttcagccatgggtaaggagaagactcacatcaacatcgtggtcattggccatgtcgactctggcaagtcgaccaccactggccacctgatctacaagcttggaggtattgacaagcgtgtgatcgagaggttcgagaaggaggctgccgagatgaacaagaggtcattcaagtacgcgtgggtgcttgacaagctcaaggcagagcgtgagagaggtatcaccatcgatattgccttgtggaagtttgagaccaccaagtactactgcacagtcatcgatgcccctggacaccgtgacttcatcaagaacatgattacgggtacctcccaggctgactgtgccgtgcttatcattgactccaccactggtggttttgaggctggtatctccaaggatggccagacccgtgagcatgcactcctcgctttcactcttggtgtgaagcagatgatctgctgctgcaacaaggtatacatgtcccaagtactcgaaggcccgttatgatgaaattgttaaggaagtctcttcgtacctcaagaaggtcgggtacaaccctgacaaggtccccttcgtccccatctctggttttgagggtgacaacatgattgagaggtccaccaaccttgactggtacaagggccctaccttgcttgaggcccttgaccagatcaatgagcccaagaggccctcggacaagcccctgcgtcttcccctccaggacgtgtacaagattggtggcattggaactgtgcctgtgggccgtgttgagactggtgtcatcaagcctggtatgattgttaccttcggcccaaccggtctgaccactgaggtcaagtctgttgagatgcaccatgaggctcttcaggaggctcttcctggtgacaatgtcggcttcaatgtgaagaatgttgctgtgaaggatctcaagcgtgggtttgttgcatccaactccaaggatgaccctgccaaggaggctgccaacttcacctcacaggtcatcatcatgaaccaccctggtcagattggcaacggctacgccccagtgctggactgccacacctcccacattgctgtcaagtttgcggagctggtgaccaagatcgacaggcgatctggtaaggagctggagaaggagcccaagttcttgaagaacggtgatgctggtatcgtgaagatgattcccaccaagcccatggttgtggagaccttcgccatgtaccctcctcttggtcgttttgctgtgcgtgacatgagacaaacagttgctgttggtgtcatcaagggcgtggagaagaaggacccaaccggtgccaaggtcaccaaggctgctgccaagaagaaatgaggtgtccctgtgaggaaatatctagca

SEQ ID NO: 441 - DNA, 1380 bp, Brachypodium distachyon
gattttgcagtttcagccatgggtaaggagaagactcacatcaacatcgtggtcattggccatgtcgactctggcaagtcgaccaccactggccacctgatctacaagcttggaggtattgacaagcgtgtgatcgagaggttcgagaaggaggctgctgagatgaacaagaggtcgttcaagtatgcgtgggtgcttgacaagctcaaggccgagcgtgagagaggtatcaccattgatattgccctgtggaagttcgagaccaccaagtactactgcacggtcatcgacgcacctggacaccgggacttcatcaagaacatgattactggtacctcccaggctgactgtgccgtgctcatcattgactccacaactggtggttttgaggctggtatctccaaggatggccagacccgtgagcatgccctcctggctttcactcttggagtgaagcagatgatctgctgctgcaacaaggtatacactcccaagtactcgaaggcccgttatgatgaaattgttaaggaagtctcttcgtacctcaagaaggtcggctacaaccctgacaaggtccccttcgtccccatctctggttttgagggtgacaacatgattgagaggtccaccaaccttgactggtacaagggccccaccttgcttgaggctcttgaccagatcaatgagcccaagaggccctcggacaagcccctgcgtcttcccctccaggacgtgtacaagatcggtggcattggaactgtgcctgttggccgtgttgagactggtgtcatcaagcctggtatgattgttaccttcggtcctactggtctgactactgaggtcaagtctgttgagatgcaccatgaggctctccaggaggcgcttccgggtgacaatgttggcttcaacgtcaagaatgttgctgtgaaggatctcaagcgtgggtttgtggcatccaactccaaggatgaccctgccaaggaggctgccaacttcacctcccaggtcatcatcatgaaccaccctggtcagattggcaacggctacgccccagtgctggactgccacacctcccacattgcagtcaagtttgctgagctggtgaccaagatcgacaggcgatctggtaaggagctggagaaggagcccaagttcttgaagaacggtgatgctggtattgtgaagatgattcccaccaagcccatggttgtggagaccttcgctatgtaccctccccttggtcgttttgctgtccgtgacatgagacaaacagttgctgttggtgtcatcaagggcgtggagaagaaggacccaactggcgccaaggtcaccaaggcggctgccaagaagaaatgatttgtcctgtgttgtggattgaga

SEQ ID NO: 442 - DNA, 1860 bp, Cajanus cajan
actctgcacttgctttacccatcgctcaatctctgcattgcggccgagggtttcgagcatcgtttttctctgagtttaagatatcatgggtaaagagaaggttcacatcaacattgtggtcattggtcatgtcgactctgggaagtcaactaccactggccatttgatttacaagcttggtggtatcgacaagcgtgttattgagaggtttgagaaagaagctgctgaaatgaacaagaggtcattcaaatatgcctgggtgcttgacaagcttaaggctgagcgtgaaagaggaattaccattgatattgcattgtggaagtttgagaccaccaaatactactgcacagtcattgatgctcctggacatcgtgactttatcaagaacatgattactggaacttcccaggctgactgtgccgtccttatcattgattccacaactggtggttttgaagctggtatttccaaagatggacagactcgtgagcatgctctacttgccttcacccttggagtcaagcaaatgatctgctgctgtaacaagatggatgccactaccccaaaatactcgaaggctaggtatgatgaaattgtgaaggaagtttcttcctacctgaagaaggttggttacaacccagacaagattccatttgttcccatctctggttttgagggtgacaacatgattgagaggtccaccaaccttgattggtacaagggaccaactcttcttgaggcccttgaccagatcaatgagcccaagagaccctcagacaagcctctgaggcttccattgcaggatgtctacaagattggtggtattggaactgtgccagtgggacgagttgaaactggtgtcttgaagcccggtatggtggtaacttttggtcccactggactgactactgaagttaagtctgtggagatgcaccatgaagctctccaagaggcccttccaggtgacaatgtgggattcaatgtgaagaatgttgcagtcaaggatctcaagcgtggttttgttgcctcaaactctaaggatgatcctgccaaggaggctgccaacttcacttcccaagtcattatcatgaaccatcctggtcagattggaaatggttatgctcctgtgcttgattgccacacttctcacattgctgtgaagtttgctgaacttattaccaagattgacaggcgatctggtaaggagcttgagaaggaacccaagttcttgaaaaatggagatgcaggtttggttaagatgattcccaccaagcccatggtggttgaaacttttgccgagtatcctcctcttggtcgttttgctgtgagggacatgcgtcaaaccgtggctgttggagtcatcaagaatgtggagaagaaggatcccaccggagccaaggtcaccaaggctgcacagaagaagaagtgaatgcatttttgtgtttctgaaagtacatgtgatcataattataattatggttacgcaaaacagtgtttccttatcagtaatttatcctttgagagtctaggtgcttttaccttttatagttttatgtgtctgtcgttttcatgcagccatagctttcaaaactgggttcttgatcggcggtggtgagttttcattatgtgctgagtcctgttttaacattttatatttcatagtctgtatgagaactctttttgcacaagcagctatagggttttagttttgctcctttgctgcccagagatgttttaagtaattgcctttacatttataattattgtctttagtctttacattttcatgttttattatatgtttgtcatctcaaaatttggtcagacattatgggaacggcggaatgaattgaatctgat

SEQ ID NO: 443 - DNA, 1701 bp, Vigna unguiculata
ccgtgcttcctcgctctgtttctcagtctatctttgcggctgaggattccgaacaatcggccttcgtttctcgctaagtttcagtttaactcatcatgggtaaagaaaaggttcatatcaacattgtggtcattggacatgtcgactctgggaagtcgactaccactggtcatttgatctacaagcttggaggtattgacaagcgtgtgatcgaaaggttcgagaaggaagctgctgagatgaacaagaggtcattcaagtatgcctgggtgcttgacaagcttaaggccgagcgtgaaagaggaattaccatcgatattgctttgtggaaattcgaaaccaccaagtactactgcacggtcattgatgcccctggacatcgtgactttatcaagaacatgatcactggaacctcccaggctgattgtgctgtccttatcattgattccaccactggtggttttgaagccggtatttccaaggatggacaaacccgtgagcatgctcttcttgctttcacccttggtgtgaagcagatgatctgttgctgtaacaaaatggatgccactactcccaagtactccaaggctaggtatgatgaaatcgtgaaggaagtttcttcctacttgaagaaggttggttacaacccagacaagattccatttgttccaatctctggatttgagggtgacaacatgattgagaggtccaccaaccttgactggtacaagggaccaactctccttgaggctcttgaccaaatcaacgagcccaagaggccctcagacaagccactcaggctccccttgcaggatgtttacaagattggtggtattggtaccgtgccagtcggacgtgttgagaccggtgtcttgaagcctggtatggtggtgacttttgctcccactggtttgacaactgaagttaagtctgttgagatgcaccacgaggctctccaagaggctctaccaggtgacaatgttggcttcaacgtgaagaacgttgctgtgaaggatctcaagcgtggtttcgttgcatccaactccaaggatgaccctgccaaggaagctgccaacttcacatcccaagtcatcatcatgaaccatcctggccagatcggaaacggctatgcaccagtgctcgattgccacacttcccacattgcagtgaagttcgccgagcttgtcaccaagatcgacaggcgatcaggtaaggagctggagaaggagcccaaatttttgaagaatggtgatgcaggtttcgttaagatgattccaaccaagcccatggtggttgaaaccttctctgagtatcctccccttggtcgttttgccgtgagggacatgcgtcaaacggtggctgttggagtcatcaagagtgttgagaagaaagacccaactggagccaaggtcaccaaggctgctcagaagaagaagtgatttctgctacatgtgatcttacttttggttacagaaaaaacttgttccttcatagtagtttatccttacagggttcatggtcggccgtcaattttctttgttgtctgttcatgagagtactattttttgttttcttttttatgtaagagtcggagttttctattttcagaagcagtcatagggttttagcccttttctgctgagagatgttttaactgcgtttaatttatatcaaagttttgtcaatggtttaacggttaaa

SEQ ID NO: 444 - DNA, 1961 bp, Arachis hypogaea
gctcactttgctcccatacactcttctctcttacttgcggctagggtttttcgcgcatctagcccttccaagatctttgttcggaatcatgggtaaagagaagactcacatcaacattgtggtcattggccacgtcgactcaggaaagtcgaccaccaccggtcacttgatctacaagttgggaggtattgacaagcgtgtgatcgaaagattcgagaaggaagctgctgagatgaacaagaggtccttcaagtatgcctgggtgctcgacaagctcaaggccgagcgtgaaagaggtatcaccatcgatattgccttgtggaagttcgagaccaccaaatactactgcactgtcattgatgctcccggacacagggatttcatcaagaacatgattactggaacttcccaggccgactgtgccgttctcatcatcgattccaccactggtggttttgaagctggtatctcgaaggatggtcagacccgtgagcacgctctccttgctttcacccttggtgtcaagcagatgatttgctgttgcaacaagatggatgccaccacacccaagtactccaaggcccgttatgatgaaatcgtgaaggaagtctcatcctacttgaagaaggtcggatacaacccagacaaaatcgcatttgttcccatctctggttttgagggagacaacatgattgagaggtctacaaacctcgactggtacaagggaccaacccttcttgaggcccttgaccagatcaatgagccaaagaggccatcagacaagcccctccgtctacctcttcaggatgtgtacaagattggaggtattggaactgtgccagtgggacgtgttgagacaggtgtcttgaagcccggtatggttgtgacctttggacctactggactgacaactgaagttaagtctgttgagatgcaccacgaagctcttacagaggccctccccggtgacaatgttgggttcaacgtcaagaatgttgcagtgaaggatctcaagcgtggttttgttgcctcaaactccaaggatgaccctgccaaggaggctgctaacttcacctcccaagtcatcatcatgaaccaccctggccagatcggaaatggctatgcgccagtgcttgattgccacacctcccacattgctgtcaagtttgctgagctcgtgaccaagattgacaggcgatctggtaaggagcttgagaaggagcccaagttcttgaagaatggtgatgcaggtcttgttaagatgattcccaccaagcccatggttgtggaaaccttctctgagtacccacctcttggtcgttttgccgtcagggacatgcgtcaaactgtggctgtgggagttatcaagaatgtggagaagaaggatgctaccggagccaaggtcaccaaggctgcccagaagaagaagtgaatcgtgcagggtggtttgaagcaagggtaccagcaccatatctacaataaatatttgtcccttgtttgcagtatctgtgtttctcgattagggagcttgtttattggacctagtttcaagtcttcaccctcgtctcgcaacttttgttcccagaactgggttctagatcgacggtggcaaggctttttggttttaccatgattttattttctgcctgcttttagttttgatgtgtctgggaatactttttaagttttgtaaactgcagtgaattttaggacttgtcctacactgcgaatttggattttgaacatcgagtctatatcttgtgctttaaactttaattgtatcgactctttattgtgttttaatcaacatcccctatgttttagtttacttttgtttcgcgatggggttgtgttttgttatgcatctagttgaaattagttcaaaaattttcccccagttttcgttaaatggtcttttctgaaacttttgttaatgaaattaaaggaccctaaatctatct

SEQ ID NO: 445 - DNA, 1730 bp, Cajanus cajan
gcagatctttctagctttcaagtttgaggcataatgggtaaggaaaaggttcacattaacattgtggtcattggccatgtcgactctgggaagtcaaccaccaccggtcacctcatctacaagcttggaggtattgacaagcgtgttattgagagatttgagaaggaagctgctgagatgaacaagaggtccttcaagtacgcgtgggtgcttgacaagctcaaggctgagcgtgaaagaggaatcaccattgatattgccctgtggaaatttgagaccaccaagtactactgcacggtcattgatgcccctggacacagggatttcattaagaacatgattactggtacatcccaagctgattgtgctgttcttattattgattccaccactggtggttttgaggccggtatttccaaggatggacagactcgtgagcacgctcttcttgctttcactcttggtgtgaagcagatgatttgctgctgtaacaagatggatgctaccacacctaagtattctaaggcaaggtatgatgaaattgttaaggaagtttcctcctacttgaagaaggtcggatacaaccctgacaagattccttttgttcccatctctggttttgagggagataacatgattgagaggtctacaaaccttgactggtacaagggaccaacccttctggaggcccttgatcagatcaacgagcccaagaggccatcagacaagcccctccgcttaccccttcaggatgtctacaagattggaggaattggaactgtgcctgttggacgagttgaaactggtactttgaaacctggaatggtggttacttttggaccaaccgggctgacaactgaagttaagtctgtggagatgcaccatgaagcactcactgaggcccttcccggtgacaatgtggggttcaatgttaagaatgttgctgtcaaggatctcaagcgtggttttgttgcctcaaactcaaaagatgaccctgccaaggaggcagctaactttacctcccaagttatcatcatgaatcaccctggtcagattggaaatggctatgcccctgttcttgattgccacacctcccacattgctgtcaagtttgccgaacttgtgaccaagattgacaggcgttctggtaaagagcttgagaaggagcccaagttcctgaagaatggagatgctggttatgtgaagatgattcccaccaagcctatggtggttgaaaccttctctgagtatcctccacttggtcgttttgctgtgagagacatgcgtcagactgtggctgtgggagtcatcaagaacgtggagaagaaggacccaactggagctaaggtcaccaaggctgcacagaagaagaagtgaatcgtgcaggatggtttatcaaggaaaaacttatatgtctacaataaatggtttcttgttcgtagtaatacattttttcgtgtagggaacttgtttatcggtttttgtgtcaggtttgctccgtcatctcggaacttttgttcccagaactgggttcttgatcgacggtggcaacgccatttatttttgtttttatgctttatctattttataatgtgttttctgtgagaactgttacatttttgtaagctgcagtgagttttatgattgttcctatgctgcaggtattgtttttgaatgttaaatctatattgtgctcttatctcttattttaaatatttactgagtagttc

SEQ ID NO: 446 - DNA, 1759 bp, Glycine max
aacactctgctcttgctttagccatcactaacactcagtctctgaattggggctgagggtttcgagtaacgtttatttttcacgagtttaagatatcatgggtaaagagaaggttcacattaacattgtggtcattggccatgttgactctgggaagtcaaccaccactggccacttgatttacaagcttggaggtattgacaagcgtgttattgagaggtttgagaaagaagctgctgagatgaacaagaggtcattcaaatacgcctgggtgcttgacaagcttaaggctgagcgtgagagaggaattaccattgatattgcattatggaagtttgagaccaccaaatactactgcactgttattgatgctccaggacatcgtgatttcatcaagaacatgattactggaacttcccaggctgattgtgctgtccttatcattgattccacaactggtggttttgaagctggtatttccaaagatggacagactcgcgagcatgctctacttgccttcacccttggtgtcaagcaaatgatctgttgctgtaacaagatggatgccactaccccaaagtactctaaggccaggtatgaagaaattgtgaaggaagtttcttcctacttgaagaaggtaggttacaacccagacaagattccatttgttcccatctcaggttttgagggtgacaacatgattgagaggtccaccaatcttgattggtacaagggaccaacccttctcgaggctcttgaccagatcaatgagcccaagagaccctcagacaagcctttgaggcttcccttgcaggatgtctacaagattggtggtattggaacagtgccagtgggacgagttgaaactggtgtcttgaagcccggtatggtggtgacttttgctcccactggcctgacaactgaagttaagtctgtggagatgcaccatgaagctctccaggaggcccttccaggtgacaacgtaggatttaatgtgaagaatgttgcagtcaaggatctcaagcgtggttttgttgcctcaaactctaaggatgatcctgccaaggaggctgccaacttcacatcccaagtcattataatgaaccatcctggccaaattggaaatggttatgctcctgtgcttgactgccacacttctcacattgccgtcaagtttgccgaacttgtgaccaagattgacaggcgatctggtaaggagattgagaaggagcccaaattcttgaaaaatggagatgcaggttatgttaagatgattcccaccaagcctatggtggtcgaaactttctccgagtatcctcctcttggtcgttttgccgtgagggacatgcgacaaactgtggctgttggagtcatcaagagtgtggagaagaaggacccaactggagccaaggtcaccaaggctgcacagaagaagaagtgaatacatttttgtgtttcttcaagtacatgcgatcatagttacatttatagttacacacaacagtggttccttattagtattttattttttgagagtataggtgcttttacttgttatagttttacttttatgtatcagccatttcattgcagccacctacctttcaaaactgggttcttgatgggcggtggtgacttttctattttataagctgtatgagaactctttttgcacaagcagctacagggttttagttttgctcctttgctgccgagggatgttataagtaaattgccttttacattttacaagttttgt

SEQ ID NO: 447 - DNA, 2066 bp, Glycine max
ccttagttggccttcgaaaccactaaaaccgacaacatacgtattttcgggggcgcgtgtaacaaactcgccaacactgttgcgaaggcgcggaccgtcaaacacaactttatagcggggcatatagggaaatatgaaaaataaacgagggcgttttcgcaacagagaaaattgtgcttcggtataaaatcctccaaaccctattactaagcctaacactctgctcttgctttagccatcactaacactcagtctctgaattggggctgagggtttcgagtaacgtttatttttcacgagtttaagatatcatgggtaaagagaaggttcacattaacattgtggtcattggccatgttgactctgggaagtcaaccaccactggccacttgatttacaagcttggaggtattgacaagcgtgttattgagaggtttgagaaagaagctgctgagatgaacaagaggtcattcaaatacgcctgggtgcttgacaagcttaaggctgagcgtgagagaggaattaccattgatattgcattatggaagtttgagaccaccaaatactactgcactgttattgatgctccaggacatcgtgatttcatcaagaacatgattactggaacttcccaggctgattgtgctgtccttatcattgattccacaactggtggttttgaagctggtatttccaaagatggacagactcgcgagcatgctctacttgccttcacccttggtgtcaagcaaatgatctgttgctgtaacaagatggatgccactaccccaaagtactctaaggccaggtatgaagaaattgtgaaggaagtttcttcctacttgaagaaggtaggttacaacccagacaagattccatttgttcccatctcaggttttgagggtgacaacatgattgagaggtccaccaatcttgattggtacaagggaccaacccttctcgaggctcttgaccagatcaatgagcccaagagaccctcagacaagcctttgaggcttcccttgcaggatgtctacaagattggtggtattggaacagtgccagtgggacgagttgaaactggtgtcttgaagcccggtatggtggtgacttttgctcccactggcctgacaactgaagttaagtctgtggagatgcaccatgaagctctccaggaggcccttccaggtgacaacgtaggatttaatgtgaagaatgttgcagtcaaggatctcaagcgtggttttgttgcctcaaactctaaggatgatcctgccaaggaggctgccaacttcacatcccaagtcattataatgaaccatcctggccaaattggaaatggttatgctcctgtgcttgactgccacacttctcacattgccgtcaagtttgccgaacttgtgaccaagattgacaggcgatctggtaaggagattgagaaggagcccaaattcttgaaaaatggagatgcaggttatgttaagatgattcccaccaagcctatggtggtcgaaactttctccgagtatcctcctcttggtcgttttgccgtgagggacatgcgacaaactgtggctgttggagtcatcaagagtgtggagaagaaggacccaactggagccaaggtcaccaaggctgcacagaagaagaagtgaatacatttttgtgtttcttcaagtacatgcgatcatagttacatttatagttacacacaacagtggttccttattagtattttattttttgagagtataggtgcttttacttgttatagttttacttttatgtatcagccatttcattgcagccacctacctttcaaaactgggttcttgatgggcggtggtgacttttctattttataagctgtatgagaactctttttgcacaagcagctacagggttttagttttgctcctttgctgccgagggatgttataagtaaattgccttttacattttacaagttttgttggatgcttttgttctttcataatttggtcagacattgttggtatagctacatggcttggacacttattgatttgattttagggatgacaata

SEQ ID NO: 448 - DNA, 1800 bp, Trigonella foenum-graecum
atctaggtcgctataaaaatcttacaaccctagtttcttcattctctcactctttacttgttcttctatcatcactcagctctctctgcggctgaggatccgaacgagtaacaaccttccatttcgtttcagctaagttttaagacatcatgggaaaagaaaaggttcatatcaacattgtcgtcattggacatgtcgactctggaaaatcaacaacaactggtcacttgatctacaagctaggaggtatcgacaagcgtgtgattgagaggttcgagaaggaagctgcggaaatgaacaaacgttcattcaagtatgcatgggttcttgacaaacttaaggctgagcgtgaaagaggaattaccatcgatattgctttgtggaaattcgagaccaccaagtactactgcacagtcattgatgctcctggacatcgtgatttcatcaagaacatgattactggaacctcccaggctgattgtgctgttctcatcattgattccaccactggtggttttgaagctggtatctcaaaggatggacagacccgtgagcatgctcttctcgctttcacccttggagtgaagcagatgatctgttgttgtaacaagatggatgctaccacccctaagtactcaaaggctaggtacgatgaaatcattaaggaagtttcttcctacttgaagaaggttggttacaacccagacaaaattccctttgttcccatctccggttttgaaggtgacaacatgattgaaaggtccaccaacctagactggtacaagggaccaactctccttgaggcacttgaccagatcaacgagcccaagagaccctcagacaagcccctcagacttccattgcaagatgtttacaagattggtggtattggaactgtgccagtcggacgtgttgagaccggtgttgtgaagcccggtatggtggttacttttggaccaactggtttgacaactgaagttaagtctgttgagatgcaccacgaggctctcactgaagctcttcctggagacaatgtcggattcaatgttaagaatgttgcagtgaaggatctcaagcgtggtttcgttgcatccaactccaaggatgaccctgccaaggaagctgccaacttcacttcccaagtcatcatcatgaaccaccctggacagattggaaacggatatgcgccagtgctcgattgccacacctctcacattgctgtgaagtttgctgaacttgtcaccaagatcgacaggcgatctggtaaggagattgagaaggagcccaagtttttgaagaatggagatgctggtatcattaagatgattcccaccaaacccatggttgttgagactttctctgaatatcctccattgggacgtttcgctgtcagggacatgcgtcaaactgttgctgttggtgtcatcaagggtgtggagaagaaggatcctaccggagccaaagtcaccaaagctgctgccaagaagaagtgatctcacaccatggttattgcataagttgttcctttttactagtttattatctcttcagagtactttgttattccagttttatttttccagttttagaaacttacagaactgggttcttgatcggcgatggtactgtttttggttttatttgttaagagtctggagaacttgattttcgaaaggcagctaaaaggttttacatcttaattttgctgctgaaggatgttgtaatttcatttgatttacaaacagttttgtgatgtcaaacctttttgtttatctctctgcttctgttcaaaatatcttt

SEQ ID NO: 449 - DNA, 1672 bp, Triticum aestivum
cctcccaccccatcgccgccgcaggctttgactccatcgcctctccctcctcttcgtctccggccggccaggtagttaacagctccagcagccatggggaaggagaagatccacatcagcattgtggtcattggccatgtcgactctggcaagtcaaccacgaccggccacctcatctacaagcttggaggcattgacaagcgtgtgatcgagaggtttgagaaggaagccgctgagatgaacaagaggtctttcaagtatgcctgggtgcttgacaagctcaaggctgagcgtgagaggggtatcaccatagatattgctctgtggaagttcgagaccaccaagtactcgtgcactgtcattgatgctcctggtcaccgtgatttcatcaagaacatgatcactgggacctcccaggctgattgtgctgtgcttatcattgactccaccactggtggttttgaggctggtatctccaaggatggccagacccgtgagcatgctctccttgctttcactcttggtgtgaaacagatgatctgctgctgtaacaagatggatgccaccactcccaagtactcgaaggcccgttatgaagaaattgtcaaggaagtctcttcatacctgaagaaggtcggttacaaccctgacaaggttcccttcgttcccatctctgggttcgagggcgacaacatgattgagaggtccaccaaccttgactggtacaagggccccacccttcttgaggccctggaccagatcaatgagcccaagaggccctccgacaagcccctgcgtcttccccttcaggacgtgtacaagattggcggcattggaactgtgccagtggggcgtgttgagactggagtcatcaagccaggcatggttgtcacctttggtcctactggcctgaccactgaggtgaagtctgtggagatgcaccacgagtctctcctggaggcgcttcctggtgacaacgtcggcttcaacgtcaagaatgtggctgtcaaggatctcaagcgtgggtacgtcgcttccaactccaaggacgaccctgccaaggaggctgccaacttcaccgcccaggtcatcatcatgaaccaccctggccagatcagcaacggctatgccccagtgctggactgccacacgtcccacatcgctgtcaagtttgctgagatccagaccaagatcgaccggcggtctggcaaggagattgaggcggcgcccaagttcctcaagaacggtgatgccgggttcgtcaagatgatccccaccaagcccatggtggtggagaccttcgctcagtaccctcccctgggccgctttgctgtgcgtgacatgaggcagacggttgcggtgggcgttatcaaggccgtggagaagaaggatccgaccggcgccaaggtgaccaaggctgcggccaagaagaaatgagatggtgtcaggttctttactgcatctatgatggtggtggcggtgacggcatttggtggtggtgatagttgttctagtcgttttgaaaacttgttaagcttcggttatttgtgtcgagcagtgttggaactgcttattgctctggtcattgtatcgttcggttgtgttggtggaactttgtcagttaatgttgctactatatatagtcatcatgtttggagtcgttttatgtcag

SEQ ID NO: 450 - DNA, 1835 bp, Triticum aestivum
atctgatcgtcttcgagcccccaactttcgttcttgattaatgaaaacatccttggcaaatctcatcgccgccgcaggctttgactccatcgcctcctccctcctcctcttcgtctccggcaggccaggtagttaacagctccagcagccatgggaaaggagaagatccacatcagcattgtggtcattggccatgttgactctggcaagtcaaccacgactggccacctcatctacaagcttggaggcattgacaagcgtgtgatcgagaggttcgagaaggaagccgctgagatgaacaagaggtctttcaagtatgcctgggtgcttgacaagctcaaggctgagcgtgagaggggtatcaccattgatattgctctctggaagttcgagaccaccaagtactcctgcactgtcattgatgctcctggtcaccgtgatttcatcaagaacatgatcactgggacctcccaggctgattgtgctgtgcttatcattgactccaccactggtggttttgaggctggtatctccaaggatggccagacccgtgagcacgctctccttgcgttcactcttggtgtgaagcagatgatctgctgctgcaacaagatggatgccaccactcctaagtactcgaaggcccgttatgaagaaattgtcaaggaagtctcttcatacctgaagaaggtcggttacaaccctgacaaggttcccttcgttcccatctctgggttcgagggtgacaacatgattgagaggtccaccaaccttgactggtacaagggccccacccttcttgaggccctggaccagatcaatgagcccaagaggccctccgacaagcccctgcgtcttccccttcaggacgtctacaagattggtggcattggaactgtgccagtggggcgtgttgagactggagtcatcaagccaggcatggttgtcacctttggtcctactggcctgaccactgaggtgaagtctgtggagatgcaccacgagtctctcctggaggcgcttcctggtgacaatgtcggcttcaacgtcaagaacgtggccgtcaaggatctcaagcgtggatacgtcgcttccaactccaaggacgaccctgccaaggaggctgccaacttcaccgcccaggtcatcatcatgaaccaccctggccagatcagcaacggctatgccccggtgctggactgccacacgtcccacattgctgtcaagttcgctgagatccagaccaagattgaccggcggtctggcaaggagattgaggcggcgcccaagttcctgaagaacggtgatgccgggttcgtcaagatgatccccaccaagcccatggtggtggaaacctttgcccagtaccctcccctgggccggtttgctgtgcgcgacatgaggcagacggttgccgtgggcgttatcaaggccgtggagaagaaggatccgaccggcgccaaggtgaccaaggctgcggccaagaagaaatgagatggtgtcaggttctttactgcatctatggtggtggtggcggtggcggtatttggtggtggtgatagttgttctagtcgttttgagaacttgttaagcttcggttatttgtgtcgagcagtgttggaactgcttattgctctggtcattgtatcgttcggttgtgttggtggaactatgtcagttgatgttgctactaaatatagtcgtcatgtttggagtcgttttatatcagttgatcatgtttcttgtcatgcaaagttgaatttttgttttgcttccttaactattcctattcctgtgcttcttttgcagccagaatatttcttcttcagttgtcc

SEQ ID NO: 451 - DNA, 1677 bp, Triticum aestivum
cactccatcgcctctccctcctcttcgtctccggccggccaggtagttaacagctccagcagccatggggaaggagaagatccacatcagcattgtggtcattggccatgtcgactctggcaagtcaaccacgaccggccacctcatctacaagcttggaggcattgacaagcgtgtgatcgagaggtttgagaaggaagccgctgagatgaacaagaggtctttcaagtatgcctgggtgcttgacaagctcaaggctgagcgtgagaggggtatcaccatagatattgctctgtggaagttcgagaccaccaagtactcgtgcactgtcattgatgctcctggtcaccgtgatttcatcaagaacatgatcactgggacctcccaggctgattgtgctgtgcttatcattgactccaccactggtggttttgaggctggtatctccaaggatggccagacccgtgagcatgctctccttgctttcactcttggtgtgaaacagatgatctgctgctgtaacaagatggatgccaccactcccaagtactcgaaggcccgttatgaagaaattgtcaaggaagtctcttcatacctgaagaaggtcggttacaaccctgacaaggttcccttcgttcccatctctgggttcgagggcgacaacatgattgagaggtccaccaaccttgactggtacaagggccccacccttcttgaggccctggaccagatcaatgagcccaagaggccctccgacaagcccctgcgtcttccccttcaggacgtgtacaagattggtggcattggaactgtgccagtggggcgtgttgagactggagtcatcaagccaggcatggttgtcacctttggtcctactggcctgaccactgaggtgaagtctgttgagatgcaccatgagtctctcctggaggcgcttcctggtgacaacgtcggcttcaacgtcaagaacgtggccgtcaaggatctcaagcgtgggtacgtcgcttccaactccaaggacgaccctgccaaggaggctgccaacttcaccgcccaggtcatcatcatgaaccaccctggccagatcagcaacggctatgccccagtgctggactgccacacgtcccacatcgctgtcaagtttgctgagatccagaccaagatcgaccggcggtctggcaaggagattgaggcggcgcccaagttcctcaagaacggtgatgccgggttcgtcaagatgatccccaccaagcccatggtggtggagaccttcgctcagtaccctcccctgggccgctttgctgtgcgtgacatgaggcagacggttgcggtgggcgttatcaaggccgtggagaagaaggatccgaccggcgccaaggtgaccaaggctgcggccaagaagaaatgagatggtgtcaggttctttactgcatctatgatggtggtggcggtgacggcatttggtggtggtgatagttgttctagtcgttttgaaaacttgttaagcttcggttatttgtgtcgagcagtgttggaactgcttattgctctggtcattgtatcgttcggttgtgttggtggaactttgtcagttaatgttgctactatatatagtcatcatgtttggagtcgttttatgtcagttgatcatgtttttttgtctgcaaagttgaattt

SEQ ID NO: 452 - DNA, 1708 bp, Triticum aestivum
ggcttcgactccagcgcctcctcccttcccctcatcgtctccggtcagccaggtagttaacagctccagcagccatgggcaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtctttcaagtacgcctgggtgcttgacaagctcaaggctgagcgtgagaggggtatcaccattgatattgctctgtggaagtttgagaccaccaagtactcctgcactgtcattgatgctcctggtcaccgtgacttcatcaagaacatgatcactgggacctcccaggctgattgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactcgaaggcccgttatgaagaaattgtcaaggaagtctcttcatacctgaagaaggtcggttacaaccctgacaaggttcccttcgttcccatctctgggttcgagggcgacaacatgattgagaggtccaccaaccttgactggtacaagggccccacccttcttgaggccctggaccagatcaatgagcccaagaggccctccgacaagcccctgcgtcttccccttcaggacgtgtacaagattggtggcattggaactgtgccagtggggcgtgttgagactggagtcatcaagccaggcatggttgtcacctttggtcctactggcctgaccactgaggtgaagtctgttgagatgcaccatgagtctctcctggaggcgcttcctggtgacaacgtcggcttcaacgtcaagaacgtggccgtcaaggatctcaagcgtgggtatgtcgcttccaactccaaggacgaccctgccaaggaggctgccaacttcaccgcccaggtcatcatcatgaaccaccctggccagatcagcaatggctacgccccggtgctggactgccacacgtcccacatcgccgtcaagttcgctgagatccagaccaagattgaccggcggtctggcaaggagattgaggcggcgcccaagttcctgaagaacggtgatgccgggttcgtcaagatgatccccaccaagcccatggtggtggaaaccttcgcccagtaccctcccctgggccgctttgctgtgcgtgacatgaggcagacggttgccgtgggcgttatcaaggctgtggagaagaaggatccgaccggcgccaaggtgaccaaggctgcggccaagaagaaatgagatggtgtcgggcggtggcgtcgttcgtggtactttaccacatctgtggtggtggtggcggtatacggtggtggttatagtcgtgttagcgaatttgcgaacttgttaagcttctgttatttgtgtcgagcagtgttcgaactgcttattactgtggtcatagtattgttcggttgtgttggtgaaacttcgtcagataaaattgctattttatatatgcgtgatatttggagtcattttatgtctgctgctgcctctacaagtatatttgataatggtgtttgttttgc

SEQ ID NO: 453 - DNA, 1801 bp, Triticum aestivum
cttcgactccatcgcctcctcctccccctcgttgtctccggccagccaggtagtcctccatgggcaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtctttcaagtacgcctgggtgcttgacaagctcaaggctgagcgtgagaggggtatcaccattgatatcgctctgtggaagttcgagaccaccaagtactcgtgcactgtcattgatgctcctggtcaccgtgatttcatcaagaacatgatcactgggacctcccaggctgactgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactcgaaggcccgttatgaagaaattgtcaaggaagtctcttcatacctgaagaaggtcggttacaaccctgacaaggttcccttcgttcccatctctgggttcgagggcgacaacatgattgagaggtccaccaaccttgactggtacaagggccccacccttcttgaggccctggaccagatcaatgagcccaagaggccctccgacaagcccctgcgtcttccccttcaggatgtgtacaagattggcggcattggaactgtgccagtggggcgtgttgagactggagtcatcaagccaggcatggttgtcacctttggtcctactggcctgaccactgaggtgaagtccgttgagatgcaccatgagtctctcctggaggctcttcctggtgacaatgtcggcttcaacgtcaagaatgtggctgtcaaggatctcaagcgagggtacgtcgcttccaactccaaggacgaccctgccaaggaggctgccaacttcaccgcccaggtcatcatcatgaaccaccctggccagatcagcaacggctatgccccggtgctggactgccacacgtcccacatcgctgtcaagtttgctgagatccagaccaagatcgaccggcggtctggcaaggagattgaggcggcgcccaagttcctcaagaacggtgatgccgggttcgtcaagatgatccccaccaagcccatggtggtggagaccttcgcccagtaccctcccctgggccgctttgctgtgcgcgacatgaggcagacggttgccgtgggcgttatcaaggccgtggagaagaaggatccgaccggcgccaaggtgaccaaggctgcggccaagaagaaatgagatggtgtcgggcggcggcgtcgttggtggttctttaccacatctatggtggtggcggcggtatacggtggtggtcatagtcgtgttagcggatttgcaaacttgttaagcttcggttatttgtgtcgagcagtgttcgaactgcttattactgtggtcagcatagtatcgttccttgtgttggtgaaacttcgtcagataaagttgctattttatatatgcgtggtatttggagtcgctgcctgtgcaagcatatttggtaatggtttttgttttgcaaagtggattttttttcgttgctaactactcatgctgaaacttacctgtgctgaaaatttattactcaaactcagacggagagttgcagcagctgcttttttttccaggtgcatctaaga

SEQ ID NO: 454 - DNA, 1639 bp, Triticum aestivum
cgccgccgcaggctttgaccccatcgcccctccgtcctcttcgtctccggtaggccaggtagttaacagctccagcagccatgggaaaggagaagatccacatcagcattgtggtcattggccatgtcgactctggcaagtcaaccacgactggccacctcatctacaagcttggaggcattgacaagcgtgtgattgagaggtttgagaaggaagccgctgagatgaacaagaggtctttcaagtatgcctgggtgcttgacaagctcaaggctgagcgtgagaggggtatcaccattgatattgctctgtggaaattcgagaccaccaagtactcctgcactgtcattgatgctcctggtcaccgtgatttcatcaagaacatgatcaccgggacctcccaggctgattgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactcgaaggcccgttatgaagaaattgtcaaggaagtctcttcatacctgaagaaggttggttacaaccctgacaaggttccctttgttcccatctctgggttcgagggtgacaacatgattgagaggtccaccaaccttgactggtacaagggccccacccttctcgaggccctggaccagatcaatgagcccaagaggccctcagacaagcccctccgtcttccccttcaggacgtgtacaagattggcggcattggaactgtgccagtgggccgtgttgagactggagtcatcaagccaggcatggttgtcacctttggtcctactggcctgaccactgaggtgaagtccgttgagatgcaccatgagtctctcctggaggcgcttcctggtgacaacgtcggcttcaacgtcaagaacgtggctgtcaaggatctcaagcgtgggtacgtcgcttccaactccaaggacgaccctgccaaggaggctgccaacttcaccgcccaggtcatcatcatgaaccaccccggccagatcagcaacggctatgccccggtgctggactgccatacgtcccacattgctgtcaagtttgctgagatccagaccaagatcgaccggcggtctggcaaggagattgaggcggcgcccaagttcctcaagaacggtgatgctgggttcgtcaagatgatccccaccaagcccatggtggtggagacctttgcccagtaccctcccctgggccgctttgctgtgcgtgacatgaggcagacggttgccgtgggtgttatcaaggctgtggagaagaaggatccgaccggtgccaaggtgaccaaggctgcggccaagaagaaatgagatggtgtcaggttctttactgcatctatggtggcggtggcggtatttggtggtggtgatagttgttctagttgttttggaaacttgttaagcttcggttatttgtgtcgagcagtgttggaactgcttattgctctgtcattgtatcgttcggttgtgttggtgaaacttcgtcagttaatgttgctactatatatagttggcatgtttggagt

SEQ ID NO: 455 - DNA, 1384 bp, Brachypodium distachyon
gctgcagtttcagccatgggtaaggagaaaactcacatcaacatcgtggtcattggccatgtcgactctggcaagtcgaccaccactggccacctgatctacaagcttggaggtattgacaagcgtgtgatcgagaggttcgagaaggaggctgccgagatgaacaagaggtcattcaagtacgcgtgggtgcttgacaagctgaaggctgagcgtgagagaggtatcaccatcgatattgccttgtggaagttcgagaccaccaagtactactgcaccgtcattgatgcccctggtcaccgtgacttcatcaagaacatgattaccggtacctcccaggctgactgtgccgtgcttatcattgactccacgactggaggttttgaggctggtatctccaaggatggccagacccgtgagcatgccctccttgctttcactcttggagtgaagcagatgatctgctgctgcaacaaggtatacttgcaagccgaattttcccaagtactcgaaggcccgttatgatgaaattgttaaggaagtctcttcctacctcaagaaggtcggctacaaccctgacaaggtccccttcgtccccatctctggttttgagggtgacaacatgattgagaggtccaccaaccttgactggtacaagggccctaccttgcttgaggcacttgaccagatcaatgagcccaagaggccctcagacaagcccctgcgtcttcccctccaggacgtgtacaagattggtggcattggaactgtgcctgttggccgtgttgagactggtgtcatcaagcctggtatgattgttaccttcggtcctactggtcttaccactgaggtcaagtccgttgagatgcaccatgaggctctccaggaggcccttcctggtgacaatgttggcttcaacgtcaagaacgttgctgtgaaggatctcaagcgtgggtttgttgcatccaactccaaggatgaccctgccaaggaggctgccaacttcacctcccaggtcatcatcatgaaccaccctggtcagattggcaacggctacgccccagtgctggactgccacacctcccacattgctgtgaagtttgccgagctggtgaccaagatcgacaggcgatctggtaaggagctggagaaggagcccaagttcttgaagaacggtgatgctggtatcgtgaagatgattcccaccaagcccatggttgtggagaccttcgccatgtaccctcctcttggtcgttttgctgtgcgtgacatgagacaaacagttgctgttggtgtcatcaagggtgtggagaagaaggacccaaccggcgccaaggtcaccaaggcggctgccaagaagaaatgatttgttctgtgttgggga

SEQ ID NO: 456 - DNA, 1388 bp, Brachypodium distachyon
catgggtaaggagaagactcacatcaacatcgtggtcattggccatgtcgactctggcaagtcgaccaccactggccacctgatctacaagcttggaggtattgacaagcgtgtgatcgagaggttcgagaaggaggctgccgagatgaacaagaggtcattcaagtacgcgtgggtgcttgacaagctgaaggctgagcgtgagagaggtatcaccatcgatattgccttgtggaagttcgagaccaccaagtactactgcaccgtcattgatgcccctggacaccgtgacttcatcaagaacatgattaccggtacctcccaggctgactgtgccgtgcttatcattgactccacgactggaggttttgaggctggtatctccaaggatggccagacccgtgagcatgccctccttgctttcactcttggagtgaagcagatgatctgctgctgcaacaaggtatatttgatattcaatttcactcccaagtactcgaaggcccgttatgatgaaattgttaaggaagtctcttcctacctcaagaaggtcggctacaaccctgacaaggtccccttcgtccccatctctggttttgagggtgacaacatgattgagaggtccaccaaccttgactggtacaagggccctaccttgcttgaggcacttgaccagatcaatgagcccaagaggccctcggacaagcccctgcgtcttcccctccaggacgtgtacaagattggtggcattggaactgtgcctgttggccgtgttgagactggtgtcatcaagcctggtatgattgttaccttcggtcctactggtcttaccactgaggtcaagtccgttgagatgcaccatgaggctctccaggaggcccttcctggtgacaatgttggcttcaacgtcaagaacgttgctgtgaaggatctcaagcgtgggtttgttgcatccaactccaaggatgaccctgccaaggaggctgccaacttcacctcccaggtcatcatcatgaaccaccctggtcagattggcaacggctacgccccagtgctggactgccacacctcccacattgctgtgaagtttgccgagctggtgaccaagatcgacaggcgatctggtaaggagctggagaaggagcccaagttcttgaagaacggtgatgctggtatcgtgaagatgattcccaccaagcccatggttgtggagaccttcgccatgtaccctcctcttggtcgttttgctgtgcgtgacatgagacaaacagttgctgttggtgtcatcaagggtgtggagaagaaggacccaaccggcgccaaggtcaccaaggcggctgccaagaagaagtgagtagttccctgtggtcgattgagatatctgtctg

SEQ ID NO: 457 - DNA, 1713 bp, Phaseolus vulgaris
tcattatcactccttgcttcctcgctctatttttgcggctgaggattctgaaccagcgaccttcgtttctctctaagtttaactcatcatgggtaaggaaaaggttcatatcaacattgtggtcattggacatgtcgactctgggaagtcaactaccaccggccacttgatctacaagcttggaggtattgacaagcgtgtgattgaaaggttcgagaaggaagctgctgagatgaacaagaggtcattcaagtatgcctgggtgcttgacaagctcaaggctgagcgtgaaagaggaattaccattgatattgctttgtggaaattcgaaaccaccaagtactactgcacagtcattgatgcccctggacatcgtgactttatcaagaacatgatcactggaacctcccaggctgattgtgctgtccttattattgattccacaactggtggttttgaagccggtatttccaaggatggacaaacccgtgagcatgctcttcttgctttcacccttggtgtcaagcagatgatctgttgctgtaacaagatggatgccactacccctaagtactccaaggctaggtatgatgaaatcatcaaggaagtttcatcctacttgaagaaggttggttacaacccagacaaaattccatttgtcccaatctctggatttgagggtgacaacatgattgagaggtccaccaaccttgactggtacaagggacccactctccttgaagcccttgaccaaatcaatgagcccaagaggccctcagacaagcctctcaggcttcccttgcaggatgtctacaagattggtggtattggtaccgtgccagtgggacgtgttgaaaccggtgtcatcaagccgggtatgctggtgacttttgctcccacaggtttgacaactgaagttaagtctgttgagatgcaccacgaggctctcctagaggctcttccaggtgacaatgtcggcttcaacgtgaagaacgttgctgtcaaggatctcaagcgtggtttcgttgcttccaactccaaggatgaccctgccaaggaagctgccaacttcacatcccaagtcatcatcatgaatcaccctggccagatcggaaatggctatgcaccagtgcttgattgccacacctcccacattgcagtcaagttcgccgaactcgtgaccaagatcgacaggcgatcaggtaaggagatcgagaaggagcccaaatttttgaagaatggtgatgcaggttatgttaagatgattccaaccaagcccatggttgttgaaaccttctctgagtatcctccccttggccgttttgccgtgagggacatgcgtcagaccgtggctgtcggagtcatcaagagtgttgagaagaaagaccccactggagccaaggtcaccaaggctgctcagaagaagaagtgatcataaaaatcttgttcctttatagtcttagtcttaaaacccgggttcatggttcaattttcgttgttgtttattcctgagaggactatttttgtttttttgtttttatttttgatgtaagagtctgagttttacattttcacaaagcagacatagggttttagcccttgctgagagatgttttaaatgcttttaatttataagaaagttttgtcaatggttttatcggtttaacgtaagcctattttataatccaattatatattttaactattcaaata

SEQ ID NO: 458 - DNA, 1682 bp, Malus domestica
ttccagttctgttgctgataatccgtcatgggtaaagagaagttccatatcaacattgtggtcattggccatgtcgactctggcaagtcaaccaccactggccacttgatctacaagcttggtggtattgacaagcgtgtgatcgagaggttcgagaaggaggctgctgagatgaacaagaggtcattcaagtatgcctgggtgttggacaagctcaaggctgagcgtgagcgtggaattaccattgatattgccttgtggaaatttgagaccaccaagtactactgcactgtcattgatgctcctggacatcgtgactttatcaagaacatgattacgggaacctcccaggctgactgtgccatcctcatcattgactccaccactggaggttttgaagctggtatttccaaggatggtcagacccgtgagcatgctttgcttgctttcactcttggtgtcaagcaaatgatttgctgctgcaacaagatggatgccaccactcccaagtactcaaaggcaaggtacgaagaaattgtgaaggaagtgtcgtcctatctcaagaaggttggctacaacccagataagattccctttgtccccatttctgggtttgagggtgacaacatgattgagaggtccaccaaccttgactggtacaagggtcccacccttcttgaggctcttgaccagatcaacgagcccaagaggccctcagacaagcccctccggcttccacttcaggatgtgtacaagattggtggtattggtaccgttcctgttggacgagttgagactggtgtcattaagcctggtatggtggtgacttttggcccaactgggctaactactgaggtcaagtctgttgagatgcaccacgaagctatgctggaggcccttccaggtgataatgttggattcaacgtgaagaatgttgctgtcaaggatctcaagcgtggttatgttgcttccaactccaaggatgatcctgcaaaggaggctgctaactttacctctcaggtcatcatcatgaaccaccccgggcagattggacagggatatgcaccagttcttgactgtcatacctcccacattgctgtcaagtttgctgagcttgtgacaaagattgacaggcgatctggcaaggagctcgagaaggagcctaagttcttgaagaatggtgatgccggatttgtgaagatgattccaactaagcccatggttgtcgagaccttctctgagtacccaccacttggacgttttgctgtgagggacatgcgccagactgttgcagttggtgtcatcaagagcgttgagaagaaggatccaactggagctaagatcaccaaggccgccgctaagaagaagtgaaccgctgtggttcatcagatttccgcaggcgaaatctcctatcctaataataataatagtcgtaaaaacttatcttctagtatttctatggattgctggttgttgtcgttgtcgtcgttgggcattcattctcagaattgggtgctcgaccggcggtggcgttgctagtgtgttcttgtgctgtctcctccgttgagagtctaggtgctctgggtttttcccagtgcggctaaaagcttttgtgactggttcttgctactctcggtataaaaacttagcgtctaataaatatgttcttgtggtatttcata

SEQ ID NO: 459 - DNA, 1717 bp, Phaseolus vulgaris
tagttcattatcactccttgcttcctcgctctatttttgcggctgaggattctgaaccagcgaccttcgtttctctctaagtttaactcatcatgggtaaggaaaaggttcatatcaacattgtggtcattggacatgtcgactctgggaagtcaactaccaccggccacttgatctacaagcttggaggtattgacaagcgtgtgattgaaaggttcgagaaggaagctgctgagatgaacaagaggtcattcaagtatgcctgggtgcttgacaagctcaaggctgagcgtgaaagaggaattaccattgatattgctttgtggaaattcgaaaccaccaagtactactgcacagtcattgatgcccctggacatcgtgactttatcaagaacatgatcactggaacctcccaggctgattgtgctgtccttattattgattccacaactggtggttttgaagccggtatttccaaggatggacaaacccgtgagcatgctcttcttgctttcacccttggtgtcaagcagatgatctgttgctgtaacaagatggatgccactacccctaagtactccaaggctaggtatgatgaaatcatcaaggaagtttcatcctacttgaagaaggttggttacaacccagacaaaattccatttgtcccaatctctggatttgagggtgacaacatgattgagaggtccaccaaccttgactggtacaagggacccactctccttgaagcccttgaccaaatcaatgagcccaagaggccctcagacaagcctctcaggcttcccttgcaggatgtctacaagattggtggtattggtaccgtgccagtgggacgtgttgaaaccggtgtcatcaagccgggtatgctggtgacttttgctcccacaggtttgacaactgaagttaagtctgttgagatgcaccacgaggctctcctagaggctcttccaggtgacaatgtcggcttcaacgtgaagaacgttgctgtcaaggatctcaagcgtggtttcgttgcttccaactccaaggatgaccctgccaaggaagctgccaacttcacatcccaagtcatcatcatgaatcaccctggccagatcggaaatggctatgcaccagtgcttgattgccacacctcccacattgcagtcaagttcgccgaactcgtgaccaagatcgacaggcgatcaggtaaggagatcgagaaggagcccaaatttttgaagaatggtgatgcaggttatgttaagatgattccaaccaagcccatggttgttgaaaccttctctgagtatcctccccttggtcgttttgccgtgagggacatgcgtcagaccgtggctgtcggagtcatcaagagtgttgagaagaaagaccccactggagccaaggtcaccaaggctgctcagaagaagaagtgatcataaaaatcttgttcctttatagtcttagtcttaaaacccgggttcatggttcaattttcgttgttgtttattcctgagaggactatttttgtttttttgtttttatttttgatgtaagagtctgagttttacattttcacaaagcagacatagggttttagcccttgctgagagatgttttaaatgcttttaatttataagaaagttttgtcaatggttttatcggtttaacgtaagcctattttataatccaattatatattttaactattcaaata

SEQ ID NO: 460 - DNA, 1663 bp, Phaseolus vulgaris
gacttgtgtttctttgaattattttcagtttaactcgtcatgggtaaggaaaaggttcatatcaacattgtggtcattggacatgtcgactctgggaagtcaactaccaccggccacttgatctacaagcttggaggtattgacaagcgtgtgattgaaaggttcgagaaggaagctgctgagatgaacaagaggtcattcaagtatgcctgggtgcttgacaagctcaaggctgagcgtgaaagaggaattaccattgatattgctttgtggaaattcgaaaccaccaagtactactgcacagtcattgatgcccctggacatcgtgactttatcaagaacatgatcactggaacctcccaggctgattgcgctgtccttattattgattccacaactggtggttttgaagccggtatttccaaggatggacaaacccgtgagcatgctcttcttgctttcacccttggtgtgaagcagatgatctgttgctgtaacaagatggatgccactacccctaagtactccaaggctaggtatgatgaaatcatcaaggaagtttcatcatacttgaagaaggttggttacaacccagacaaaattccatttgtcccaatctctggatttgagggtgacaacatgattgagaggtccaccaaccttgactggtacaagggacccactctccttgaagcccttgaccaaatcaatgagcccaagaggccctcagacaagcctctcaggcttcccttgcaggatgtctacaagattggtggtattggtaccgtgccagtgggacgtgttgaaaccggtgtcatcaagccgggtatgctggtgacttttgctcccacaggtttgacaactgaagttaagtctgttgagatgcaccacgaggctctcctagaggctcttccaggtgacaatgtcggcttcaacgtgaagaacgttgctgtcaaggatctcaagcgtggtttcgttgcttccaactccaaggatgaccctgccaaggaagctgccaacttcacatcccaagtcatcatcatgaatcaccctggccagatcggaaatggctatgcaccagtgcttgattgccacacctcccacattgcagtcaagttcgccgaactcgtgaccaagatcgacaggcgatcaggtaaggagatcgagaaggagcccaaatttttgaagaatggtgatgcaggttatgttaagatgattccaaccaagcccatggttgttgaaaccttctctgagtatcctccccttggccgttttgccgtgagggacatgcgtcagaccgtggctgtcggagtcatcaagagtgttgagaagaaagaccccactggagccaaggtcaccaaggctgctcagaagaagaagtgatcataaaaatcttgttcctttatagtcttagtcttaaaacccgggttcatggttcaattttcgttgttgtttattcctgagaggactatttttgtttttttgtttttatttttgatgtaagagtctgagttttacattttcacaaagcagacatagggttttagcccttgctgagagatgttttaaatgcttttaatttataagaaagttttgtcaatggttttatcggtttaacgtaagcctattttataatccaattatatattttaactattcaaat

SEQ ID NO: 461 - DNA, 1777 bp, Vigna unguiculata
cttctcgcggctagggtttaagagcagcttctttctcttcaagatcttaattgtttcaatttagaggactaatgggtaaagagaaggttcatattaacattgtggtcattggccatgtggactctggaaagtcaactaccaccggtcacctcatctacaagcttggaggtattgacaagcgtgtgatagagagattcgagaaagaagctgctgagatgaacaagaggtcattcaagtatgcctgggttcttgacaagctcaaggctgagcgtgaaagaggaatcaccattgacattgctctctggaagtttgagaccaccaagtactactgcacagtcattgatgcccccggacacagggatttcattaagaatatgattactgggacatcccaagctgactgcgctgttcttatcattgattccaccactggtggttttgaagctggtatctccaaggatggacagactcgtgaacatgctcttcttgcttttactcttggtgttaagcagatgatttgctgctgtaacaagatggatgccactacacctaaatactccaaggcaaggtatgatgaaattgtgaaggaagtttcttcgtatttgaagaaggtcggttacaaccctgacaagatcccttttgttcccatctctggttttgagggagataacatgattgagaggtctaccaaccttgactggtataagggtccaacccttctggaggctcttgataatatcaatgagccaaagaggccatcagacaagcctcttaggttaccccttcaggatgtgtacaagattggaggaattggaaccgtacctgttggacgtgttgaaactggtgtgttgaaacctggaatggttgttacctttgcaccaactggactgacaactgaagttaagtccgtggagatgcaccacgaagcactcactgaggctcttcccggtgacaatgtgggattcaacgtgaagaatgttgctgtgaaggatctgaagcgtggtttcgttgcctcaaactccaaggatgatcctgccaaggaggctgctaatttcacgtcccaagttatcatcatgaatcaccctgggcagattggaaatggctatgcacctgttcttgactgccacacctcccacattgccgtgaagtttgccgaactcgtgaccaagattgacaggcgatctggtaaagagctggagaaggagcccaaattcctgaagaacggagatgctggttttgtgaagatgattcccactaagcccatggtggttgaaaccttctctgaatatcctccacttggtcgttttgctgtgagagacatgcgtcaaactgtggctgtgggagtcatcaagagcgtggagaagaaggaccctactggagctaaagtcaccaaggctgcacagaagaagaaataaattgcgcagggtctatcaagaaatctgttattatgcctgtgataaatggtgtcttcttgtagacgctgttatttttcgtgtcaggatattgtttttcgtattttgtttgaggttttctccctcatctctcaaattttgttctcagaattgggttcttggtcgatgggggcagggtttagactttttttttttttctatgccttatttcttgtgtaatgtgtttttgtgagaacgtttataatttggtaagctacagtgatatttaggacgagccctataaagtttgggttttgaatgtcatgttatattttgttcttatttttagattagttctatgtgactaatttggtatttcctatggt

SEQ ID NO: 462 - DNA, 2616 bp, Humulus lupulus
aataaactcaagtgctcctccctcgctctatcgttcccaaagcttcattgttaagattctgtctcttctgctctcgttgaaaagaaaaggtaactcttcgcttcgccggagacgagcatcgtttagagtttttctatacatcgaaacgcaaggaaactctgtttcagtcatgtcttcgtcctcaaagaagatcatcctcaagagctctgacggcgagtcgtttgaggtcgaagaggcggttgcgcttcagtcccagacgatcaagcatatgatcgaagacgattgtgctgataacggcattcctctgcctaacgtgacaagcaaaattcttgctaaggtcatcgagtactgtaggaagcacgttgattcccccaaccctgatgagcgcgtcgccgacgacgatcttaagtcttgggatgcagagttcgtcaaggttgaccaggccacgctctttgaccttattctgtctgcaaactaccttaacatcaagaacctgcttgacttgacatgccaaactgtggctgatatgatcaaaggaaagactccagaggagatcaggaagacattcaacatcaagaatgatttcactccagaggaagaggaagaggtccgccgggagaaccagtgggcttttgaatgattattatatgtaactaagtggggattattattttgaattgaaatggttgaaaatattttctagtggggggcttctagttttacgttagtcttagttggttagcttttctcctcacctttctctagtactcctttaatctttttgttgtcttaattttgtcgtcgtttgatttctgaaacttcttttgagccctctaattgtaaagaattgctggatactggatggtattatgatggtggtttgtcttgcttatcaatttatgttatgaaatctagttttttcctctatcggccgaaactctgctttctctcgcttcacacatccaagtcggcgagagactctcattcttcttcacttcgaggtattttctgcagcaacttagaatgggaaaagaaaaggttcacatcaacatcgtggtcattggccatgtcgactcaggaaagtcgaccaccactggtcatttgatctacaagcttggaggtattgacaagcgtgtcattgagaggttcgagaaggaggctgctgagatgaacaaaaggtcattcaagtatgcctgggtattggacaagctcaaggctgagcgtgagcgtggtattaccattgatattgccttgtggaagttcgagaccaccaagtactactgcactgtcattgatgccccaggacatcgtgactttatcaagaacatgattactggtacctctcaagccgactgtgctgtcctcattattgactccaccaccggaggttttgaggctggtatttccaaggatgggcagacccgtgagcacgcattgctggctttcactcttggtgtgaagcagatgatttgctgctgcaacaagatggatgccactacccccaagtattctaaggctaggtacgatgaaattgttaaggaggtttcatcttacttgaagaaggttggttacaacccagacaaaattgcatttgtcccaatctctggttttgagggtgacaacatgattgagaggtctaccaaccttgactggtacaagggaccaacccttcttgaggctcttgaccaaatcaatgagcccaagaggcccacagacaagccccttcgtctcccacttcaggatgtgtacaagataggcggtattggaactgtgcccgtcggacgtgttgagactggtgttatcaagcctggtatggttgtgacctttggccccactggtctgactactgaagttaagtctgttgagatgcaccatgaagctcttctagaggctcttccaggtgacaatgttggattcaatgttaagaatgttgctgtcaaggatcttaagagaggttttgttgcctccaactccaaggatgaccctgctaaggaagctgccaacttcacatcccaggtcatcatcatgaaccaccctggtcagattggaaacggttatgctccagtgctggattgccacacctctcacattgctgttaagtttgctgagcttgttaccaagattgacaggcgttctggtaaggagcttgagaaggagcccaagtttttgaagaacggtgatgctggtattattaagatgattcccaccaagcccatggttgtggagactttctctgagtaccctcctcttggtcgttttgccgtgagggacatgcgtcagaccgttgctgtcggagtcatcaaggctgttgagaagaaggacccatcaggcgccaaggtcaccaagtctgctgtcaagaagaagtgaagtgttgtttaggagtttttatagttaggctagttttgtctctggtctttgcctttcgattttgttttgctttaatatgcggacaattatatgggtttgcattgcagtgagttgagcaacagatgcctttctgtttgcttggcaagcttttgatgtgagctttcgtttttaattatcgttttttgctttaatatcattgagaatgagttgtctagttgattgtcgatgaacaactacatttaaatttta

SEQ ID NO: 463 - DNA, 2557 bp, Humulus lupulus
aagcttcattgttaagattctggctcttctgctctcgttgaaaagaaaaggtaactcttcgcttcgccggagaagagcatcgtttagagtttttctatacatcgaaacgcaaggaaactctgtttcagtcatgtcttcgtcctcaaagaagatcatcctcaagagctctgacggcgagtcgtttgaggtcgaagaggcggttgcgcttcagtcccagacgatcaagcatatgatcgaagacgattgtgctgataatggcattcctctgcctaacgtgacaagcaaaattcttgctaaggtcatcgagtactgtaggaagcacgttgattcccccaaccctgatgagcgcgtcgccgacgacgatcttaagtcttgggatgcagagttcgtcaaggttgaccaggccacgctctttgaccttattctgtctgcaaactaccttaacatcaagaacctgcttgacttgacatgccaaactgtggctgatatgatcaaaggaaagactccagaggagatcaggaagacattcaacatcaagaatgatttcactccagaggaagaggaagaggttcgccgggagaaccagtgggcttttgaatgattattatatataactaagtggggattattattttgaattgaaatggttgaaaatatgttctagtggggggcttctagttttacgttagtcttagttggttagcttttctcctcacctttctctagtactcctttaatctttttgttatcttaattttgtcgtcgtttgatttctgaaacttcttttgggccctctaattgtaaagaattgctggatactggttggtattatgatggtggtttgtcttgcttatcaatttatgttatgaaatctagttttttcctctatcggccgaaactctgctttctctcgcttcacacatccaagtcggcgagagactctcattcttcttcacttcgaggtattttctgcagcaacttagaatgggaaaagaaaaggttcacatcaacatcgtggtcattggccatgtcgactcaggaaagtcgaccaccactggtcatttgatctacaagcttggaggtattgacaagcgtgtcattgagaggttcgagaaggaggctgctgagatgaacaaaaggtcattcaagtatgcctgggtattggacaagctcaaggctgagcgtgagcgtggtattaccattgatattgccttgtggaagttcgagaccaccaagtactactgcactgtcattgatgccccaggacatcgtgactttatcaagaacatgattactggtacctctcaagccgactgtgctgtcctcattattgactccaccaccggaggttttgaggctggtatttccaaggatgggcagacccgtgagcacgcattgctggctttcactcttggtgtgaagcagatgatttgctgctgcaacaagatggatgccactacccccaagtattctaaggctaggtacgatgaaattgttaaggaggtttcatcttacttgaagaaggttggttacaacccagacaaaattgcattcgtcccaatctctggttttgagggtgacaacatgattgagaggtctaccaaccttgactggtacaagggaccaacccttcttgaggctcttgaccaaatcaatgagcccaagaggcccacagacaagccccttcgtctcccacttcaggatgtgtacaagataggcggtattggaactgtgcccgtcggacgtgttgagactggtgttatcaagcctggtatggttgtgacctttggccccactggtctgactactgaagttaagtctgttgagatgcaccatgaagctcttctagaggctcttccaggtgacaatgttggattcaatgttaagaatgttgctgtcaaggatcttaagagaggttttgttgcctccaactccaaggatgaccctgctaaggaagctgccaacttcacatcccaggtcatcatcatgaaccaccctggtcagattggaaacggttatgctccagtgctggattgccacacctctcacattgctgttaagtttgctgagcttgttaccaagattgacaggcgttctggtaaggagcttgagaaggagcccaagtttttgaagaacggtgatgctggtattattaagatgattcccaccaagcccatggttgtggagactttctctgagtaccctcctcttggtcgttttgccgtgagggacatgcgtcagaccgttgctgtcggagtcatcaaggctgttgagaagaaggacccatcaggcgccaaggtcaccaagtctgctgtcaagaagaagtgaagtgttgtttaggagtttttatagttaggctagttttgtctctggtctttgcctttcgattttgttttgctttaatatgcggacaattatatgggtttgcattgcagtgagttgagcaacagatgcctttctgtttgcttggcaagcttttgatgtgagcttcgtttttaattatcgttttttgctttaatatcattgagaatgagttgtctagttgattgtcgatgaa

SEQ ID NO: 464 - DNA, 1684 bp, Humulus lupulus
ccgaaactctgctttctctcgcttcacacatccaagtcggcgagagactctccttcttcttcacttcgaggtattttctgcagtaacttagaatgggaaaagaaaaggttcacatcaacatcgtggtcattggccatgttgactcaggaaagtcgaccaccactggtcatttgatctacaagcttggaggtattgacaagcgtgtcattgagaggttcgagaaggaggctgctgagatgaacaaaaggtcattcaagtatgcctgggtgttggacaagctcaaggctgagcgtgagcgtggtattaccattgatattgccttgtggaagttcgagaccaccaagtactactgcactgtcattgatgccccaggacatcgtgactttatcaagaacatgattactggtacctctcaggctgactgtgccgtcctcattattgactccaccaccggaggttttgaggctggtatttccaaggatgggcagacccgtgagcacgcattgctggctttcactcttggtgtgaagcagatgatttgctgctgcaacaagatggatgccactacccccaagtattctaaggctaggtacgatgaaatcgttaaggaggtttcctcttacttgaagaaggttggttacaacccagacaaaattgcattcgtcccaatatctggttttgagggtgacaacatgattgagaggtctaccaaccttgactggtacaagggaccaacccttcttgaggctcttgaccaaatcaatgagcccaagaggcccacagacaagccccttcgtctcccacttcaggatgtgtacaagatcggtggtattggaactgtgcctgttggacgtgttgagactggtgttatcaagcctggtatggttgtgacctttggccccactggtctgactactgaagttaagtctgttgagatgcaccatgaagctcttctagaggctcttccaggtgacaatgttggattcaatgttaagaatgttgctgtcaaggatcttaagagaggttttgttgcctccaactccaaggatgaccctgctaaggaagcagccaacttcacatcccaggtcatcatcatgaaccaccctggtcagattggaaacggttatgctccagtgctggattgccacacctctcacattgctgttaagtttgctgagcttgttaccaagattgacaggcgttctggtaaggagcttgagaaggagcccaagtttttgaagaacggtgatgctggtattattaagatgattcccaccaagcccatggttgtggagactttctctgagtaccctcctcttggtcgttttgccgtgagggacatgcgtcagaccgttgctgtcggagtcatcaaggctgttgagaagaaggacccatcaggcgccaaggtcaccaagtctgctgtcaagaagaagtgaagtgttgtttaggagtttttatagttaggctagttttgtctctggtctttgcctttcgattttgttttgctttaatatgcggacaattatatgggtttgcattgcagtgagttgagcaacagatgcctttctgtttgcttggcgagcttttgatgtgagctttcgtttttaattatcgttttttgctttaatatcattgagaatgagttgtctagttgattgtcgatgaacagctacatttaaatttt

SEQ ID NO: 465 - DNA, 1759 bp, Zea mays
gagcaaataacattgtcattcagtcatcccatatactatgtctcgctccgtttatgggccctgggccgccattcggaagtcaagtattgggctggtccggccactccgacacccttatataaagtcccgaaccctagaggccagcaccttcctccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaataagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaggcacgttatgaagagattgtgaaggaagtctcatcctacctcaagaaagttgggtacaaccctgataagattgcctttgttcccatttctggttttgagggtgacaacatgattgagaggtccaccaaccttgactggtacaaaggcccaaccctgcttgaggctcttgaccagatcaccgagcccaagaggccttcagacaagcccctgcgtctgcccctccaggatgtgtacaagattggtggtattggaactgtaccggttggtcgtgtggagactggtgtcatcaagcctggtatggttgtcacctttggtccaactggcctgactaccgaggtgaagtctgttgagatgcaccacgaggcgcttcaggaggctcttccgggtgacaatgttggcttcaacgtgaagaacgttgctgtcaaggatctcaagcgtgggtttgtggcctccaactccaaggatgaccctgccaaggaggctgccagcttcacctcccaggtcatcatcatgaaccaccctgggcagattggcaacggctatgccccagtgctggactgccacacctcccacattgctgtcaagtttgctgagctcattaccaagatcgacaggcggtctggcaaggagcttgagaaggagccaaagttcctgaagaacggtgatgctggtatggtgaagatgataccgaccaagcccatggtggtggagacgttctcagcgtatcctccccttggtaggtttgctgtccgtgacatgaggcagacggttgctgttggagttatcaagagtgtggagaagaaggacccgaccggcgccaaggtgaccaaggcggctgccaagaagaaatgatgcgatcctgcgcctgctttagcaatacctagttttcatcatcacaagttttgtttgtgatcgttgctgttatcgtgtgaactgttgagatctgttagcatgtgcacttttatctatttatttggtaccatcttgctatttcaccttttgcaatacaagaatgctctaagacctatatgttaaccttt

SEQ ID NO: 466 - DNA, 1670 bp, Zea mays
agattgggctggtccggccactccgacacccttatataaagtcccgaaccctagaggccagcaccttcctccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggttcgagaaggaggctgctgaaatgaacaagcggtccttcaagtacgcgtgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaggcacgttatgaagagattgtgaaggaagtctcatcctacctcaagaaagttgggtacaaccctgataagattgcctttgttcccatttctggttttgagggcgacaacatgattgagaggtccaccaaccttgactggtacaaaggcccaaccctgcttgaggctcttgaccagatcaccgagcccaagaggccttcggacaagcccctgcgtctgcccctccaggatgtgtacaagattggtggtattggaactgtaccggttggtcgtgtggagactggtgtcatcaagcctggtatggtagtcacctttggtccaactggcctgactaccgaggtgaagtctgttgagatgcaccacgaggcacttcaggaggctcttccgggtgacaatgttggcttcaacgtgaagaatgttgctgtcaaggatctcaagcgtgggtttgtggcctccaactccaaggatgaccctgccaaggaggctgccagcttcacctcccaggtcatcatcatgaaccaccctgggcagattggcaacggctatgcccctgtgctggactgccacacctcccacatcgctgtcaagtttgctgagctcattaccaagatcgacaggcgctctggcaaggagcttgagaaggagccaaagttcctgaagaacggtgatgctggtatggtgaagatgatacccaccaagcccatggtggtggagacattctcagcgtatcctccccttggtaggtttgctgtccgtgacatgaggcagacggttgctgttggagttatcaagagtgtggagaagaaggacccaaccggcgccaaggtgaccaaggctgctgccaagaagaaatgatgcgatcctgcgcctgctttagcaatacctagttttcatcattacaagttttgtttgtggtcgttgctgttattgtgtgaactgttgagctctgttagcctgtgcacttttatctatttatttggtaccttcttgctatttcaccttctgcaatacaagaatgctgtaagagctatatgtta

SEQ ID NO: 467 - DNA, 1600 bp, Pennisetum glaucum
cctctcccctccctcttcttctccgccgctccgcgagattaacctttgcttttagccatgggcaaggagaagagtcacattaacatcgtggtcattggccatgtcgactctggcaagtcgaccaccactggccacctgatctacaagcttggaggtattgacaagcgtgtgatcgagaggttcgagaaggaggccgcagaaatgaacaagaggtccttcaagtatgcgtgggtgcttgacaagctgaaggctgagcgtgaaagaggtatcaccatcgacattgccctgtggaagttcgagaccaccaagtactactgcacggtcatcgatgcccctggtcaccgtgacttcatcaagaacatgattaccggcacctcccaggccgactgtgctgtcctcatcattgactctaccactggtggttttgaggctggtatctctaaggatggccagacccgtgagcatgctctccttgctttcactcttggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctgcgtctcccccttcaggacgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcctggtgacaatgttggtttcaatgtgaagaacgttgctgtgaaggatctcaagcgtggttatgtggcctccaactccaaggatgaccctgccaaggaggctgccagcttcacctcccaggtcatcatcatgaaccaccctgggcagatcggcaatggctatgccccagtgctggactgccacacctcccacattgctgtcaagtttgctgagcttgtcaccaagatcgacaggcggtctggtaaggagctcgagaaggagcccaagtttctgaagaacggtgatgctggtatggtgaagatgattcccacgaagcccatggttgtggagacattctctgagtacccccctcttggtcgctttgctgttcgtgacatgaggcagacggttgctgttggtgtcatcaagagcgtcgagaagaaggatcccactggtgccaaggttaccaaggctgctgccaagaagaaatgaggggtctgagggttattgtcgtcgtagtagtcctagtgcggttttgaggttttgttaggccattgttcttgcagcagggccttgcagttccacgcgactgtaatttctgctggcaatgcgctctactgtctggtgtctatgtaaacgctactgttatttggttgtggtgaaacctttactggctgattcataatttcat

SEQ ID NO: 468 - DNA, 1637 bp, Pennisetum glaucum
gccgccgccgtccctccctcccgatcctcttcttctacgcgagattaagctttgcttttagccatgggtaaggagaagagtcacattaacattgtggtcattggccatgtcgactctggcaagtcgaccaccactggccacctgatctacaagcttggaggtattgacaagcgtgtgatcgagaggttcgagaaggaggccgcggaaatgaacaagaggtccttcaagtacgcgtgggtgcttgacaagctgaaggctgagcgtgagagaggtatcaccatcgacattgccctgtggaagttcgagaccaccaagtactactgcacggtcatcgatgcccctggtcaccgtgacttcatcaagaacatgattaccgggacctcccaggctgactgcgctgtcctcatcattgactctaccactggtggttttgaggctggtatctctaaggatggccagacccgtgagcatgctctccttgctttcactcttggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctccggtttcgagggtgacaacatgattgagaggtccaccaaccttgactggtacaagggcccaaccctgcttgaggctctggaccagatcaacgagcccaagaggccctccgacaagcccctgcgtctcccccttcaggatgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaatgttgctgtgaaggatctcaagcgtgggtacgtggcgtccaactccaaggacgaccctgccaaggaggctgccagcttcacctcccaggtcatcatcatgaaccaccctgggcagatcggcaatggctatgccccagtgctggactgccacacctcccacatcgctgtcaagtttgctgagcttgtcaccaagattgacagacgatctggtaaggagcttgagaaggagcccaaattcctgaagaatggtgatgctggtatggtgaagatgattcccacgaagcccatggttgtggagacattctctgagtaccctcctcttggtcgctttgctgttcgtgacatgaggcagacggttgctgttggtgtcatcaagagtgtggagaagaaggaccccactggtgccaaggttaccaaggctgctgctaagaagaaatgagaggtctgagggttgttatcgtctgctggttttcatctatcttagtagtcttagtgctgttttaagctttgttaggccattgtctttgcagttggtagcaactgtaatttctgctggcaatgtgccctagtctgctgtcctgtaaactctactgttattttggttgtggttaaacctggctactttgagtgagttgaacgctctgtagtaacaatcttgctattcagcac

SEQ ID NO: 469 - DNA, 1553 bp, Pennisetum glaucum
ctccgcgagattaagctttgcttttagccatgggtaaggagaagagtcacattaacattgtggtcattggccatgtcgactctggcaagtcgaccaccactggccacctgatctacaagcttggaggtattgacaagcgtgtgatcgagaggttcgagaaggaggccgcagaaatgaacaagaggtccttcaagtatgcgtgggtgcttgacaagctgaaggctgagcgtgaaagaggtatcaccatcgacattgccctgtggaagttcgagaccaccaagtactactgcacggtcatcgatgcccctggtcaccgtgacttcatcaagaacatgattaccggcacctcccaggccgactgtgctgtcctcatcattgactctaccactggtggttttgaggctggtatctctaaggatggccagacccgtgagcatgctctccttgctttcactcttggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctccgtctcccccttcaggacgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaacgttgctgtgaaggatctcaagcgtgggtacgtggcctccaactccaaggacgaccctgccaaggaggctgccagcttcacctcccaggttatcatcatgaaccaccctgggcagattggcaacgggtatgcaccagtgctggactgccacacctcccacatcgctgtcaagtttgctgagcttgtcaccaagatcgacagacgatctggtaaggagctcgagaaggagcccaagttcctgaagaacggtgatgctggtatggtgaagatgattcccacgaagcccatggttgttgagacattctctgagtaccctcctcttggtcgctttgctgttcgggacatgaggcagacggttgctgttggtgtcatcaagagcgtcgagaagaaggaccccactggtgccaaggttaccaaggctgctgccaagaagaaatgagagggttgacattgtctgctgtgtttcatctatcttagtactcttgctgttttaagctttgttatgctattgttcttgcagcagggccttgcagttgcgtgcaactgtaatatctgctggcaatgcgccctattgtctggtgttgctgtaaacggtactcttatttttggatactgtgag

SEQ ID NO: 470 - DNA, 2434 bp, Pennisetum glaucum
taaccgaagggcacccaatggaaatgaggaatagatcgcaacgccagtgcgtggcactagatacattctattctatgtacaatggccaacgccaaacatactgtcaaataagatgtcaaaaaaaggatttgccgcaatggatatatatttatatggtacaagctacaatcaagcgtgtgaatattttgtcagactcctcaaatcatcacatcttcctcaggttgtcaagccgcgcctgcaagtcgtcatcgattccaccatccggcccgcccgcggcttcagcttgagcagcaggaactttgcctgctgccaccggtttagcaactgcagttgcaggagccttcacaagctctgagttgatatcaatgccaatttcatcaaggacttggttgactagctcttctgtttcttcctcctcctcgtcgccctccaacgcatcatcgatggcgtcgttcatcacatcactgaccatctccatcctctcattttgcatctcgaactcccgcattatcttctgcagagctggcaggttcatctgtctgttcatttgtcccatggcttttgtgacacccttcatagcttcacccattgcttgtgttgatttcaaagtctgaatgcgaagagatacgccttgtagctgggatttcagggcataaaactttgtgatctggtgccttgtgcggataaggtccttggccataatttttacagctcccatctgtccctgcttggccaccttcttgatctcgttgatgagcttcttctcctgggtctgcaggccctgcctctccctctcgatctccctgatggacttgtccagcatccgcttgttctcccgcagcagccgttcccccgcatcctctccttctccgccgctccgcgagattaagctttgtttttagccatgggaaaggagaagagtcacattaacatcgtggtgattggccatgtcgactctggcaagtcgaccaccactggccacctgatctacaagcttggaggtattgacaagcgtgtgatcgagaggttcgagaaggaggccgcagaaatgaacaagaggtccttcaagtacgcgtgggtgcttgacaagctgaaggctgagcgtgagagaggtatcaccatcgacattgccctgtggaagttcgagaccaccaagtactactgcactgttatcgatgcccctggtcaccgtgacttcatcaagaacatgattaccggcacctcccaggccgactgtgctgtcctcatcattgactctaccactggtggttttgaggctggtatctctaaggatggccagacccgtgagcatgctctccttgctttcactctgggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctccggtttcgagggtgacaacatgattgagaggtccaccaaccttgactggtacaagggcccaaccctgcttgaggctctggaccagatcaacgagcccaagaggccctccgacaagcccctgcgtctcccccttcaggatgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaatgttgctgtgaaggatctcaagcgtgggtacgtggcgtccaactccaaggacgaccctgccaaggaggctgccagcttcacctcccaggttatcatcatgaaccaccctgggcagattggcaatgggtatgcaccagtgctggactgccacacctcccacatcgctgtcaagtttgctgagcttgtcaccaagatcgacagacgatctggtaaggagcttgagaaggagcccaaattcctgaagaacggtgatgctggtatggtgaagatgattcccacgaagcccatggttgtggagacattctctgagtaccctcctcttggtcgttttgctgttcgtgacatgaggcagactgttgctgttggtgtcatcaagagcgtcgagaagaaggatcccactggtgccaaggttaccaaggctgctgccaagaagaaatgaggggtctgagggttattgtcgtcgtagtagtcctagtgcggttttgaggttttgttaggccattgttcttgcagcagggccttgcagttgcacgcgactgtaatttctgctggcaatgcgctctactgtctggtgtctatgtaaacgctactgttatttggttgtggtgaaacctttacttgctga

SEQ ID NO: 471 - DNA, 1678 bp, Pennisetum glaucum
ctggggttcgccggcgccagcaccaccctgccgtccctccctcccgatcctcttcttctacgcgagattaagctttgcttttagccatgggtaaggagaagagtcacattaacatcgtggtcattggccatgtcgactctggcaagtcgaccaccactggccacctgatctacaagcttggaggtattgacaagcgtgtgatcgagaggttcgagaaggaggccgcagaaatgaacaagaggtccttcaagtacgcgtgggtgctcgacaagctgaaggctgagcgtgagagaggtatcaccatcgacattgccctgtggaagtttgagaccaccaagtactactgcacggtcatcgatgcccctggtcaccgtgacttcatcaagaacatgattaccggtacctcccaggccgactgtgctgtcctcatcattgactccaccactggtggttttgaggctggtatctctaaggatggccagacccgtgagcatgctctccttgctttcactcttggagtgaagcaaatgatctgctgctgtaacaagatggatgccaccactcccaagtactccaaggcccgttatgatgagattgttaaggaagtctcctcgtacctcaagaaggtgggttacaacccagacaagattgccttcgtccccatctccggtttcgagggtgacaacatgattgagaggtccaccaaccttgactggtacaagggcccaaccctgcttgaggctctggaccagatcaacgagcccaagaggccctccgacaagcccctgcgtctcccccttcaggatgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaatgttgctgtgaaggatctcaagcgtggttatgtggcctccaactccaaggatgaccctgccaaggaggctgccagcttcacctcccaggttatcatcatgaaccaccctgggcagattggcaacgggtatgcaccagtgctggactgccacacctcccacattgctgtcaagtttgctgagcttgtcaccaagatcgacaggcggtctggtaaggagcttgagaaggagcccaaattcctgaagaatggtgatgctggtatggtgaagatgattcccacgaagcccatggttgtggagacattctctgagtaccctcctcttggtcgttttgctgttcgtgacatgaggcagactgttgctgttggtgtcatcaagagtgtggagaagaaggatcccactggtgccaaggttaccaaggctgctgccaagaagaaatgagaggtctgagggttgttatcgtctgctggttttcatctatcttagcagtcttagtgctgttttaagctttgttaggccattgtttttgcagttggtagcaactgtaatttctgctggcaatgtgccctagtctgctgtcctgtaaacgctactgttattttggttgtggttaaacctggctactttgagtgagttaaacgctctgtagtaacaatcttgctgttctgcacctaaaaagggtgttttcg

SEQ ID NO: 472 - DNA, 1569 bp, Pennisetum glaucum
attaacctttgcttttagccatgggcaaggagaagagtcacattaacatcgtggtcattggccatgtcgactctggcaagtcgaccaccactggccacctgatctacaagcttggaggtattgacaagcgtgtgatcgagaggttcgagaaggaggccgcagaaatgaacaagaggtccttcaagtatgcgtgggtgcttgacaagctgaaggctgagcgtgaaagaggtatcaccatcgacattgccctgtggaagttcgagaccaccaagtactactgcacggtcatcgatgcccctggtcaccgtgacttcatcaagaacatgattaccggcacctcccaggccgactgtgctgtcctcatcattgactctaccactggtggttttgaggctggtatctctaaggatggccagacccgtgagcatgctctccttgctttcactcttggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctccgtctcccccttcaggacgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaacgttgctgtgaaggatctcaagcgtgggtacgtggcctccaactccaaggacgaccctgccaaggaggctgccagcttcacctcccaggttatcatcatgaaccaccctgggcagattggcaacgggtatgcaccagtgctggactgccacacctcccacatcgctgtcaagtttgctgagcttgtcaccaagatcgacagacgatctggtaaggagctcgagaaggagcccaagttcctgaagaacggtgatgctggtatggtgaagatgattcccacgaagcccatggttgttgagacattctctgagtaccctcctcttggtcgctttgctgttcgggacatgaggcagacggttgctgttggtgtcatcaagagcgtcgagaagaaggaccccactggtgccaaggttaccaaggctgctgccaagaagaaatgagagggttgacattgtctgctgtgtttcatctatcttagtactcttgctgttttaagctttgttatgctattgttcttgcagcagggccttgcagttgcgtgcaactgtaatatctgctggcaatgcgccctattgtctggtgttgctgtaaacggtactcttatttttggatactgtgagttacgaatggttctgtggtgacaat

SEQ ID NO: 473 - DNA, 1414 bp, Pennisetum glaucum
gccgccgtccctctcccctccctcttcttctccgccgctccgcgagattaacctttgcttttagccatgggcaaggagaagagtcacattaacatcgtggtcattggccatgtcgactctggcaagtcaaccaccactggccacctgatctacaagcttggaggtattgacaagcgtgtgatcgagaggttcgagaaggaggccgcagaaatgaacaagaggtccttcaagtatgcgtgggtgcttgacaagctgaaggctgagcgtgaaagaggtatcaccatcgacattgccctgtggaagttcgagaccaccaagtactactgcacggtcatcgatgcccctggtcaccgtgacttcatcaagaacatgatcaccggcacctcccaggctgactgtgctgtcctcatcattgactctaccactggtggttttgaggctggtatctctaaggatggccagacccgtgagcatgctctccttgctttcactcttggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctccgtctcccccttcaggacgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaacgttgctgtgaaggatctcaagcgtgggtacgtggcttccaactccaaggacgaccctgccaaggaggctgccagcttcacctcccaggttatcatcatgaaccaccctgggcagattggcaacgggtatgcgccagtgctggactgccacacctcccacatcgctgtcaagtttgctgagcttgtcaccaagatcgacagacgatctggtaaggagcttgagaaggagcccaaattcctgaagaacggtgatgctggtatggtgaagatgattcccacgaagcccatggttgttgagacattctctgagtaccctcctcttggtcgctttgctgttcgtgacatgaggcagacggttgctgttggcgtcatcaagagcgtggagaagaaggaccccactggtgccaaggttaccaaggctgctgctaagaagaaatgagggt

SEQ ID NO: 474 - DNA, 1660 bp, Pennisetum glaucum
aaggtctcgccgctgcctcgacagatgggctggcggctcccatacaaattattccaagctccaatcagagtacgcccaactggcgaacactttgacctacgcccaccgctctctccctaccccgcagcagccgttcccccgcatcctctccttctccgccgctccgcgagattaagctttgtttttagccatgggaaaggagaagagtcacattaacatcgtggtgattggccatgtcgactctggcaagtcgaccaccactggccacctgatctacaagcttggaggtattgacaagcgtgtgatcgagaggttcgagaaggaggccgcggaaatgaacaagaggtccttcaagtacgcgtgggtgcttgacaagctgaaggctgagcgtgagagaggtatcaccatcgacattgccctgtggaagttcgagaccaccaagtactactgcacggtcatcgatgcccctggtcaccgtgacttcatcaagaacatgattaccgggacctcccaggctgactgcgctgtcctcatcattgactctaccactggtggttttgaggctggtatctctaaggatggccagacccgtgagcatgctctgcttgctttcactcttggagtgaagcagatgatctgctgctgtaacaagatggatgccaccactcccaagtactccaaggcccgttatgatgagattgttaaggaagtctcctcgtacctcaagaaggtgggttacaacccagacaagattgccttcgtccccatctccggtttcgagggtgacaacatgattgagaggtccaccaaccttgactggtacaagggcccaaccctgcttgaggctctggaccagatcaacgagcccaagaggccctccgacaagcccctgcgtctcccccttcaggatgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaatgttgctgtgaaggatctcaagcgtgggtacgtggcgtccaactccaaggacgaccctgccaaggaggctgccagcttcacctcccaggttatcatcatgaaccaccctgggcagattggcaacgggtatgcgccagtgttggactgccacacctcccacatcgctgtcaagtttgctgagcttgtcaccaagattgacagacgatctggtaaggagcttgagaaggagcccaaattcctgaagaatggtgatgctggtatggtgaagatgattcccacgaagcccatggttgtggagacattctctgagtaccctcctcttggtcgctttgctgttcgtgacatgaggcagacggttgctgttggtgtcatcaagagtgtggagaagaaggaccccactggtgccaaggttaccaaggctgctgctaagaagaaatgagaggtctgagggttgttatcgtctgctggttttcatctatcttagtagtcttagtgctgttttaagctttgtcaggccattgttctcgcagctaggccttgcagttgtgagcaactgtaaattctg

SEQ ID NO: 475 - DNA, 1848 bp, Pennisetum glaucum
gccgccgcagaccagtagtgcacgagcggcgagcgcgccgtcaactgcgcctccgcctccgccccgcctccgcctcctcatctcccggcgccccctccttcgctttctcagtggtttaagcttcacctgtagccatgggtaaggagaagtcccatatcaacattgtggtcattggccacgtcgactctggcaagtcgaccaccaccggacacctgatctacaagcttggaggtatcgacaagcgtgtgatcgagaggttcgagaaggaggctgctgagatgaacaagcggtccttcaagtacgcgtgggtgcttgacaagctcaaggctgagcgtgagagaggtatcaccattgatattgccctgtggaagtttgagaccaccaagtactactgcactgtcattgacgcccctggacaccgtgacttcatcaagaatatgatcaccggtacctcacaggctgactgtgctgtccttatcattgactccaccactggtggttttgaggctggtatctccaaggatggccaaacccgtgagcatgctctccttgcttttactcttggagtgaagcagatgatttgctgctgcaacaagatggatgccaccactcccaagtactccaaggcccgttatgatgagattgttaaggaagtctcctcatacctcaagaaggtcggttacaaccctgacaagattgcctttgtccctatctctggttttgagggtgacaacatgattgagaggtccaccaatcttgactggtacaagggcccaaccctgcttgaggctctggaccagatcaacgagcccaagaggccttcagacaagcccctgcgtctcccccttcaggatgtgtacaagatcggtggtattggaactgtccctgttggacgtgttgagactggtgtcatcaagcctggtatggttgtcaccttcggtccaactggcctgactactgaggttaagtctgttgagatgcaccacgaggctctccaggaggcccttcccggtgacaatgttggcttcaacgtgaagaacgttgctgtcaaggatctcaagcgtgggtacgtggcctccaactccaaggatgaccctgccaaggaggctgccagctttacctcgcaggtcatcatcatgaaccaccctgggcagatcggcaacggctatgccccagtgctggactgccacacctcccacattgctgtcaagttcgctgagcttgttaccaagatcgacagacgatccggtaaggagcttgagaaggagcctaagttcctgaagaatggtgatgctggtatggtgaagatgattcccacgaagcccatggtggtggagaccttctctgagtaccctccacttggtcgttttgctgtccgtgacatgaggcaaacggttgctgttggagtcatcaagagtgtggagaagaaggacccgaccggggccaaggtgaccaaggctgcagccaagaagaaatgatcatcttatggttgattccgccagaggctattgtattgcttaagttttgtccagggccattgctgttctcatgaactatatctctgctgccaatttgcccccgatctgttactctgcttttacgtttacatgcagttttaatatttgaactccgcgaaacttaaattacctgagattgatgtgtctgttggtggttgttctatgccagctaatttgcttggtagtttgttatgttcaactacatgcagatctcatcgtcctctaataaattctgccctgtttgttattggcattgtcgtcttcactgttcaattaggattgccactgctgcaagcagtgtatgtacgatttgttatctgatttgatagtt

SEQ ID NO: 476 - DNA, 1457 bp, Pennisetum glaucum
ccatgggtaaggagaagtcccacatcaacatcgtggtcattggccatgtcgactctggcaagtcgaccaccactggccacctgatctacaagcttggaggtattgacaagcgtgtgatcgagaggttcgagaaggaggccgcagaaatgaacaagaggtccttcaagtacgcgtgggtgcttgacaagctgaaggctgagcgtgagagaggtatcaccatcgacattgccctgtggaagttcgagaccaccaagtactactgcactgttatcgatgcccctggtcaccgtgacttcatcaagaacatgattaccggcacctcccaggccgactgtgctgtcctcatcattgactctaccactggtggttttgaggctggtatctctaaggatggccagacccgtgagcatgctctccttgctttcactcttggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctgcgtctcccccttcaggacgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaatgttgctgtgaaggatctcaagcgtgggtacgtggcgtccaactccaaggacgaccctgccaaggaggctgccagcttcacctcccaggttatcatcatgaaccaccctgggcagattggcaacgggtatgcaccagtgctggactgccacacctcccacatcgctgtcaagtttgctgagcttgtcaccaagatcgacagacgatctggtaaggagctcgagaaggagcccaagttcctgaagaacggtgatgctggtatggtgaagatgattcccacgaagcccatggttgttgagacattctctgagtaccctcctcttggtcgctttgctgttcgggacatgaggcagacggttgctgttggtgtcatcaagagcgtcgagaagaaggaccccactggtgccaaggttaccaaggctgctgccaagaagaaatgagaggtctgagggttgttatcgtctgctggttttcatctatcttagtagtcttagtgctgttttaagctttgtcaggccattgttctcgcagctaggccttgcagttgtgag

SEQ ID NO: 477 - DNA, 1668 bp, Pennisetum glaucum
cgaggcaagcacacgagaggcgagtcgccagcgcaccgtcacctccgcctccgcttctcgacgccgcttcctcagcggcttaaggttcacctgcgaccatgggtaaggagaagagtcacattaacatcgtggtcattggccatgtcgactctggcaagtcgaccaccactggccacctgatctacaagcttggaggtattgacaagcgtgtgatcgagaggttcgagaaggaggccgcagaaatgaacaagaggtccttcaagtatgcgtgggtgcttgacaagctgaaggctgagcgtgaaagaggtatcaccatcgacattgccctgtggaagttcgagaccaccaagtactactgcacggtcatcgatgcccctggtcaccgtgacttcatcaagaacatgattaccggcacctcccaggccgactgtgctgtcctcatcattgactctaccactggtggttttgaggctggtatctctaaggatggccagacccgtgagcatgctctccttgctttcactcttggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctccgtctcccccttcaggacgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaacgttgctgtgaaggatctcaagcgtgggtacgtggcctccaactccaaggacgaccctgccaaggaggctgccagcttcacctcccaggttatcatcatgaaccaccctgggcagattggcaacgggtatgcaccagtgctggactgccacacctcccacatcgctgtcaagtttgctgagcttgtcaccaagatcgacagacgatctggtaaggagctcgagaaggagcccaagttcctgaagaacggtgatgctggtatggtgaagatgattcccacgaagcccatggttgttgagacattctctgagtaccctcctcttggtcgctttgctgttcgggacatgaggcagacggttgctgttggtgtcatcaagagcgtcgagaagaaggaccccactggtgccaaggttaccaaggctgctgccaagaagaaatgagagggttgacattgtctgctgtgtttcatctatcttagtactcttgctgttttaagctttgttatgctattgttcttgcagcagggccttgcagttgcgtgcaactgtaatatctgctggcaatgcgccctattgtctggtgttgctgtaaacggtactcttatttttggatactgtgagttacgaatggttctgtggtaacaatgtttgcggaattgcacctaaa

SEQ ID NO: 478 - DNA, 1638 bp, Pennisetum glaucum
cccgcagccgccgtccctctccctccctcttcttctccgccgctccgcgagattaacctttgcttttagccatgggcaaggagaagagtcacattaacatcgtggtcattggccatgtcgactctggcaagtcaaccaccactggccacctgatctacaagcttggaggtattgacaagcgtgtgatcgagaggttcgagaaggaggccgcagaaatgaacaagaggtccttcaagtatgcgtgggtgcttgacaagctgaaggctgagcgtgaaagaggtatcaccatcgacattgccctgtggaagttcgagaccaccaagtactactgcacggtcatcgatgcccctggtcaccgtgacttcatcaagaacatgatcaccggcacctcccaggctgactgcgctgtcctcatcattgactctaccactggtggttttgaggctggtatctctaaggatggccagacccgtgagcatgctctccttgctttcactcttggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctccgtctcccccttcaggacgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaacgttgctgtgaaggatctcaagcgtgggtacgtggcctccaactccaaggacgaccctgccaaggaggctgccagcttcacctcccaggttatcatcatgaaccaccctgggcagattggcaacgggtatgcgccagtgctggactgccacacctcccacatcgctgtcaagtttgctgagcttgtcaccaagatcgacagacgatctggtaaggagctcgagaaggagcccaagttcctgaagaacggtgatgctggtatggtgaagatgattcccacgaagcccatggttgttgagacattctctgagtaccctcctcttggtcgctttgctgttcgggacatgaggcagacggttgctgttggtgtcatcaagagcgtcgagaagaaggaccccactggtgccaaggttaccaaggctgctgccaagaagaaatgagagggttgacattgtctgctgtgtttcatctatcttagtactcttgctgttttaagctttgttatgctattgttcttgcagcagggccttgcagttgcgtgcaactgtaatatctgctggcaatgcgccctattgtctggtgttgctgtaaacggtactcttatttttggatactgtgagttacgaatggttctgtggtaacaatgtttgcggaattgcacct

SEQ ID NO: 479 - DNA, 1380 bp, Pennisetum glaucum
agattaacctttgcttttagccatgggcaaggagaagagtcacattaacatcgtggtcattggccatgtcgactctggcaagtcgaccaccactggccacctgatctacaagcttggaggtattgacaagcgtgtgatcgagaggttcgagaaggaggccgcagaaatgaacaagaggtccttcaagtatgcgtgggtgcttgacaagctgaaggctgagcgtgagagaggtatcaccatcgacattgccctgtggaagttcgagaccaccaagtactactgcacggtcatcgatgcccctggtcaccgtgacttcatcaagaacatgattaccgggacctcccaggctgactgcgctgtcctcatcattgactctaccactggtggttttgaggctggtatctctaaggatggccagacccgtgagcatgctctgcttgctttcactcttggagtgaagcagatgatctgctgctgtaacaagatggatgccaccactcccaagtactccaaggcccgttatgatgagattgttaaggaagtctcctcgtacctcaagaaggtgggttacaacccagacaagattgccttcgtccccatctccggtttcgagggtgacaacatgattgagaggtccaccaaccttgactggtacaagggcccaaccctgcttgaggctctggaccagatcaacgagcccaagaggccctccgacaagcccctgcgtctcccccttcaggacgtgtacaagatcggtggtattggaactgtccctgttggccgtgttgagactggtgtgatcaagcctggtatggttgtcacctttggtccaactggcctgaccactgaggttaagtctgttgagatgcaccacgaggctctccaggaggcccttcccggtgacaatgttgggttcaacgtgaagaatgttgctgtgaaggatctcaagcgtgggtacgtggcttccaactccaaggacgaccctgccaaggaggctgccagcttcacctcccaggttatcatcatgaaccaccctgggcagattggcaacgggtatgcgccagtgctggactgccacacctcccacatcgctgtcaagtttgctgagcttgtcaccaagatcgacagacgatctggtaaggagcttgagaaggagcccaagttcctgaagaacggtgatgctggtatggtgaagatgattcccacgaagcccatggttgttgagacattctctgagtaccctcctcttggtcgctttgctgttcgtgacatgaggcagacggttgctgttggcgtcatcaagagcgtggagaagaaggaccccactggtgccaaggttaccaaggctgctgctaagaagaaatgagggttctgaggatt

SEQ ID NO: 480 - DNA, 1555 bp, Pennisetum glaucum
aaacaaaagaatacaaatactactagatacaaaagaatacaaccctagttgcatctgtgggatttataattaattaattggataaatatagggggatcccctcccctaatcccagctcccaaccctaccccgcagccgccgtccctctcccctccctcttcttctccgccgctccgcgagattaacctttgcttttagccatgggcaaggagaagagtcacattaacatcgtggtcattggccatgtcgactctggcaagtcgaccaccactggccacctgatctacaagcttggaggtattgacaagcgtgtgatcgagaggttcgagaaggaggccgcagaaatgaacaagaggtccttcaagtatgcgtgggtgcttgacaagctgaaggctgagcgtgaaagaggtatcaccatcgacattgccctgtggaagttcgagaccaccaagtactactgcacggtcatcgatgcccctggtcaccgtgacttcatcaagaacatgattaccggcacctcccaggccgactgtgctgtcctcatcattgactctaccactggtggttttgaggctggtatctctaaggatggccagacccgtgagcatgctctccttgctttcactcttggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctgcgtctcccccttcaggacgtgtacaagattggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaacgttgctgtgaaggatctcaagcgtggttatgtggcctccaactccaaggatgaccctgccaaggaggctgccagcttcacctcccaggtcatcatcatgaaccaccctgggcagatcggcaatggctatgccccagtgctcgactgccacacctcccacattgctgtcaagtttgctgagcttgtcaccaagatcgacagacgatctggtaaggagcttgagaaggagcccaaattcctgaagaatggtgatgctggtatggtgaagatgattcccacgaagcccatggttgttgagacattctctgagtaccctcctcttggccgctttgctgttcgtgacatgaggcagactgttgctgttggtgtcatcaagagtgtggagaagaaggatcccaccggtgccaaggttaccaaggctgctgccaagaagaaatgagaggtctgagg

SEQ ID NO: 481 - DNA, 1853 bp, Cajanus cajan
atcactccgcattctcgctctatcgctcagtctgtttagttgcggctgaggatttctgaacgagcgaccttcgttcctcgcaagtttaagtcatcatgggtaaggaaaaggttcacattaacattgtcgtcattggacatgtcgactctggaaagtcaaccaccaccggtcacttgatctacaagcttggaggtattgacaagcgtgtgattgagaggttcgagaaggaagctgctgagatgaacaagaggtcattcaagtacgcctgggtgctcgacaagcttaaggctgagcgtgaaagaggaattaccattgatattgctctgtggaaattcgagaccaccaagtactactgcacagtcattgatgctcctggacatcgtgactttatcaagaacatgatcactggaacctcccaggctgattgtgctgtccttatcattgattccactactggtggttttgaagctggtatttccaaggatggacaaacccgtgagcatgctctgcttgcctttacacttggtgtcaagcaaatgatctgttgctgtaacaagatggatgccaccacacccaagtactctaaggctaggtatgatgaaattgttaaggaagtctcttcctacttgaagaaggttggttacaacccagacaagattccatttgttcccatctctggatttgagggtgacaacatgattgagaggtccaccaaccttgactggtacaagggaccaaccctccttgaggctcttgaccaaatcaacgagcccaagaggcccacagacaagcccctcaggcttccattgcaggacgtctacaagattggtggtattggtaccgtgccagttggaagagttgagaccggtgtcttgaagcccggtatggtggtgacttttggtcccactgggctgacaactgaagttaagtctgtggagatgcaccacgaggctctccaagaggctcttccaggtgacaatgtcggcttcaatgtgaagaacgttgcagtcaaggatctcaagcgtggtttcgttgcatccaactccaaggatgaccctgcaaaggaagctgccaacttcacatcccaggtcattatcatgaaccatcctggccagattggtaacggatacgcaccagtgctcgattgccacacctctcacattgctgtcaagtttgctgagctcgtgaccaagatcgacaggcgatctggtaaggagctcgagaaggagcccaagttcttgaagaatggtgatgcaggtttcgttaagatggttccaaccaagcccatggtggtggagactttctctgagtaccctcctcttggtcgttttgccgtgagggacatgcgtcaaaccgtggctgttggagtcatcaagagtgttgagaagaaagacccaaccggcgccaaggtcaccaaggctgcccagaagaagaaatgattgcttgtgtgtgatcatgttcatggttacagaaaaaccttgttctccctttatagtagtttatcattgcagagtcttaggtgtttgttttattttcaagtttctgccgatttcttgtagccataggtttcaaaactgggttcttgatcggcggtggtgaattttcattgcagttgtttttgggagttctgtttttgtttcgatgtaagagtcttccattttcgcaaagcagctatagggttttagtttattcctttgctgctgaggatgttttaattgcatttaattcataagaaagttttgtcaactctatgcattatttccttttttaatttatttgaaatgatgtgaggtgcgtgaacaggaggtagttgtgctcttaaatatgcgatcgaaggttcctagttgcactaa

SEQ ID NO: 482 - DNA, 1808 bp, Oryza sativa
ccctcccctctcccatctcaccccgccgccgccgccgccgcagcctcctcaaggctgctcccatcctctccttcgagttagcttcctccttattcaaccatgggtaaggagaagacgcacatcaacattgtggtcattggccacgtcgactccggcaagtcgaccaccacgggccatctgatctacaagcttggaggtatcgacaagcgtgtgattgagaggttcgagaaggaagccgctgagatgaacaagaggtccttcaagtacgcgtgggtgcttgacaagctcaaggccgagcgtgagagaggtatcaccatcgatatcgccctgtggaagttcgagaccaccaagtactactgcacggtcatcgatgcccctggtcaccgtgacttcatcaagaacatgatcacgggtacctcccaggctgactgtgccgtgctcatcattgactccaccactggtggttttgaggctggtatctccaaggatggccagacccgtgagcacgctcttcttgctttcactcttggagtgaagcagatgatctgctgctgcaacaagatggatgccaccactcccaagtactccaaggcccgttacgatgaaatcgtgaaggaagtctcatcctacctgaagaaggtcggctacaaccctgacaagattcccttcgttcccatctctgggtttgagggtgacaacatgattgagaggtccaccaaccttgactggtacaagggccccaccttgcttgaggctcttgaccagatcaacgagcccaagaggccatcagacaagcccctgcgtcttccccttcaggacgtgtacaagatcggtggtattggcaccgtgcctgtgggtcgtgttgagactggagtcctcaagcctggtatggtggtgacctttggtcccagcggcctgaccactgaggtcaagtcggttgagatgcaccacgaggctctccaggaggctcttcctggtgacaacgtcgggttcaacgtgaagaacgttgcggtgaaggatctgaagcgtgggtacgtggcctccaactccaaggatgaccctgccaaggaggctgccagcttcacctcccaggtgatcatcatgaaccaccctggccagatcggcaacggctacgccccagtgctggactgccacacctcccacattgccgtcaagtttgctgagctggtgaccaagatcgacagacgatctggtaaggagctggagaaggagcccaagttcctcaagaacggtgatgctggtatggttaagatgattcccaccaagcccatggttgtggagaccttctctgagtaccctcctcttggtcgttttgccgtgcgggacatgaggcaaacggtggctgttggcgtcatcaagaacgtggagaagaaggacccaaccggtgccaaggtgaccaaggctgccgccaagaagaaatgagcctcgttcaagtggtgctttccatatctgcatttgagatatctagctcttttagtactcgttaagttttgtcgacggtcatttcagttgttgcattgaccgttaatatctgctcgctttgtgcactatgtcagtcatttaaaactctattttctgttcggtttaaacttggatgttaagacttattattgcccttcgactgttgtggaatgcgagtatacattgctaattcctttgtctttattttcgcttgtgctattcgctgtttctgctgctattggatactggatcgtcttcctgttaatgaaaagtgaactttttgaaaggtattgaaaactgaaaaccgagtgggtgtcggtttagca

SEQ ID NO: 483 - DNA, 3412 bp, Oryza sativa
cggacggctaggaaggaaccctagcacccgtggctgcctatataagaagcaatcctctcgccccaacccctcccttctcccgtctcatcccagccgccgccgccgcagcctcctcctctcgtcttctccttcgagttgttagctccctccttattcaaccatgggtaaggagaagacgcacatcaacattgtggtcattggccacgtcgactccggcaagtcgaccaccacgggccatctgatctacaagcttggaggtatcgacaagcgtgtgatcgagaggttcgagaaggaagccgctgagatgaacaagaggtccttcaagtacgcgtgggtgctcgacaagctcaaggccgagcgtgagagaggtatcaccattgatatcgccctgtggaagttcgagaccaccaagtactactgcacggtcatcgatgcccctggtcaccgtgacttcatcaagaacatgatcacgggtacctcccaggctgactgtgccgtgctcatcattgactccaccactggtggttttgaggctggtatctccaaggatggccagacccgtgagcacgctcttcttgctttcactcttggagtgaagcagatgatctgctgctgcaacaagatggatgccaccactcccaagtactccaaggcccgttatgatgaaatcgtgaaggaagtctcatcctacctgaagaaggtcggctacaaccctgacaagattccctttgttcccatctctgggtttgagggtgacaacatgattgagaggtccaccaaccttgactggtacaagggccccaccttgcttgaggctcttgaccagatcaacgagcccaagaggccatcagacaagcccctacgtcttccccttcaggacgtgtacaagatcggcggtattggtaccgtgcctgtgggtcgtgttgagactggtgtcctcaagcctggtatggtggtgacctttggtcccagcggtctgaccactgaggtcaagtcggttgagatgcaccacgaggctctccaggaggctcttcctggtgacaacgttgggttcaacgtgaagaacgttgccgtgaaggatctgaagcgtgggtacgtggcctctaactccaaggatgaccctgccaaggaggctgccagcttcacctcccaggtgatcatcatgaaccaccctgggcagatcggcaatggctacgccccagtgctggactgccacacctcacacattgccgtcaagtttgctgagctggtgaccaagatcgacagacgatccggcaaggagctggagaaggagcccaagttcctcaagaacggtgatgctggtatggttaagatgattcccaccaagcccatggttgtggagaccttctctgagtaccctcctcttggtcgttttgccgtgcgtgacatgaggcaaacggtggctgttggcgtcatcaagaacgtggagaagaaggacccaaccggtgccaaggtgaccaaggctgccgccaagaagaaatgagcatcgttgaagtggtggttatgctggctgcatttgagatatcttagcgttcgttaagttttgcccacggccatggcactcgttgcatggaccgttaatatctgctcgcaatgtgcactatgttagtcgtttaaaactcgtttatttctattcggttaaaaacttggatgctctgagtcttattgttgcccttcggttgttgtggaatgcgagtacttacagtgctaaatcctttgctctttattttcgattgtgctatttggtgaaaactgaaagctcttttgcttggtgaaatctgaaaactcttggtacttttgaaatctttaacttggtatttcaattgtagagattgaaaactgatacctaatgctacccaacggtgtttaattgaagctctttttgttccaaattttgtgctgattggaacattatttaggcatatgactggatttcgcttaaatatgaactgactgttagtagtctttatcagatacatcgagtacactcgtgtcggatagcagctatgtaaactgtaccatcgttgctctaataacttttcaatgaaaaaaaatcaagctctaataacttttagtcccccatgataatgttttggggccgtggcaatacaacacttgggtgatttaggctgtatgctatatgaacagttgacaaaaggctaacttgcttaaaatctatacgtatggacgcttgcgccggagttgatggtcactctatgatcctgtacatgtgtgcgatctcaaagcagttcgccaattccatcctacggatgcggcgatatgcaaactggaccaaatttgatgcggtctgcgagcaaatttaattcagcctggagttcagatcttcccgttgtttttccgtactctgaaatgatccatgtagttgtagaagtaaagaattgctgacaacaaaaatcgagctcagggccatcaatccccctacatgataccatcaacaaagacaatattaaagctcataattttaagataatggtgggatgcaaacaaaccatacggatactgaaatggtggagatgcatacaatagcggtatattgtacctgatagagatggtgtcatggcgaaatcaaattgaggcagcaacaccccggcggcaatagggatagctactatgttatatgcgacagcccaggctaaattttggtgaactttggccatagttgctttcgaaagtgataaagcatccattacctaagccgtagggtggttcttgtttattagcacgaatgccacttgaactatgcagttacaatatcatagagaacagaatcctacctgagaaagtctgtttcctaatagaacaactgaagccgcgtcagaggcagcactctcttttgagtttgttcgcatagctactcccacatcagcagctgctaaagatggtgcatcatttattccatccccaacctatgcaacagcaaattccactaagacaataatacagagtagtttcatccaatctaaaactttgagttagtcaaactttaatttttgtttactatgctcaacatttaaacactctccgaaagtcaggacgcggaataattttagtgcaggcaatttcagtatgccatagactagcaacaactgtacgtgctgtcaataatagataaaagcacatcacagagcattaccattgcaacccgacgtccctctccttgcaatgcagttataatgcctgccttttcatgtggagttaaggatgactttatgttttcacttctgatccctacagttctcccaatgctttcaactgcttctttcctgtctcctgatagtagaaatgtcaagatttcttcctgctggagcctgttaattaatcagaaagggaaaatacagtatttaaattatacagacaacataattagtaa

SEQ ID NO: 484 - DNA, 1852 bp, Oryza sativa
ccctaaccccctcctctctcccatctcatcccagccgccgccgccgcagcctcctcctctcgccatctcccgtcctctccttcaagtcagctacctgcttaatcaaccatgggtaaggagaagacgcacatcaacattgtggtcattggccacgtcgactctggcaagtcgaccaccacgggccatctgatctacaagcttggaggtatcgacaagcgtgtgattgagaggttcgagaaggaagccgctgagatgaacaagaggtccttcaagtacgcgtgggtgctcgacaagctcaaggccgagcgtgagagaggtatcaccatcgatattgccctgtggaagttcgagaccaccaagtactactgcacggtcatcgatgcccctggtcaccgtgacttcatcaagaacatgatcacgggtacctcccaggctgactgtgccgtgctcatcattgactccaccactggtggttttgaggctggtatctccaaggatggccagacccgtgagcacgctcttcttgctttcactcttggtgtgaagcagatgatctgctgctgcaacaagatggatgccaccactcccaagtactccaaggcccgttacgatgaaatcgtgaaggaagtctcatcctacctgaagaaggtcggctacaaccctgacaagattcccttcgttcccatctctgggtttgagggtgacaacatgattgagaggtccaccaaccttgactggtacaagggccccaccttgcttgaggctcttgaccagatcaacgagcccaagaggccatcagacaagcccctgcgtcttccccttcaggacgtgtacaagatcggtggtattggcaccgtgcctgtgggtcgtgttgagactggagtcctcaagcctggtatggtggtgacctttggtcccagcggcctgaccactgaggtcaagtcggttgagatgcaccacgaggctctccaggaggctcttcctggtgacaacgtcgggttcaacgtgaagaacgttgcggtgaaggatctgaagcgtgggtacgtggcctccaactccaaggatgaccctgccaaggaggctgccagcttcacctcccaggtgatcatcatgaaccaccctggccagatcggcaacggctacgccccagtgctggactgccacacctcccacattgccgtcaagtttgctgagctggtgaccaagatcgacagacgatctggtaaggagctggagaaggagcccaagttcctcaagaacggtgatgctggtatggttaagatgattcccaccaagcccatggttgtggagaccttctctgagtaccctcctcttggtcgttttgccgtgcgtgacatgaggcaaacggtggctgttggcgtcatcaagaacgtggagaagaaggacccaaccggtgccaaggtgaccaaggctgccgccaagaagaaatgatcctcgttcaagtggtagttttgtgcacggccatggcactcgttgcattgaccgttattatcatatgctcgctgtgtgcactgtgtcgtttaaaactctctattttctgttcggtttaaacttgttctgagcctgattattgcccttcggctgttgtggaatgcgggtatttacattgctaattcctatgtctttattttggcttgtggcattcgcttgttctactgctattgaaaactgtaatctgtttctgttattaaaaactgaaccttttcttctgctatttgaaactgaagcgagtgggtttcaatttgctgaaatcctgctacttgctatttaaattatttatgttcaatttcgttcagtcccatatttgttggattgagtgaaaaactgacta

SEQ ID NO: 485 - DNA, 1827 bp, Oryza sativa
ctcgtttctcccgtctcaccctagccgccgccgcctcctcctcctctcgccttctcccgtcttctccttcgagttagctacctccttattcaaccatgggtaaggagaagacgcacatcaacatcgtggtcattggccacgtcgactccggcaagtcgaccaccacgggccatctgatttacaagcttggaggtatcgacaagcgtgtgatcgagaggttcgagaaggaagccgctgagatgaacaagaggtccttcaagtacgcgtgggtgcttgacaagctcaaggccgagcgtgagagaggtatcaccatcgatattgccctgtggaagttcgagaccaccaagtactactgcacggtcatcgatgcccctggtcaccgtgacttcatcaagaacatgatcacgggtacctcccaggctgactgtgccgtgctcatcattgactccaccactggtggttttgaggctggtatctccaaggatggccagacccgtgagcacgctcttcttgctttcactcttggagtgaagcagatgatctgctgctgcaacaagatggatgccaccactcccaagtactccaaggcccgttatgatgaaatcgtgaaggaagtctcatcctacctgaagaaggtcggctacaatcctgacaagattcccttcgttcccatctctgggtttgagggtgacaacatgattgagaggtccaccaaccttgactggtacaagggccccaccttgcttgaggctcttgaccagatcaacgagcccaagaggccatcagacaagcccctgcgtcttccccttcaggacgtgtacaagatcggtggtattggcaccgtgcctgtgggtcgtgttgagactggagtcctcaagcctggtatggtggtgacctttggtcccagtggcctgaccactgaggtcaagtcggttgagatgcaccacgaggctctccaggaggctcttcctggtgacaacgtcgggttcaacgtgaagaacgttgcggtgaaggatctgaagcgtgggtacgtggcctccaactccaaggatgaccctgccaaggaggctgccagcttcacctcccaggtgatcatcatgaaccaccctgggcagatcggtaacggctatgctccagtgctggactgccacacctcccacattgctgtcaagtttgctgagctggtgaccaagattgacagacgatctggcaaggagctggagaaggagcccaagttcttgaagaacggtgatgctggtatggtcaagatgattcctaccaagcccatggttgtggagaccttctctgagtaccctcctcttggtcgttttgcggtgcgtgacatgaggcaaacggtggctgttggcgtcatcaagaacgtggagaagaaggacccaaccggtgccaaggtgaccaaggctgccgccaagaagaagtgagcctcgttcaaatggtggtttgcatgtctgcagttgagatatctagttctagtatttgttaagttttgcccacggccatggctctcgtttcatggaccgttaatatctgctcgcaatgtgcactatgtcagtcgtttaatactcgtttatttctgttcggttaaaactgatgctctgagtccgattattgtccatcggctgttttggaatgcgagtatttacattgctacttcctgtgtcgttattttcgtttgtgctattccctgcttttgctgctattgataactggaaactgtctctgtcattgaatctcagacaagttttctgctattggaaactgaaagcctaatggatttcaattatgatgattgctttttctgcaactgcc

SEQ ID NO: 486 - DNA, 1760 bp, Oryza sativa
cccgtctcaccctagccgccgccgcctcctcctcctctcgccttctcccgtcttctccttcgagttagctacctccttattcaaccatgggtaaggagaagacgcacatcaacatcgtggtcattggccacgtcgactccggcaagtcgaccaccacgggccatctgatttacaagcttggaggtatcgacaagcgtgtgatcgagaggttcgagaaggaagccgctgagatgaacaagaggtccttcaagtacgcgtgggtgcttgacaagctcaaggccgagcgtgagagaggtatcaccatcgatattgccctgtggaagttcgagaccaccaagtactactgcacggtcatcgatgcccctggtcaccgtgacttcatcaagaacatgatcacgggtacctcccaggctgactgtgccgtgctcatcattgactccaccactggtggttttgaggctggtatctccaaggatggccagacccgtgagcacgctcttcttgctttcactcttggagtgaagcagatgatctgctgctgcaacaagatggatgccaccactcccaagtactccaaggcccgttatgatgaaatcgtgaaggaagtctcatcctacctgaagaaggtcggctacaatcctgacaagattcccttcgttcccatctctgggtttgagggtgacaacatgattgagaggtccaccaaccttgactggtacaagggccccaccttgcttgaggctcttgaccagatcaacgagcccaagaggccatcagacaagcccctgcgtcttccccttcaggacgtgtacaagatcggtggtattggcaccgtgcctgtgggtcgtgttgagactggagtcctcaagcctggtatggtggtgacctttggtcccagtggcctgaccactgaggtcaagtcggttgagatgcaccacgaggctctccaggaggctcttcctggtgacaacgtcgggttcaacgtgaagaacgttgcggtgaaggatctgaagcgtgggtacgtggcctccaactccaaggatgaccctgccaaggaggctgccagcttcacctcccaggtgatcatcatgaaccaccctgggcagatcggtaacggctatgctccagtgctggactgccacacctcccacattgctgtcaagtttgctgagctggtgaccaagattgacagacgatctggcaaggagctggagaaggagcccaagttcttgaagaacggtgatgctggtatggtcaagatgattcctaccaagcccatggttgtggagaccttctctgagtaccctcctcttggtcgttttgcggtgcgtgacatgaggcaaacggtggctgttggcgtcatcaagaacgtggagaagaaggacccaaccggtgccaaggtgaccaaggctgccgccaagaagaagtgagcctcgttcaaatggtggtttgcatgtctgcagttgagatatctagttctagtatttgttaagttttgcccacggccatggctctcgtttcatggaccgttaatatctgctcgcaatgtgcactatgtcagtcgtttaatactcgtttatttctgttcggttaaaactgatgctctgagtccgattattgtccatcggctgttttggaatgcgagtatttacattgctacttcctgtgtcgttattttcgtttgtgctattccctgcttttgctgctattgataactggaaactgtctctgtcattgaatctcagacaagtcctctgcta

SEQ ID NO: 487 - DNA, 1642 bp, Secale cereale
ggctctcactcctcttcgtctccggacagccaggtagttatcagccatgggtaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtcgttcaagtacgcctgggtgcttgacaagctcaaggctgagcgtgagagaggtatcaccattgatattgctctgtggaagttcgagaccaccaagtactcctgcaccgtcattgatgctcctggtcaccgtgatttcatcaagaacatgatcactggtacctcccaggctgattgtgctgtgcttatcattgactccaccactggtggttttgaggctggtatctccaaggatggccagacccgtgagcatgctctccttgctttcactcttggtgtgaagcagatgatctgctgctgcaacaagatggacgccaccactcccaagtactcaaagtcccgttatgaagaaattgttaaggaagtctcttcatacctgaagaaggtcggttacaaccctgacaaggttcccttcgtccccatctctgggttcgagggtgacaacatgattgagaggtccaccaaccttgactggtacaagggccccacccttcttgaggcccttgaccagatcaatgagcccaagaggccctcagacaagcccctccgccttccccttcaggatgtctacaagattggtggcattggaactgtgccagtggggcgtgttgagactggtgtcatcaagccgggcatggttgtcacctttggccctactggcctgaccactgaggtgaagtctgtggagatgcaccacgagtctctcctggaggcgcttcctggtgacaatgtcggcttcaacgtcaagaacgtggccgtcaaggatctcaagcgtgggtatgttgcctccaactctaaggacgaccccgccaaggaggctgccaacttcactgcccaggtcatcatcatgaaccaccccggccagatcagcaatggctacgccccagtgctggactgccacacgtgccacatcgccgtcaagtttgctgagatccagaccaagatcgacaggcggtccggcaaggagctggaggctgcgcccaagttcctcaagaacggtgacgccgggttcgtcaagatgattcccaccaagcccatggtggtggagacctttgcccagtaccctcccctgggccgctttgctgtgcgcgacatgaggcagacggttgctgtgggtgtgatcaagagcgtggagaagaaggagccgaccggtgccaaggtgaccaaggctgcgatcaagaagaaatgagatggtgtctggcagtgctgttgttggcgggtggtggtgacggtatacggcggttgcggttgcggtagtcgtcttagtcgattacaaaactctttaagtctttggttatttgtgtcgagcagtgttggaactgtctttttctctgctcgttgtatctatttagttgtgttggtgtaacttcgtctagttaaattaatgttgcttatctatatagttcgttctttgttgtagttctaatttaatcttgttacg

SEQ ID NO: 488 - DNA, 1355 bp, Secale cereale
tcagctcggttccttcttctccttccttggagctaagctctttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtacgcctgggtgcttgacaagctgaaggccgagcgtgagaggggtatcacaattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacgtttggtcccactggtctgacaactgaggtcaagtctgttgagatgcaccacgagtccctcctggaggcgcttcctggtgacaacgttggcttcaacgtcaagaatgttgctgtgaaggatctgaagcgtgggtttgttgcatccaactccaaggatgaccctgccaaggaggccgccaacttcacctcccaggtcatcatcatgaaccaccctggtcagattggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaacggaccccacgg

SEQ ID NO: 489 - DNA, 1633 bp, Secale cereale
cccgtccccgccgcaggctctcactcctcttcgtccccggacagccaggtagttatcagccatgggtaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtcgttcaagtacgcctgggtgcttgacaagctcaaggctgagcgtgagagaggtatcaccattgatattgctctgtggaagttcgagaccaccaagtactcctgcaccgtcattgatgctcctggtcaccgtgatttcatcaagaacatgatcactggtacctcccaggctgattgtgctgtgcttatcattgactccaccactggtggttttgaggctggtatctccaaggatggccagacccgtgagcatgctctccttgctttcactcttggtgtgaagcagatgatctgctgctgcaacaagatggacgccaccactcccaagtactcaaagtcccgttatgaagaaattgttaaggaagtctcttcatacctgaagaaggtcggttacaaccctgacaaggttcccttcgtccccatctctgggttcgagggtgacaacatgattgagaggtccaccaaccttgactggtacaagggccccacccttcttgaggcccttgaccagatcaatgagcccaagaggccctcagacaagcccctccgccttccccttcaggatgtctacaagattggtggcattggaactgtgccagtggggcgtgttgagactggtgtcatcaagccaggtatggttgtcacctttggccctactggcctgaccactgaggtgaagtctgtggagatgcaccacgagtctctcctggaggcgcttcctggtgacaatgtcggcttcaacgtcaagaacgtggccgtcaaggatctcaagcgtgggtatgttgcctccaactctaaggacgaccccgccaaggaggctgccaacttcactgcccaggtcatcatcatgaaccaccccggccagatcagcaacggctacgccccagtgctggactgccacacgtgccacatcgccgtcaagtttgctgagatccagaccaagattgacaggcggtccggcaaggagctggaggctgcgcccaagttcctcaagaacggtgacgccgggttcgtcaagatgattcccaccaagcccatggtggtggagacctttgcccagtaccctcccctgggccgctttgctgtgcgcgacatgaggcagacggttgctgtgggtgtgatcaagagcgtggagaagaaggagccgaccggtgccaaggtgaccaaggctgcgatcaagaagaaatgagatggtgtctggcagtgctgttgttggcgggtggtggtgacggtatacggcggttgcggttgcggtagtcgtcttagtcgattcaaaaactctttaagctttggttatttgtgtcgagcagtgttggaactgcttttttctctgctcgttgtatcatttagttgtgttggtgaaacttcgtcagttaaaattaatgttgctatctactatagtcgtcttgtttggagt

SEQ ID NO: 490 - DNA, 1577 bp, Secale cereale
ggctctcactcctcttcgtccccggacagccaggtagttatcagccatgggtaaggagaagatccacatcagcattgtggtcattggccatgtcgactctggcaagtcaaccacgactggtcacctcatctacaagcttggaggcattgacaagcgtgtgatcgagaggttcgagaaggaagccgctgagatgaacaagaggtcgttcaagtacgcctgggtgcttgacaagctcaaggctgagcgtgagagaggtatcaccattgatattgctctgtggaagttcgagaccaccaagtactcctgcaccgtcattgatgctcctggtcaccgtgatttcatcaagaacatgatcactggtacctcccaggctgattgtgctgtgcttatcattgactccaccactggtggttttgaggctggtatctccaaggatggccagacccgtgagcatgctctccttgctttcactcttggtgtgaagcagatgatctgctgctgcaacaagatggacgccaccactcccaagtactcaaagtcccgttatgaagaaattgttaaggaagtctcttcatacctgaagaaggtcggttacaaccctgacaaggttcccttcgtccccatctctgggttcgagggtgacaacatgattgagaggtccaccaaccttgactggtacaagggccccacccttcttgaggcccttgaccagatcaatgagcccaagaggccctcagacaagcccctccgccttccccttcaggatgtctacaagattggtggcattggaactgtgccagtggggcgtgttgagactggtgtcatcaagccaggtatggttgtcacctttggccctactggcctgaccactgaggtgaagtctgtggagatgcaccatgagtctctcctggaggcgcttcccggtgacaatgtcggcttcaacgtcaagaacgtggccgtcaaggatctcaagcgtgggtatgttgcgtccaactctaaggacgaccctgccaaggaggctgccaacttcactgcccaggtcatcatcatgaaccaccctggccagatcagcaatggctatgccccagtgctggactgccacacgtgccacatcgccgtcaagtttgctgagatccagaccaagattgacaggcggtccggcaaggagctggaggctgcgcccaagttcctcaagaacggtgacgctgggttcgtcaagatgatccccaccaagcccatggtggtggagacctttgcccagtaccctcccctgggccgctttgctgtgcgcgacatgaggcagacggttgctgtgggtgtgatcaagagcgtggagaagaaggagccgaccggtgccaaggtgaccaaggctgcgatcaagaagaaatgagatggtgtctggcagtgctgttgttggcgggtggtggtgacggtatacggcggttgcggttgcggtagtcgtcttagtcgattcaaaaactcgttaagctttggttatttgtgtcagcagtgttggaactgcttatgtctctggtccttgtatcatttagttgtgttggtgaaacttcatcagttaa

SEQ ID NO: 491 - DNA, 1391 bp, Secale cereale
tgtcgactctggcaagtcgacgaccactggccatctgatctacaagcttggaggcattgacaagcgtgtgatcgagaggttcgagaaggaagccgcggagatgaacaagaggtctttcaagtacgcctgggtgcttgacaagctcaaggctgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggttttgaggctggtatctccaaggatggccagacacgtgagcacgctctccttgctttcactcttggagtgaagcagatgatttgctgctgcaacaagatggacgccaccactcccaagtactcaaaggctcgttacgaagaaattgttaaggaggtgtcttcctacctgaagaaggttggctacaaccctgacaaggttccctttgtccccatctctgggttcgagggtgacaacatgatcgagaggtccaccaaccttgactggtacaagggccccaccctgcttgaggcgcttgaccagatcaacgagcccaagaggccctcagacaagcccctccgacttcccctccaggatgtttacaagattggtggcattggaactgtgcctgttggccgtgttgagactggtgtcatcaagcctggtatggttgtcacctttggtcccactggtctgacaactgaggtcaagtccgttgagatgcaccacgagtctctgctggaggcgcttcctggtgacaatgttggcttcaacgtgaagaacgttgctgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtcaccaagattgacaggcgatctggtaaggagctggaagccctgcccaagttcctcaagaatggtgatgctggcatagtgaagatgattcccaccaagcccatggttgtggagacctttgccacctaccctcctcttggtcgatttgctgtccgtgacatgaggcaaactgtggctgttggtgtcatcaagggcgttgagaagaaggacccaaccggcgccaaggtgaccaaggctgccatcaagaagaaatagaggcttttacctggatccatctatgtctgcttttgagatctctagtagtttagtgcctattaagttttgctactgttagcgccgtgtgata

SEQ ID NO: 492 - DNA, 1666 bp, Secale cereale
atcccctccctctcccctccccgccgcggctttgactccatcccccacttcgtcgccggccagccaggtagttaacatattcagcagccatgggcaaggagaagatccacatcagcattgtggtcattggccatgtcgattctggcaagtcaaccacgactggccacctcatctacaagcttggaggcattgacaagcgtgtgatcgagaggttcgagaaggaagccgctgagatgaacaagaggtcgttcaagtacgcctgggtgcttgacaagctcaaggctgagcgtgagaggggtatcaccattgatatcgctctgtggaagttcgagaccaccaagtactcctgcactgtcattgatgctcctggtcaccgtgatttcatcaagaacatgatcactggtacctcccaggctgactgtgctgtgcttatcattgactcaaccactggtggttttgaggctggtatctccaaggatggccagacccgtgagcacgctctccttgctttcactcttggtgtgaagcagatgatctgctgctgcaacaagatggacgccaccactcccaagtactccaaggcccgttacgatgaaattgtcaaggaagtctcttcatacctgaagaaggttggttacaaccctgacaaggttcccttcgtccccatctctgggtttgagggtgacaacatgatcgagaggtcctccaaccttgactggtacaagggcccgaccctgcttgaggctcttgaccagatcaatgagcccaagaggccctcagacaagcccctgcgtcttccccttcaggacgtctacaagattggcggcattggaactgtgccagtggggcgtgttgagactggagtcatcaagccaggcatggttgtcacctttggccctactggcctgaccactgaggtgaagtctgtggagatgcaccacgagtctctcctggaggcgcttcccggtgacaacgtcggcttcaacgtcaagaatgtggctgtcaaggatctcaagcgtgggtatgtggcctccaactccaaggacgaccccgccaaggaggctgccaacttcacggcccaggtcatcatcatgaaccaccctggccagatcagcaatggctacgccccggtgctggactgccacacgtcccacattgccgtcaagttcgctgagattcagaccaagatcgaccggcggtctggcaaggagctggaggcggcgcccaagttcctcaagaacggtgacgctgggttcgtgaagatgatccccaccaagcccatggtggttgagacctttgcccagtaccctcccctgggccgcttcgccgtgcgtgacatgaggcagacggttgctgtgggtgtgatcaagagcgtggagaagaaggagccgacgggcgccaaggtgaccaaggctgcgatcaagaagaaatgagatggtgttgggcggtggcgtggttggtggttctttgttccatctatggtggtggcggtggtatatgttggtggtgatagtcgtgttagtgggtttgaaaacttgttaagcttcgtgtatttgcgtcgtgcagtgtttgaacttcttactattctgttcatgttatggttcggttgtgttggtgaaacttcgtcgggtaaagttgttactatatctagtcatatttggagtca

SEQ ID NO: 493 - DNA, 1709 bp, Secale cereale
ccgcggctttgactccatcccccacttcgtcgccggccagccaggtagttaacagctccagcagccatgggaaaggagaagatccacatcagcattgtggtcattggccatgtcgactctggcaagtcaaccacgactggccacctcatctacaagcttggaggcattgacaagcgtgtgatcgagaggttcgagaaggaagctgctgagatgaacaagaggtcgttcaagtacgcctgggtgcttgacaagctcaaggctgagcgtgagaggggtatcaccattgatattgctctgtggaagttcgagaccaccaagtactcctgcactgtcattgatgctcctggtcaccgtgatttcatcaagaacatgatcactgggacctcccaggctgactgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactcaaaggcccgttacgatgaaattgtcaaggaagtctcttcatacctgaagaaggtcggttacaaccctgacaaggttccctttgtccccatctctgggtttgagggtgacaacatgatcgagaggtcctccaaccttgactggtacaagggccctaccctgcttgaggctcttgaccagatcaatgagcccaagaggccctccgacaagcccctgcgtcttccccttcaggacgtctacaagattggtggcattggaactgtgccagtggggcgtgttgagaccggagtcatcaagccaggcatggttgtcacctttggccctactggcctgaccactgaggtgaagtctgtggagatgcaccatgagtctctcctggaggcgcttcccggtgacaacgtcggcttcaacgtcaagaatgtggctgtcaaggatctcaagcgtgggtacgtggcctctaactccaaggatgaccccgccaaggaggctgccaacttcacggcccaagtcatcatcatgaaccaccctggccagatcagcaacgggtacgccccggtgctggactgccacacgtcccacattgccgtcaagttcgctgagatccagaccaagattgaccggcggtccggcaaggagctggaggcggcgcccaagttcctcaagaacggcgacgctgggtttgtgaagatgatacccaccaagcccatggttgtggagacctttgcccagtaccctcccctgggccgcttcgccgtgcgtgacatgaggcagacggttgctgtgggtgtgatcaagagcgtggagaagaaggagccgacgggcgccaaggtgaccaaggctgcgatcaagaagaaatgagatggtgttgggcggtggcgtcgttggtggttctatgttccatctatggtggtggcggtggtatatgttggtggtgatagtcgtgttagtgggtttgaaaacttgttaagcttcgtgtatttgcgtcgtgcagtgtttgaacttcttactattctgttcatgttatggttcggttgtgttggtgaaacttcgtcggttaaagttgttactatatctatagtcatatttggagtcattttatatctgttgcatcatgtttttttcttttctttggcaaactgtaattggtttcctagttg

SEQ ID NO: 494 - DNA, 1681 bp, Secale cereale
ccggccagccaggtagttcacagctccagcagccatgggcaaggagaagatccacatcagcattgtggtcattggccatgtcgactctggcaagtcaaccacgactggccacctcatctacaagcttggaggcattgacaagcgtgtgatcgagaggttcgagaaggaagctgccgagatgaacaagaggtcgttcaagtacgcctgggtgcttgacaagctcaaggctgagcgtgagagaggtatcaccattgatatcgctctgtggaagttcgagaccaccaagtactcctgcactgtcattgatgctcctggtcaccgggatttcatcaagaacatgatcactgggacctcccaggctgattgtgctgtgcttatcattgactccaccactggtggttttgaggctggtatctccaaggatggccagacacgtgagcatgctctccttgctttcacccttggtgtgaagcagatgatctgctgctgcaacaagatggacgccaccactcccaagtactcaaaggcccgttacgatgaaattgtcaaggaagtctcttcatacctgaagaaggttggttacaaccctgacaaggttcccttcgtccccatctctgggtttgagggtgacaacatgatcgagaggtcctccaaccttgactggtacaagggcccaaccctgcttgaggcgcttgaccagatcaacgagcccaagaggccctccgacaagcccctgcgtcttccccttcaggacgtgtacaagattggcggcattggaactgtgccagtgggacgtgttgagactggagtcatcaagccaggcatggttgtcacctttggtcctactggcctgactactgaggtgaagtccgttgagatgcaccacgagtcccttttggaggcgcttcctggtgacaacgtcggcttcaacgtcaagaacgtggctgtcaaggatctcaagcgtgggtatgtcgcttccaactcgaaagacgaccctgccaaggaggctgccaacttcacggcgcaggtcatcatcatgaaccaccctggccagatcagcaacggctacgctccagtgctggactgccacacgtcccacatcgccgtcaagttcgctgagatccagaccaagatcgaccggcggtctggcaaggagctggaggcggcgcccaagttcctcaagaacggtgacgccgggttcgtcaagatgatccccaccaagcccatggtggtggagacctttgcccagtaccctcccctgggccgctttgctgtgcgcgacatgaggcagacggttgctgtgggtgtgatcaagagcgtggagaagaaggagccgaccggtgccaaggtgaccaaggctgcgatcaagaagaaatgagatggtgtctggcagtgctgttgttggcgggtggtggtgacggtatacggcggttgcggttgcggtagtcgtcttagtcgattcaaaaactcgttaagctttggttatttgtgtcgagcagtgttggaactgcttttttctctgctcgttgtatcatttagttgtgttggtgaaacttcgtcagttaaaattaatgttgctatctactatagtcgtcttgtttggagtcatattatatctgttgccttcatgtttttgtctagttgattttgcttaactacgtgagcagtggattttttccca

SEQ ID NO: 495 - DNA, 1620 bp, Secale cereale
ctccatccccgacttcgtcgccggccagccaggtagttaacagctccagcagccatgggaaaggagaagatccacatcagcattgtggtcattggccatgtcgactctggcaagtcaaccacgactggccacctcatctacaagcttggaggcattgacaagcgtgtgatcgagaggttcgagaaggaggccgctgagatgaacaagaggtcgttcaagtacgcctgggtgcttgacaagctcaaggctgagcgtgagaggggtatcaccattgatattgctctgtggaagtttgagaccaccaagtactcctgcactgtcattgatgctcctggtcaccgtgatttcatcaagaacatgatcactgggacctcccaggctgattgcgctgtgcttatcattgactccaccactggtggttttgaggctggtatctccaaggatggccagacccgtgagcatgctctccttgctttcactcttggtgtgaagcagatgatctgctgctgcaacaagatggacgccacaactcccaagtactcgaaggcccgttacgatgaaattgtcaaggaagtctcttcatacctgaagaaggtcggttacaaccctgacaaggttcccttcgtccccatctctgggtttgagggtgacaacatgatcgagaggtcctccaaccttgactggtacaagggcccaaccctgcttgaggcgcttgaccagatcaatgagcccaagaggccctccgacaagcccctgcgtcttccccttcaggacgtgtacaagattggcggcattggaactgtgccagtggggcgtgttgagactggagtcatcaagccaggcatggttgtcacctttggccctactggcctgaccactgaggtgaagtctgtggagatgcaccacgagtctctgctggaggcgcttcctggtgacaacgtcggcttcaacgtcaagaatgtggccgtcaaggatctcaagcgtgggtacgtggcctccaactccaaggacgacccagccaaggaggctgccaacttcacggcccaggtcatcatcatgaaccaccctggccagatcagcaacggctacgccccggtgctggactgccacacgtcccacatcgccgtcaagttcgctgagatccagaccaagatcgaccggcggtctggcaaggagctggaggcggcgcccaagttcctcaagaacggcgacgctgggttcgtcaagatgatccccaccaagcccatggtggtggagacctttgcccagtaccctcccctgggccgcttcgccgtgcgtgacatgaggcagacggttgctgtgggtgtgatcaagagcgtggagaagaaggagccgacgggcgccaaggtgaccaaggctgcgatcaagaagaaatgagatggtgtcaggttctttactgcatctatggtggtggtggcggtatacgttggtggtgatagtcgtgttagtgggtttgaaaacttgttaagcttcgtgtatttgcgtcgtgcagtgtttgaacttcttactattctgttcatgttatggttcggttgtgttggtgaaacttcgtcgggtaaagttgttactatatctagtcatatttggagtcattttata

SEQ ID NO: 496 - DNA, 1659 bp, Secale cereale
gccgcggctttgactccatcccccacttcgtcgccggccagccaggtagttaacagctccagcagccatgggaaaggagaagatccacatcagcattgtggtcattggccatgtcgactctggcaagtcaaccacgactggccacctcatctacaagcttggaggcattgacaagcgtgtgatcgagaggttcgagaaggaagctgctgagatgaacaagaggtcgttcaagtacgcctgggtgcttgacaagctcaaggctgagcgtgagaggggtatcaccattgatattgctctgtggaagttcgagaccaccaagtactcctgcactgtcattgatgctcctggtcaccgtgatttcatcaagaacatgatcactgggacctcccaggctgactgtgctgtgcttatcattgactccaccactggtggttttgaggctggtatctccaaggatggccagacccgtgagcacgctctccttgctttcactcttggtgtgaagcagatgatctgctgctgcaacaagatggacgccaccactcccaagtactcaaagtcccgttatgaagaaattgttaaggaagtctcttcatacctgaagaaggtcggttacaaccctgacaaggttcccttcgtccccatctctgggttcgagggtgacaacatgattgagaggtccaccaaccttgactggtacaagggccccacccttcttgaggcccttgaccagatcaatgagcccaagaggccctcagacaagcccctccgccttccccttcaggatgtctacaagattggtggcattggaactgtgccagtggggcgtgttgagactggtgtcatcaagccaggtatggttgtcacctttggccctactggcctgaccactgaggtgaagtctgtggagatgcaccacgagtctctcctggaggcgcttcctggtgacaatgtcggcttcaacgtcaagaacgtggccgtcaaggatctcaagcgtgggtatgttgcctccaactctaaggacgaccccgccaaggaggctgccaacttcactgcccaggtcatcatcatgaaccaccccggccagatcagcaatggctatgccccagtgctggactgccacacgtgccacatcgccgtcaagtttgctgagatccagaccaagatcgacaggcggtccggcaaggagctggaggctgcgcccaagttcctcaagaacggtgacgccgggttcgtcaagatgatccccaccaagcccatggtggtggagacctttgcccagtaccctcccctgggccgctttgctgtgcgcgacatgaggcagacggttgctgtgggtgtgatcaagagcgtggagaagaaggagccgaccggtgccaaggtgaccaaggctgcgatcaagaagaaatgagatggtgtctggcagtgctgttgttggcgggtggtggtgacggtatacggcggttgcggttgcggtagtcgtcttagtcgattcaaaaactcgttaagctttggttatttgtgtcgagcagtgttggaactgcttttttctctgctcgttgtatcatttagttgtgttggtgaaacttcgtcagttaaaattaatgttgctatctactatagtcgtcttgtttggagtcatattatatctgttgcctt

SEQ ID NO: 497 - DNA, 2701 bp, Glycine max
atcactctgctgcctcgctctgtttctgtctctgtgtttgcggctgaggattccgaacgagcgaccttcttcgtttctcgcaaaggtaacagcctctgctcttgtctcttccattcgatccatgcctgtctcttctttacgatgatgtttcttcggtgtatgtttatttatttatttatttatgctttatgttgtgaatgttcggttgttttgtttcgctttgcttttgtggattctattggtttttgaatcagttaatcggaagagattttcgagttgttttgtgttttggaggtgaatctttttgttgaggtcgcagatctgttgattttgtgtcataaacgtgcgactctgtttgattttttacgaggttatgacgttttggttgttttattatggatctgttaaggcagaaccatgatttatgtttatgttcgtttacacgattaaattttcttgtaacacgatgaagtttttttaaacacgttgaaggagtcttgttgatatgaatttgtcgattgtttttttgtggttttgttctcacgttatcaagcgtaatcttttactatgtacgcgaacatatctagatctagcagagctttttttttttttaattctttgtgaagcttttgaaatatgaaatttgtttttcaaatttttttttaatttattgaaaacactgtggatactgaataaggttctatgtatgatgcgaaccatgtttgatatgtttgtttttgttgttccatatggatttttctgttagatttccatatgcttttgagtttgtttttgctgttacagattgatttactttttagaatatttctcttggctttcactgttttagaaattttttgttattggtaactataaatgtgtgaatttggattatacctttaccttgttatttagttgtgtgataatttggtttatagttattttgagttctgactcgtgtttctttgaattgattccagtttaagtcatcatgggtaaggaaaagactcacatcaacattgtcgtcattggacatgtcgactctgggaagtcaactaccactggtcatttgatctacaagcttggaggtattgacaagcgtgtgattgagaggttcgagaaggaggctgctgagatgaacaagaggtcattcaagtatgcctgggtgcttgacaagctcaaggctgagcgcgaaagaggaattaccattgatattgctttgtggaagtttgaaaccaccaagtactactgcacagtcatcgatgcccccggacatcgtgactttatcaagaacatgattactggtacctcccaggctgattgtgctgtccttatcattgactccaccactggtggttttgaagctggtatttctaaggatggacagactcgtgagcatgctcttcttgctttcacccttggtgtgaagcagatgatctgctgctgtaacaagatggatgccactaccccgaagtactctaaggctaggtatgatgaaattgtgaaggaagtctcttcctacttgaagaaggttggttacaacccagacaagattccatttgtgcccatctctggtttcgagggtgacaacatgattgagaggtccaccaaccttgactggtacaagggaccaactctccttgaggctcttgaccaaatcaatgagcccaagaggccctcagacaagccactcaggcttccattgcaggatgtctacaaaattggtggtattggtaccgtgccagtgggacgtgttgagactggtgtcgtgaagcccggtatggtggtgacttttggtcccactgggctgacaactgaggttaagtctgttgagatgcaccatgaggctctcacagaggctcttccaggtgacaatgttggctttaatgtgaagaatgttgcagtcaaggatctcaagcgtggttttgttgcatccaactccaaggatgaccctgccaaggaagctgccaacttcacatctcaagtcattatcatgaaccaccctggccagattggaaatggatacgcaccggtgcttgattgccacacttctcacattgctgtcaagttttctgaaatcttgaccaagattgacaggcgatctggtaaggagcttgagaaggagcccaaatttttgaagaatggtgatgcaggtatggttaagatgattccaaccaagcccatggtggttgaaactttctctgagtatcctccccttggtcgttttgctgtgagggacatgcgtcaaactgtggctgtcggagtcatcaagagtgttgagaagaaagaccccaccggagccaaggtcaccaaggccgctgccaagaagaagtgattgcatttgggcaattttgctagcacatgtgatcatcatcgtggttactcctttatagtagttttatccttgcagagtcttaggtgttttgtttaagttatatttttaagtttctgccgatttcatgtagccgtaactttcaaaactaggttcttgatcggcggtggtcaattttcattgctgtttgtttttgatgagtactgttttttgttttgatggtaagaagagtctgagatatttcgaatttcacaagcagctatagggttttagtccatttcctttgctgctgagggatgttttaagttgcatttaatttataacgaagttttataaactgtttatggtttaaaggctattattctttaa

SEQ ID NO: 498 - DNA, 1589 bp, Triticum aestivum
ggtagtcctccatgggcaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtctttcaagtacgcctgggtgcttgacaagctcaaggctgagcgtgagaggggtatcaccattgatatcgctctgtggaagttcgagaccaccaagtactcgtgcactgtcattgatgctcctggtcaccgtgatttcatcaagaacatgatcactgggacctcccaggctgactgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactcgaaggcccgttatgaagaaattgtcaaggaagtctcttcatacctgaagaaggtcggttacaaccctgacaaggttcccttcgttcccatctctgggttcgagggcgacaacatgattgagaggtccaccaaccttgactggtacaagggccccacccttcttgaggccctggaccagatcaatgagcccaagaggccctcccacaagcccctgcgtcttccccttcaggacgtgtacaagattggcggcattggaactgtgccagtggggcgtgttgagactggagtcatcaagccaggcatggttgtcacctttggtcctactggcctgaccactgaggtgaagtctgtggagatgcaccacgagtctctcctggaggcgcttcctggtgacaacgtcggcttcaacgtcaagaatgtggctgtcaaggatctcaagcgtgggtacgtcgcttccaactccaaggacgaccctgccaaggaggctgccaacttcaccgcccaggtcatcatcatgaaccaccctggccagatcagcaacggctatgccccagtgctggactgccacacgtcccacatcgctgtcaagtttgctgagatccagaccaagatcgaccggcggtctggcaaggagattgaggcggcgcccaagttcctcaagaacggtgatgccgggttcgtcaagatgatccccaccaagcccatggtggtggagaccttcgctcagtaccctcccctgggccgctttgctgtgcgtgacatgaggcagacggttgcggtgggcgttatcaaggccgtggagaagaaggatccgaccggcgccaaggtgaccaaggctgcggccaagaagaaatgagatggtgtcaggttctttactgcatctatgatggtggtggcggtgacggcatttggtggtggtgatagttgttctagtcgttttgaaaacttgttaagcttcggttatttgtgtcgagcagtgttggaactgcttattgctctggtcattgtatcgttcggttgtgttggtggaactttgtcagttaatgttgctactatatatagtcatcatgtttggagtcgttttatgtca

SEQ ID NO: 499 - DNA, 1932 bp, Glycine max
caaaaagtagctcactcattataaaattcaagtaaccctagttttcatcatcactctgctgcctcgctctgtttctgtctctgtgtttgcggctgaggattccgaacgagcgaccttcttcgtttctcgcaaagtttaagtcatcatgggtaaggaaaagactcacatcaacattgtcgtcattggacatgtcgactctgggaagtcaactaccactggtcatttgatctacaagcttggaggtattgacaagcgtgtgattgagaggttcgagaaggaggctgctgagatgaacaagaggtcattcaagtatgcctgggtgcttgacaagctcaaggctgagcgcgaaagaggaattaccattgatattgctttgtggaagtttgaaaccaccaagtactactgcacagtcatcgatgcccccggacatcgtgactttatcaagaacatgattactggtacctcccaggctgattgtgctgtccttatcattgactccaccactggtggttttgaagctggtatttctaaggatggacagactcgtgagcatgctcttcttgctttcacccttggtgtgaagcagatgatctgctgctgtaacaagatggatgccactaccccgaagtactctaaggctaggtatgatgaaattgtgaaggaagtctcttcctacttgaagaaggttggttacaacccagacaagattccatttgtgcccatctctggtttcgagggtgacaacatgattgagaggtccaccaaccttgactggtacaagggaccaactctccttgaggctcttgaccaaatcaatgagcccaagaggccctcagacaagccactcaggcttccattgcaggatgtctacaaaattggtggtattggtaccgtgccagtgggacgtgttgagactggtgtcgtgaagcccggtatggtggtgacttttggtcccactgggctgacaactgaggttaagtctgttgagatgcaccatgaggctctcacagaggctcttccaggtgacaatgttggctttaatgtgaagaatgttgcagtcaaggatctcaagcgtggttttgttgcatccaactccaaggatgaccctgccaaggaagctgccaacttcacatctcaagtcattatcatgaaccaccctggccagattggaaatggatacgcaccggtgcttgattgccacacttctcacattgctgtcaagttttctgaaatcttgaccaagattgacaggcgatctggtaaggagcttgagaaggagcccaaatttttgaagaatggtgatgcaggtatggttaagatgattccaaccaagcccatggtggttgaaactttctctgagtatcctccccttggtcgttttgctgtgagggacatgcgtcaaactgtggctgtcggagtcatcaagagtgttgagaagaaagaccccaccggagccaaggtcaccaaggccgctgccaagaagaagtgattgcatttgggcaattttgctagcacatgtgatcatcatcgtggttactcctttatagtagttttatccttgcagagtcttaggtgttttgtttaagttatatttttaagtttctgccgatttcatgtagccgtaactttcaaaactaggttcttgatcggcggtggtcaattttcattgctgtttgtttttgatgagtactgttttttgttttgatggtaagaagagtctgagatatttcgaatttcacaagcagctatagggttttagtccatttcctttgctgctgagggatgttttaagttgcatttaatttataacgaagttttataaactgtttatggtttaaaggctattattctttaattttgttgttgaagtaatgtgagtgggaggtgcgcttgagctgtgtggacgtagttgagctcttaattatgcgatcg

SEQ ID NO: 500 - DNA, 1548 bp, Cicer arietinum
ctctgcggctgaggattccgaacgcgtcttcgtttttcttagctaagatatcatgggtaaagagaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatcgcccccggacatcgtgatttcattaagaacatgattactggtacctcccaagctgattgtgctgtccttatcattgactccaccactggtggttttgaggctggtatctctaaggatggacagacccgtgagcacgctcttcttgctttcactcttggagtgaaacagatgatctgttgttgtaacaagatggatgccaccacacccaagtactcaaaggccaggtacgatgaaatcgtgaaggaagtttcttcatacttgaagaaggttggttacaaccctgacaaaatccccttcgttccaatctctggttttgagggagacaacatgattgagaggtccaccaaccttgactggtacaagggaccaactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttggccctactggtctgacaactgaagttaagtctgttgagatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgccccagtcctcgactgtcacacctcccacattgctgttaagttcgctgagcttctcaccaagatcgacaggcgatctggtaaggaacttgagaaggagcctaagtttttgaagaatggtgatgctggtcttgttaagatgattccaaccaagcctatggttgtggaaactttctccgagtatccaccacttggtcgtttcgccgtgagggacatgcgtcaaactgttgctgtcggtgtcatcaagagtgttgagaagaaggatccaactggagccaagatcaccaaagctgcagtgaagaagaagtgatggttgatgcagaagtggatgttgctttatagtagcttattatcttttaagagtcttagtttattttgccttttaattttgccgttttatgcagccaaacttgcaaaaatgggtttttgattggggatggtcgacctttattttgtggttg

SEQ ID NO: 501 - DNA, 1584 bp, Pennisetum glaucum
gtccctctcccctccctcttcttctccgccgctccgcgagattaacctttgcttttagccatgggcaaggagaagagtcacattaacatcgtggtcattggccatgtcgactctggcaagtcaaccaccactggccacctgatctacaagcttggaggtattgacaagcgtgtgatcgagaggttcgagaaggaggccgcagaaatgaacaagaggtccttcaagtacgcgtgggtgcttgacaagctgaaggctgagcgtgagagaggtatcaccatcgacattgccctgtggaagttcgagaccaccaagtactactgcactgttatcgatgcccctggtcaccgtgacttcatcaagaacatgattaccggcacctcccaggctgactgcgctgtcctcatcattgactctaccactggtggttttgaggctggtatctctaaggatggccagacccgtgagcatgctctccttgctttcactcttggagtgaagcagatgatttgctgctgcaacaagatggatgccaccactcccaagtactccaaggcccgttatgatgagattgtgaaggaagtctcctcgtacctcaagaaggtgggttacaacccagacaagattgcttttgtccccatctctggtttcgagggtgacaacatgattgagaggtccaccaaccttgactggtacaagggccaaccctgcttgaggctctggaccagatcaacgagcccaagaggccttccgacaagcccctgcgtctcccccttcaggacgtgtacaagattggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaatgttgctgtgaaggatctcaagcgtgggtacgtggcgtccaactccaaggacgaccctgccaaggaggctgccagcttcacctcccaggttatcatcatgaaccaccctgggcagattggcaacgggtatgcgccagtgttggactgccacacctcccacatcgctgtcaagtttgctgagcttgtcaccaagattgacagacgatctggtaaggagcttgagaaggagcccaaattcctgaagaatggtgatgctggtatggtgaagatgattcccacgaagcccatggttgtggagacattctctgagtaccctcctcttggtcgctttgctgttcgtgacatgaggcagacggttgctgttggtgtcatcaagagtgtggagaagaaggaccccactggtgccaaggttaccaaggctgctgctaagaagaaatgagaggtctgagggttgttatcgtctgctggttttcatctatcttagtagtcttagtgctgttttaagctttgtcaggccattgttctcgcagctaggccttgcagttgtgagcaactgtaaattctgctgacaatgtgccctactgtcgggggtcctgtaaacgctactgttattttggttg

SEQ ID NO: 502 - DNA, 1529 bp, Cicer arietinum
aacgcgtcttcgtttttcttagctaagatatcatgggtaaagagaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccattgatattgccttgtggaaattcgagaccaccaagtactactgcacagtcatcgatgcccccggacatcgtgatttcattaagaacatgattactggtacctcccaggctgattgtgctgtccttatcattgactccaccactggtggttttgaggctggtatctctaaggatggacagacccgtgagcatgctcttcttgctttcactcttggagtgaaacagatgatctgttgttgtaacaagatggatgccaccacacccaagtactcaaaggccaggtacgatgaaatcgtgaaggaagtttcttcatacttgaagaaggttggttacaaccctgacaaaatccccttcgttccaatctctggatttgagggagacaacatgattgagaggtccaccaaccttgactggtacaagggaccaactctccttgaagctcttgaccagatcaacgagcccaagagaccctcagacaagcccctcaggcttccattgcaagatgtttacaagatcggtggtattggaactgtgccagtcggacgtgttgagactggagtcatcaagcctggtgtgattgttacctttggccctaccggtctgacaactgaagttaagtctgttgagatgcaccacgaggctctcaccgaagctctccccggagacaatgttggattcaatgttaagaatgttgcagtgaaggatctcaagcgtggtttcgttgcatccaactccaaggatgaccctgctaaggaagctgccaacttcacttcccaagtcatcatcatgaaccatccaggacagattggaaacggttatgccccagtcctcgactgtcacacctcccacattgctgttaagttcgctgagcttctcaccaagattgacagacgatctggtaaggaactcgagaaggagcctaagtttttgaagaatggtgatgctggtcttgttaagatgattccaacaaagcctatggttgtggaaactttctccgagtatccaccacttggtcgttttgctgtgagggacatgcgtcaaactgttgctgtcggtgtcattaagagtgttgagaagaaggatccaactggagccaagatcaccaaggctgcagtcaagaagaagtgagtttgcacatcatcatcaccatggttgctgctgaagttgttcctttatagtagtttatctttccggagtcttagtttaattttgcagtttattttgcaagtctttgccggtttagtcgtgggaggcaagggcacacagggggatagggggggg

SEQ ID NO: 503 - DNA, 1643 bp, Cicer arietinum
cgaacgagtcttagatttcatttcttctttgctaagatatcatgggtaaagaaaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctcccaagctgattgtgctgtccttatcattgactccaccactggtggttttgaggctggtatctctaaggatggacagacccgtgagcacgcccttcttgctttcactcttggagtgaaacagatgatctgttgttgtaacaagatggatgccactacacccaagtactcaaaggccaggtacgatgaaatcgtgaaggaagtttcttcatacttgaagaaggttggttacaaccctgacaaaatccccttcgttccaatctctggatttgagggagacaacatgattgagaggtccaccaaccttgactggtacaagggaccaactctccttgaggctcttgaccagatcaacgagcccaagagaccctcagacaagcccctcaggcttccattgcaagatgtttacaagatcggtggtattggaactgtgccagtcggacgtgttgagactggagtcatcaagcctggtgtgatcgttacctttggccctaccggtctgacaactgaagttaagtctgttgagatgcaccacgaggctctcaccgaagctctccccggagacaatgttggattcaatgttaagaatgttgcagtgaaggatctcaagcgtggtttcgttgcatccaactccaaggatgaccctgctaaggaagctgccaacttcacttcccaagtcatcatcatgaaccatccaggacagattggaaacggttatgccccagtcctcgactgtcacacctcccacattgctgttaagttcgctgagcttctcaccaagattgacagacgatctggtaaggaactcgagaaggagcctaagtttttgaagaatggtgatgctggtcttgttaagatgattccaacaaagcctatggttgtggaaactttctccgagtatccaccacttggtcgttttgctgtgagggacatgcgtcaaactgttgctgtcggtgtcattaagagtgttgagaagaaggatccaactggagccaagatcaccaaggctgcagtcaagaagaagtgagtttgcacatcatcatcaccatggttgctgctgaagttgttcctttatagtagtttatctttccggagtcttagtttaattttgcagtttattttgcaagtctttgccggtttcattcagccaaacttacaaaactgggttcttgatcggcggtggtcatatttattttgtggttgtttttgatggtgctgtttttgcttatttgatcttttgagaacttcattttgtaaaagcagctaggtttcatggtttaatttt

SEQ ID NO: 504 - DNA, 1742 bp, Cicer arietinum
cccccccccccctactcccctgtgtcgcttcgcctcccacgactattcattcatccttcagtctctctgcggctgaggattccgaacgcgtcttcgtttttcttagctaagatatcatgggtaaagagaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctcccaagctgattgtgctgtccttatcattgactccaccactggtggttttgaggctggtatctctaaggatggacagacccgtgagcacgctcttcttgctttcactcttggagtgaaacagatgatctgttgttgtaacaagatggatgccactacccccaagtactccaaggccaggtacgatgaaatcgtgaaggaagtttcttcatacttgaagaaggttggttacaaccctgacaaaatccccttcgtgccaatctctggatttgagggagacaacatgattgagaggtccaccaaccttgactggtacaagggaccaactctccttgaggctcttgaccagatcaacgagcccaagagaccctcagacaagcccctcaggcttccattgcaagatgtttacaagatcggtggtattggaactgtgccagtcggacgtgttgagactggagtcatcaagcctggtgtgatcgttacctttggccctaccggtctgacaactgaagttaagtctgttgagatgcaccacgaggctctcaccgaagctctccctggagacaatgttggattcaatgttaagaatgttgcagtgaaggatctcaagcgtggtttcgttgcatccaactccaaggatgaccctgctaaggaagctgccaacttcacttcccaagtcatcatcatgaaccatccaggacagattggaaacggttatgccccagtcctcgactgtcacacctcccacattgctgttaagttcgctgagcttctcaccaagattgacagacgatctggtaaggaactcgagaaggagcctaagtttttgaagaatggtgatgctggtcttgttaagatgattccaacaaagcctatggttgtggaaactttctccgagtatccaccacttggtcgttttgctgtgagggacatgcgtcaaactgttgctgtcggtgtcattaagagtgttgagaagaaggatccaactggagccaagatcaccaaggctgcagtcaagaagaagtgagtttgcacatcatcatcaccatggttgctgctgaagttgttcctttatagtagtttatctttccggagtcttagtttaattttgcagtttatttgcaagtctttgccggtttcattcagccaaacttacaaaactgggttcttgatcggcggtggtcatatttattttgtggttgttttgatggtgctgtttttgcttatttgatcttttgagaacttcattttgtaaaagcagctaggtttcatggtttaatttgctgctgaaggatgcagtcgtgggagg

SEQ ID NO: 505 - DNA, 1607 bp, Cicer arietinum
attcatccttcagtctctctgcggctgaggattccgaacgcgtcttcgtttttcttagctaagatatcatgggtaaagagaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccattgatattgccttgtggaaattcgagaccaccaagtactactgcacagtcatcgatgcccccggacatcgtgatttcattaagaacatgattactggtacctcccaggctgattgtgctgtccttatcattgactccaccactggtggttttgaggctggtatctctaaggatggacagacccgtgagcatgctcttcttgctttcactcttggagtgaaacagatgatctgttgttgtaacaagatggatgccaccacacccaagtactcaaaggccaggtacgatgaaatcgtgaaggaagtttcttcatacttgaagaaggttggttacaaccctgacaaaatccccttcgttccaatctctggatttgagggagacaacatgattgagaggtccaccaaccttgactggtacaagggaccaactctccttgaagctcttgaccagatcaacgagcccaagagaccctcagacaagcccctcaggcttccattgcaagatgtttacaagatcggtggtattggaactgtgccagtcggacgtgttgagactggagtcatcaagcctggtgtgattgttacctttggccctaccggtctgacaactgaagttaagtctgttgagatgcaccacgaggctctcaccgaagctctccccggagacaatgttggattcaatgttaagaatgttgcagtgaaggatctcaagcgtggtttcgttgcatccaactccaaggatgaccctgctaaggaagctgccaacttcacttcccaagtcatcatcatgaaccatccaggacagatcggaaacggttatgccccagtcctcgactgtcacacctcccacattgctgttaagttcgctgagcttctcaccaagatcgacaggcgatctggtaaggaacttgagaaggagcctaagtttttgaagaatggtgatgctggtcttgttaagatgattccaaccaagcctatggttgtggaaactttctctgagtatccaccacttggtcgtttcgccgtgagggacatgcgtcaaaccgttgctgtcggtgtcatcaagagtgttgagaagaaggatccaactggagccaagatcaccaaagctgcagtgaagaagaagtgatggttgatgcagaagtggatgttgctttatagtagcttattatcttttaagagtcttagtttatttttgccttttaattttgccgtttttatgcagccaaacttgcaaaactgggttcttgatcggcgatggtcgaactttattttgtggttgttttgattttgatggtactgttttgaattaaattatgagtct

SEQ ID NO: 506 - DNA, 1634 bp, Cicer arietinum
cttcagtctctctctgcggctgaggattccgaacgagtcttagatttcatttcttctttgctaagatatcatgggtaaagaaaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctcccaagctgattgtgctgtccttatcattgactccaccactggtggttttgaggctggtatctctaaggatggacagacccgtgagcacgctcttcttgctttcactcttggagtgaaacagatgatctgttgttgtaacaagatggatgccaccacacccaagtactcaaaggccaggtacgatgaaatcgtgaaggaagtttcttcatacttgaagaaggttggttacaaccctgacaaaatccccttcgttccaatctctggttttgagggagacaacatgattgagaggtccaccaaccttgactggtacaagggaccaactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttggccctactggtctgacaactgaagttaagtctgttgagatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgccccagtcctcgactgtcacacctcccacattgctgttaagttcgctgagcttctcaccaagatcgacaggcgatctggtaaggaacttgagaaggagcctaagtttttgaagaatggtgatgctggtcttgttaagatgattccaaccaagcctatggttgtggaaactttctccgagtatccaccacttggtcgtttcgccgtgagggacatgcgtcaaactgttgctgtcggtgtcatcaagagtgttgagaagaaggatccaactggagccaagatcaccaaagctgcagtgaagaagaagtgatggttgatgcagaagtggatgttgctttatagtagcttattatcttttaagagtcttagtttatttttgccttttaattttgccgtttttatgcagccaaacttgcaaaactgggttcttgatcggcgatggtcgacctttattttgtggttgttttgattttgatggtactgtttttgaattaaattatgagtcttgagaacttattttcagaggcaca

SEQ ID NO: 507 - DNA, 1489 bp, Cicer arietinum
cttctagtctctctgcggcgtgaggagttccgtaacgcgtcttcgtttttcttagctaagatatcatgggtaaagagaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctcccaagctgattgtgctgtccttatcattgactccaccactggtggttttgaggctggtatctctaaggatggacagacccgtgagcacgctcttcttgctttcactcttggagtgaaacagatgatctgttgttgtaacaagatggatgccaccacacccaagtactcaaaggccaggtacgatgaaatcgtgaaggaagtttcttcatacttgaagaaggttggttacaaccctgacaaaatccccttcgttccaatctctggttttgagggagacaacatgattgagaggtccaccaaccttgactggtacaagggaccaactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttggccctactggtctgacaactgaagttaagtctgttgagatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgccccagtcctcgactgtcacacctcccacattgctgttaagttcgctgagcttctcaccaagatcgacaggcgatctggtaaggaacttgagaaggagcctaagtttttgaagaatggtgatgctggtcttgttaagatgattccaaccaagcctatggttgtggaaactttctccgagtatccaccacttggtcgtttcgccgtgagggacatgcgtcaaactgttgctgtcggtgtcatcaagagtgttgagaagaaggatccaactggagccaagatcaccaaagctgcagtgaagaagaagtgatggttgatgcagaagtggatgttgctttatagtagcttattatcttttaagagtcttagtttattttgccttttaatttt

SEQ ID NO: 508 - DNA, 1795 bp, Cicer arietinum
gacaactccttacttgttctttcattcttcagtctctctctgcggctgaggattccgaacgagtcttagatttcatttcttctttgctaagatatcatgggtaaagaaaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctcccaagctgattgtgctgtccttatcattgactccaccactggtggttttgaggctggtatctctaaggatggacagacccgtgagcacgcccttcttgctttcactcttggagtgaaacagatgatctgttgttgtaacaagatggatgccactacacccaagtactcaaaggccaggtacgatgaaatcgtgaaggaagtttcttcatacttgaagaaggttggttacaaccctgacaaaatccccttcgttccaatctctggatttgagggagacaacatgattgagaggtccaccaaccttgactggtacaagggaccaactctccttgaggctcttgaccagatcaacgagcccaagagaccctcagacaagcccctcaggcttccattgcaagatgtttacaagatcggtggtattggaactgtgccagtcggacgtgttgagactggagtcatcaagcctggtgtgatcgttacctttggccctaccggtctgacaactgaagttaagtctgttgagatgcaccacgaggctctcaccgaagctctccccggagacaatgttggattcaatgttaagaatgttgcagtgaaggatctcaagcgtggtttcgttgcatccaactccaaggatgaccctgctaaggaagctgccaacttcacttcccaagtcatcatcatgaaccatccaggacagattggaaacggttatgccccagtcctcgactgtcacacctcccacattgctgttaagttcgctgagcttctcaccaagattgacagacgatctggtaaggaactcgagaaggagcctaagtttttgaagaatggtgatgctggtcttgttaagatgattccaacaaagcctatggttgtggaaactttctccgagtatccaccacttggtcgttttgctgtgagggacatgcgtcaaactgttgctgtcggtgtcattaagagtgttgagaagaaggatccaactggagccaagatcaccaaggctgcagtcaagaagaagtgagtttgcacatcatcatcaccatggttgctgctgaagttgttcctttatagtagtttatctttccggagtcttagtttaattttgcagtttattttgcaagtctttgccggtttcattcagccaaacttacaaaactgggttcttgatcggcggtggtcatatttattttgtggttgtttttgatggtgctgtttttgcttatttgatcttttgagaacttcattttgtaaaagcagctaggtttcatggtttaattttgctgctgaaggatgttcaattgcatttaatttataagacatttttgtcaatccttcatccggattttgtttatggttttattttaatatccagttta

SEQ ID NO: 509 - DNA, 2078 bp, Cicer arietinum
cacttatcataagtgtgaaacaaaaacgttcaaataagaaagcgagggtatattcggaaattaaaaataaaacgaaggatactttgggaatatgaaaaaatctttatgactataaaaaagttgtaaccctagttttttcattacaactccttacttgttctttcattcttcagtctctctctgcggctgaggattccgaacgagtcttagatttcatttcttctttgctaagatatcatgggtaaagaaaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctcccaagctgattgtgctgtccttatcattgactccaccactggtggttttgaggctggtatctctaaggatggacagacccgtgagcacgcccttcttgctttcactcttggagtgaaacagatgatctgttgttgtaacaagatggatgccactacacccaagtactcaaaggccaggtacgatgaaatcgtgaaggaagtttcttcatacttgaagaaggttggttacaaccctgacaaaatccccttcgttccaatctctggatttgagggagacaacatgattgagaggtccaccaaccttgactggtacaagggaccaactctccttgaggctcttgaccagatcaacgagcccaagagaccctcagacaagcccctcaggcttccattgcaagatgtttacaagatcggtggtattggaactgtgccagtcggacgtgttgagactggagtcatcaagcctggtgtgatcgttacctttggccctaccggtctgacaactgaagttaagtctgttgagatgcaccacgaggctctcaccgaagctctccccggagacaatgttggattcaatgttaagaatgttgcagtgaaggatctcaagcgtggtttcgttgcatccaactccaaggatgaccctgctaaggaagctgccaacttcacttcccaagtcatcatcatgaaccatccaggacagattggaaacggttatgccccagtcctcgactgtcacacctcccacattgctgttaagttcgctgagcttctcaccaagattgacagacgatctggtaaggaactcgagaaggagcctaagtttttgaagaatggtgatgctggtcttgttaagatgattccaacaaagcctatggttgtggaaactttctccgagtatccaccacttggtcgttttgctgtgagggacatgcgtcaaactgttgctgtcggtgtcattaagagtgttgagaagaaggatccaactggagccaagatcaccaaggctgcagtcaagaagaagtgagtttgcacatcatcatcaccatggttgctgctgaagttgttcctttatagtagtttatctttccggagtcttagtttaattttgcagtttattttgcaagtctttgccggtttcattcagccaaacttacaaaactgggttcttgatcggcggtggtcatatttattttgtggttgtttttgatggtgctgtttttgcttatttgatcttttgagaacttcattttgtaaaagcagctaggtttcatggtttaattttgctgctgaaggatgttcaattgcatttaatttataagacatttttgtcaatccttcatcctgattttgttttatggttttatttttaatatccagtttatgaatgtgtatgctttgattgagcttgtcatttagtatatttgattgttcaaggcttcaatcaagtattcagacgttggttttgtgaattactttcattgcctgatatttcactatggagtgacgttttttttattatac

SEQ ID NO: 510 - DNA, 1636 bp, Gossypium hirsutum
ccagttcttcattttcattttcttgttccttccttcgccgtctattgctttttgttacctcgatttcaagtgaatcagaatgggtaaggaaaagactcacattaacattgtggttatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccacgaaatactactgcactgtgattgatgcacctggacaccgtgactttatcaagaatatgattactggtacgtcacaggctgactgtgctgttttgattattgattccaccactggtggttttgaggctggtatctccaaggatggtcagactcgtgagcacgcattgcttgcttttacccttggtgtcaagcaaatgatttgctgttgcaacaagatggatgccactacccctaaatactcgaaggctaggtatgatgaaattgtgaaggaagtctcttcctacttgaagaaggtgggatacaaccctgacaagattccatttgttcccatttctggttttgagggtgacaacatgattgagaggtctaccaacttggactggtacaagggccctactcttcttgaggctcttgaccagatcaatgagcccaagaggccttcagacaagcctctccgtctcccacttcaggatgtgtacaagattggtggtattggaactgttccagttggtcgtgttgaaaccggtgtcttgaagcctggtatggttgtgacatttggcccttctggtctgacaactgaagttaagtcagttgagatgcaccatgaagctcttacagaggcacttcctggtgataatgttgggttcaatgttaaaaacgttgctgttaaggatctcaagcgtggttttgttgcatccaactccaaggatgaccctgctaaggaggctgccaacttcacttctcaggtcatcattatgaaccaccctggacaaattggaaatggatatgctccagtccttgactgccacacgtcacacattgctgttaagtttgctgagcttttgaccaagattgacaggcgatctggtaaggagcttgagaaggaacccaagttcttgaagaatggtgatgctggtatgattaagatgattcctaccaagcccatggttgtggagaccttctctgagtacccacccctgggtcgttttgctgtgagggacatgcgtcagaccgtggctgttggtgttatcaagagtgtcgagaagaaggacccaaccggtgccaaggtcaccaagtctgctgctaagaagaagtgaagaggccaaaaggttttagccgtgaagcagattgagtgttttatctttggttatatgtggtttgaagtttttgcctgttttatgtaggatttttaaagtttgagatgctttggtttgccaaggcgtcttagtcaagttttgtgtctgatcttgcggaactatactttgttttttctatatatttgtctgtttcatttttctattttactagtt

SEQ ID NO: 511 - DNA, 1667 bp, Cucumis sativus
acctcgctgcttgctcctgcgtgaaatttaggctgcttctttcttttgatttctctgcaaattcttgtggttcgattaataccaaatgggtaaagaaaagactcatatcaacatcgtggttattggccatgtcgactctggaaagtcgaccaccactggtcatcttatctacaagcttggagggattgacaagcgtgtgattgagagattcgagaaggaagccgctgagatgaacaagaggtcattcaagtatgcttgggtgctcgacaaacttaaggcagagcgtgaacgtggtattaccattgacattgccctgtggaagtttgagaccaccaagtactactgcacagtcattgatgctcccggacatcgtgactttatcaagaacatgattactggaacctcacaggctgactgtgctgtcctcattattgactccaccactggtggttttgaggctggtatttccaaggatggtcagacccgtgagcacgctcttcttgctttcacccttggtgtcaagcaaatgatctgctgctgcaacaagatggatgccaccacacccaaatactccaaggcaaggtacgatgaaattgtgaaggaagtctcatcatacctcaagaaggtcggatacaacccagacaaaatccccttcgttcccatctctggtttcgagggtgacaacatgattgagaggtccaccaaccttgattggtacaagggaccaacccttcttgaggctcttgacttgatctctgagcccaagaggccctcagacaagcccctccgtctcccacttcaggacgtttacaagattggtggtattggaactgtccctgttggacgtgttgaaactggtgtcctcaagcctggtatggttgttaccttcggaccaactggactgaccactgaagttaagtctgttgaaatgcaccacgagtctctcccagaagctttgccaggtgacaatgttggcttcaacgtcaagaacgttgctgtcaaggatctcaagcgtggtttcgttgcctcaaactccaaggatgaccctgccaaggaagctgctaactttacatctcaggttatcatcatgaaccaccctggtcagattggtaatggttatgctccagtccttgattgccacacttcccacattgctgttaagttcgctgagatcctcaccaaaatcgatcgtcgatctgctaaggagcttgagaaggagcccaagttcttgaagaatggagatgccggtatggttaagatgattccaaccaaacccatggttgtggagaccttctctacatacccaccattgggtcgatttgctgtccgtgatatgcgtcaaaccgttgctgttggtgttatcaagagtgtggagaagaaggacccaacaggagccaaggtcaccaagtccgctgtgaagaagaaataggtgatcaatcaagcctgcgttgtgtcattgagaaaacatggttttaatatgcaaaatatgagacttttggtttttggtactcttagtggttcttatttatttagtttacatgtctggttttgtgttttttctctttttaattttggtatgctgttttgagtcattttgagacattaaattgttggatactgctgagggttaaatgtttttaatctaagttttaatttctcttctgcca

SEQ ID NO: 512 - DNA, 1502 bp, Cynodon dactylon
atgggtaaggagaagagtcacattaacattgtggtcattggacatgtcgactctggcaagtcgactaccactggccacctgatctacaagcttggaggaattgacaagcgtgtgattgagcggttcgagaaggaggctgctgaaatgaacaagaggtccttcaagtacgcgtgggttcttgacaagctcaaggctgagcgtgagagaggtatcaccattgatattgccctgtggaagttcgagaccaccaagtactactgcacagtcattgatgcccctggacaccgtgacttcatcaagaacatgattactggcacctcccaggctgactgtgctgtgcttatcattgactccaccactggtggttttgaggctggtatctccaaggatggccagacccgtgagcatgctctccttgctttcactcttggagtgaagcagatgatctgctgctgcaacaagatggatgccaccactcccaagtactcaaaggctcgttatgatgagattgtgaaggaagtctcttcatacctcaagaaggttggctacaaccctgacaagatccccttcgttcccatctctgggtttgagggtgacaacatgattgagaggtccaccaaccttgactggtacaagggccccaccctgcttgaggctcttgaccagatcaacgagccgaagaggccctcagacaagccgctgcgtcttccccttcaggatgtgtacaagatcggtggtattggaactgtgcctgtgggccgtgtggagactggtgtcctcaagcctggtatggttgtcacctttggtcccagcggactgaccactgaggtcaagtctgtggagatgcaccacgaggctctccaggaggcccttcctggtgacaatgttgggttcaacgtgaagaacgttgctgtgaaggatctcaagcgtgggttcgtggcctccaactccaaggatgaccctgccaaggaggctgccagcttcacctcccaggtcatcatcatgaaccaccctggtcagatcggcaatggctacgccccagtgctggactgccacacctcccacatcgctgtcaagtttgctgagctgctgaccaagattgacagacgatctggcaaggagctcgagaaggagcccaagttcctgaagaacggtgatgctggtatggtgaagatgattcccaccaagcccatggttgtggagaccttctctcagtaccctcctcttggtcgttttgctgttcgtgacatgaggcaaacggttgctgttggtgtcatcaagagcgtggagaagaaggacccgaccggtgccaaggttaccaaggccgctgccaagaagaaatgaggcgtttgttcaagtcctattatctagctcgttttagtgcatgtttaagttttgtcttgtggggatgctatgctatgcaccttatttctgtgtcttaagctactgtcgagttatggatgagacttaaattgtggtttaataccatggaattccggagt

SEQ ID NO: 513 - DNA, 1741 bp, Setaria italica
attccaccgagcggcctccctaactcgactccgccgcccctccacgccgcctccttcgcttcctcagtttaagcctcacctgcagccatgggtaaggagaagtcccacatcaacatcgtggtcattggccacgtcgactctggcaagtcgaccaccaccggccacctgatctacaagcttggaggtatcgacaagcgtgtgatcgagaggttcgagaaggaggccgctgagatgaacaagaggtccttcaagtatgcgtgggtgcttgacaagctcaaggctgagcgtgagaggggtatcaccattgatattgccctgtggaagttcgagaccaccaagtactactgcaccgtcattgacgcccctggacaccgtgacttcatcaagaacatgattaccggtacctcccaggcagactgtgctgtccttatcattgactccaccactggtggttttgaggctggtatctccaaggatggccagacccgtgagcatgctctccttgctttcactcttggagtgaagcagatgatctgctgctgcaataagatggatgccaccactcccaagtactccaaggcccgttatgatgagattgtgaaggaagtctcctcctacctgaagaaggtgggttacaaccctgacaagattgccttcgtccccatctccggttttgagggtgacaacatgattgagaggtccaccaaccttgactggtacaagggcccaaccctgcttgaggctcttgaccagatcaacgagcccaagaggccttcggacaagcccctgcgtcttccccttcaggatgtgtacaagattggtggtattggaaccgtccctgttggccgtgttgagaccggtgtcatcaagcctggtatgcttgtcacctttggtccaactggcctgactactgaggtgaagtctgttgagatgcaccatgaggctctccaggaggcccttcctggtgacaacgttggcttcaacgtgaagaacgttgctgttaaggatctcaagcgtggttttgtggcctccaactccaaggatgaccctgccaaggaagctgccagcttcacctcccaggtcatcatcatgaaccaccctggccagatcggcaatggttacgccccagtcctggactgccacacctcccacatcgctgtcaagtttgctgagctcattaccaagatcgacagacggtccggtaaggagcttgagaaggagcccaagttcctgaagaacggcgatgctggtatggtgaagatgattcccaccaagcccatggtggtggagaccttctctgagtaccctcctctgggtcgctttgctgtccgtgacatgaggcagacggttgctgtgggagtcatcaagagcgtggagaagaaggacccgaccggcgccaaggttaccaaggctgctgccaagaagaaatgatgggcctggtggttaatcctgcatctgcttttgcgatacctaggtgccttgtctttatcacacaagttttgtccgccacttctgttagcctgtgaactgttaaggtctgctggcggtgtgctatgtatcagttgtttaggtaccatcttagctttggctaaacttgaatggtccaagaccatgtgtacccttttgtgagacgttattggttggatgtattgtcggagtctttcgttctgcattttttttattgttttcttagtgttgtttgctcttctgagtggattgtgtggtttttgaagccttccta

SEQ ID NO: 514 - DNA, 1851 bp, Setaria italica
ccaggtccaggcagcctctcccccgcgccgtcacctgcgccgccgcctccttcctacgccccttctcatccgcttcctcagcggtttaagcttcaccggcagccatgggtaaggagaagtcccacatcaacattgtggtcattggccacgtcgactctggcaagtcaaccaccaccggccacctgatctacaagcttggaggtatcgacaagcgtgtgatcgagaggttcgagaaggaggccgctgagatgaacaagcggtccttcaagtacgcgtgggtgcttgacaagctcaaggctgagcgtgagagaggtatcaccattgatatcgccctgtggaagtttgagaccaccaagtactactgcaccgtcattgacgcccctggacatcgtgacttcatcaagaacatgatcactggtacctcccaggctgactgtgctgtccttatcattgactccaccactggtggttttgaggctggtatctcaaaggatggccagacccgtgagcatgctctccttgctttcactctcggagtgaagcagatgatctgctgctgcaacaagatggacgccaccactcccaagtactccaaggcccgttatgatgagattgtgaaggaagtctcctcctacctgaagaaggtgggttacaaccctgacaagattgccttcgtccccatctccggttttgagggtgacaacatgattgagaggtccaccaaccttgactggtacaagggcccaaccctgcttgaggctcttgaccagatcaacgagcccaagaggccttcggacaagcccctgcgtcttccccttcaggatgtgtacaagattggtggtattggaaccgtccctgttggccgtgttgagaccggtgtcatcaagcctggtatgcttgtcacctttggtccaactggcctgactactgaggtgaagtctgttgagatgcaccatgaggctctccaggaggcccttcctggtgacaacgttggcttcaacgtgaagaacgttgctgttaaggatctcaagcgtggttttgtggcctccaactccaaggatgaccctgccaaggaggctgccagcttcacctcccaggtcatcatcatgaaccaccctggccagatcggcaatggttacgccccagtcctggactgccacacctcccacatcgctgtcaagtttgctgagctcattaccaagatcgacagacggtccggtaaggagcttgagaaggagcccaagttcctgaagaacggcgatgctggtatggtgaagatgattcccaccaagcccatggtggtggagaccttctctgagtaccctcctctgggtcgctttgctgtccgtgacatgaggcagacggttgctgtgggagtcatcaagagcgtggagaagaaggacccgaccggcgccaaggttaccaaggctgctgccaagaagaaatgatgggcctggtggttaatcctgcatctgcttttgcgatacctaggtgccttgcctctatcacacaagttttgtccgccaccacttctgttatcctgtaaactgttgaggtctgctggcggtgtgccatgtgtctgttgtttaggtaccatcttagctttgttaaaacttgaatgctccaataccatgtgtacccttttgtgagacgttattcgttggatgtattgttgggagtctttcttatctttgtgcattttgtttattgttttctactgttttgctcttctgattggattgtgttttttcaagccttgctccagtagaaaatgaagggtatttgtttttgagttttagtgtagtctttggtgtttactgcaaaacgtgtttttccattgccataatgttt

SEQ ID NO: 515 - DNA, 1967 bp, Gossypium raimondii
ttggatgcgcttagtatccacggaattcccagagaacccccggctttgactgcagtcaatgaaacgaaatgcaaggccaatttcgtaaaactgccctaattgaatctccttgtgtaaccctaaccctagctcttgttgcttttgctcaatatatatagcaggcagagcccttaggtcttaacccagttcttcattttcattttcttgttccttccttcgccgtctattgctttttgttacctcgatttcaagtgaatcagaatgggtaaggaaaagactcacattaacattgtggtcatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccaccaaatactactgcactgtgattgatgcacctggacaccgtgactttatcaagaatatgattactggtacgtcacaggctgactgtgctgttttgattattgattccaccactggtggttttgaggctggtatctccaaggatggtcagactcgtgagcacgcattgcttgcttttacccttggtgtcaagcaaatgatttgctgttgcaacaagatggatgccactacccctaaatactcgaaggctaggtatgatgaaattgtgaaggaagtctcttcctacttgaagaaggtgggatacaaccctgacaagattccatttgttcccatttctggttttgagggtgacaacatgattgagaggtctaccaacttggactggtacaagggccctactcttcttgaggctcttgaccagatcaatgagcccaagaggccttcagacaagcctctccgtctcccacttcaggatgtgtacaagattggtggtattggaactgttccagttggtcgtgttgaaaccggtgtcttgaagcctggtatggttgtgacctttggcccttctggtctgacaactgaagttaagtcagttgagatgcaccatgaagctcttacagaagcacttcctggtgataatgttgggttcaatgttaaaaacgttgctgttaaggatctcaagcgtggttttgttgcatccaactccaaggatgaccctgctaaggaggctgccaacttcacttctcaggtcatcattatgaaccaccctggacaaattggaaatggatatgccccagtccttgactgccacacgtcacacattgctgttaagtttgctgagcttttgaccaagattgacaggcgatctggtaaggagcttgagaaggaacccaagttcttgaagaacggtgatgctggtatgattaagatgattcctaccaagcccatggttgtggagaccttctctgagtacccacccctgggtcgttttgctgtgagggacatgcgtcagaccgtggctgttggtgttatcaagagtgtcgagaagaaggacccaaccggtgccaaggtcaccaagtctgctgctaagaagaagtgaagaggccaaaaggttttagcggtgaagcagattgagtgttttatctttggttatatgtggtttgaagtttttgcctgttttatgtaggatttttaaagtttgagatgctttggtttgccaaggcatcttagtcaagttttgtgtctgatcttgcggaactatactttgttttttctatatatttgtctgtttcatttttctattttactagtttcatttagacctacaattttgcgataaatgctgaaaaatttattgaacatcactaaaatgggcaatttataaaaaaaaaagtcgttttttttcaaaatttatcgaaatgggttgattttttgattatttatcggaatgggctatttttc

SEQ ID NO: 516 - DNA, 1935 bp, Zea mays
accctagggcgcgttccttataaaacctatctccattctgttctcactctcagacaccagacgcagtcggctgccgcagactggtagtagccggcgcgccgtcaccgtatcctcagatcagcggcgagcagaaaccacaccactctactgacgcccgacgagcagtgtaacattttccttcagccatgggtaaggagaagactcacatcaacattgtggtcattggccatgtcgactctggcaagtcgaccaccactggccacctgatctacaagcttggaggtattgacaagcgagtgattgagaggttcgagaaagaggctgccgagatgaacaagcggtcattcaagtatgcgtgggtgcttgacaagctcaaggctgagcgtgagagaggtattacaattgatattgccctgtggaagttcgagaccaccaagtactactgcactgttattgatgccccgggacaccgtgacttcatcaagaatatgatcactggcacttcccaagctgactgtgctgttcttatcattgactcaaccactggtggttttgaggctggtatctccaaggatggccagacccgtgagcatgctctccttgctttcacacttggtgtgaagcagatgatttgctgctgcaacaagatggatgctactacacccaagtattcaaaggcccgttatgatgagattgtgaaggaagtctcttcctacctgaagaaggttggatacaaccctgataagatccacttcgttccaatctctggttttgaaggtgacaacatgattgagaggtccaccaaccttgactggtacaagggcccaaccctacttgaggctctggacttgatcaatgagccaaagaggccttcagacaagcccctgcgtctcccccttcaggatgtgtacaagattggtggtattggaactgtccctgttggacgtgttgagactggtgtcattaagcctggtatggttgttacttttgggcctactggtcttactactgaggttaagtccgttgagatgcaccatgaggctctccaggaggcccttcctggtgacaatgttggcttcaacgtgaagaatgttgctgtgaaggatctgaagcgtgggtatgtggcctccaactccaaggatgaccctgccaaggaggctgctagcttcacctcccaggtcatcatcatgaaccaccctggccagattggcaatggctatgccccagttctggactgccacacctcacacattgctgtcaagtttgctgagctcgttaccaagattgataggcgatccggcaaggagctggagaaggagcccaaatttctcaagaacggtgatgctggtatggtgaagatggttcccactaagcccatggtggtggagaccttttctcagtatcctcctcttggtcgatttgctgtccgtgacatgaggcaaacggtggctgtcggagtcatcaagagtgtggagaagaaggacccaactggagccaaggtgacgaaggctgctgccaagaagaaatgatctatctggctggtgctgtgcttgcttgttggttacctcgtggaagcttaaaatatctcgtcttgttgacatccttgcagttgtcgcgtgaacaagtaatctatgatggcaatgtttgcctggtcatgaagtattattactttcgttgaaaccgtgatgctattaagacttaatttttttatggaacatcgaatgtaaggcatacatggttatgagttttgtactaccctttgcagtgtgttcctgtttaccttttgtgctgatgattcgcttgtctttgtgtcttcaagttaatcttgcacttaactgtttttaatatgccagatcgtttcaaaagatttgaaatttggattcttccgaaacgtttttttgataataatgtagtcctgaaaacatgattttgatt

SEQ ID NO: 517 - DNA, 1814 bp, Zea mays
tggctccgtttatgggccctgggccgccattcgggagtcaattatttggctggtccggcctacgccgaagcccttatataaagtctcgaaccctagaggccagcaccttcctccccaactcgccgtcgtcttctgcggttctgccgtctacgcctccaatttggcctctctcccttgcaagtttaagcttcatcttcagccatgggtaaggagaagtcccacatcaacattgtggtcattggccacgtcgactctggcaagtcgaccaccaccggccacctgatctacaagcttggaggcattgacaagcgtgtaatagagaggtttgagaaggaggctgctgagatgaacaagcggtccttcaagtatgcttgggtgctcgacaagctcaaggctgagcgtgagaggggtatcaccattgatattgctctgtggaagtttgagaccaccaagtattactgcaccgtcattgatgcccctggacaccgtgacttcatcaagaacatgatcactggtacctcccaggctgactgtgctgtccttatcattgactccaccactggtggttttgaggctggtatctccaaggatggccagacccgtgagcatgctctccttgcgttcactcttggagtgaaacagatgatttgctgctgcaacaagatggatgcaacgactcccaaatactccaaggcgcgttatgatgagattgtgaaggaagtctcatcctacctcaagaaagttgggtacaaccctgataagattgcctttgtccccatctctggttttgagggcgacaacatgattgagaggtccaccaaccttgactggtacaaaggcccgaccctgcttgaggctcttgaccagatcaccgagcccaagagaccttcggacaagcccctgcgtctccccctgcaggatgtgtacaagattggtggtattggaactgtaccggttggtcgtgtggagactggtgtcatcaagcctggtatggttgtcaccttcggtccaactggcctgactactgaggtgaagtctgttgagatgcaccacgaggctcttcaggaggcccttcctggtgacaatgttggcttcaacgtgaagaacgttgctgtgaaggatctcaagcgtggttttgtggcctcaaactccaaggatgaccctgccaaggaggctgccagcttcacgtcccaggtcatcatcatgaaccaccctgggcagataggcaatggctatgccccagtgctggactgccacacctcccacattgctgtcaagtttgctgaactcattaccaagatcgacaggcggtctggcaaggagcttgagaaggagcccaagttcctgaagaacggtgatgctggtatggtgaagatgattcccaccaagcccatggtggtggagacattctcgcagtatcctccccttggtaggtttgctgtccgcgacatgaggcagacagttgctgttggagtcatcaagagtgtggagaagaaggacccgaccggcgccaaggttaccaaggcagctgccaaaaagaaatgatgcaacctgtcgttaatcctgtatctgcttttgcaatacctgacttgtcactccatcccgaagttttgtatgcggttgttactgttattgtgtactgttaagctctgctgcggcgtgccctgttgtttgggtagcgtcaacgtcgagcgccacttgcgggtgtgcctttgtctgctatcagtagcggcaaaaattgaaagctctcgagacttatgtcccttttgggcgccgttgaactgattattttaaagtctgcccacatttttcta

SEQ ID NO: 518 - DNA, 1995 bp, Zea mays
attgatgggctggccggcctacgccgacgcacttatataaaagccccgaaccctagaggccagcagcacattcttccccgagtcgccgtcgtctgctccgggctgctgttctgcgcctccacaaggctttggcctctgttgtaagttttaagcttcacctccagccatgggtaaggagaagtcccacatcaacattgtggttattggccatgtcgactctggcaagtcaaccaccaccggccacctgatctacaagcttggaggcattgacaagcgtgtgattgagaggttcgagaaggaagccgctgaaatgaacaaacggtccttcaagtacgcttgggtgcttgacaagctcaaggctgagcgtgagagaggtatcaccattgatatcgctctgtggaagtttgagaccaccaagtactactgcactgtcattgatgcccctggacatcgcgacttcatcaagaacatgatcacgggtacctcccaggctgactgtgctgtcctgatcattgactccaccactggtggttttgaggccggtatctctaaggatggccagacccgtgagcatgctctccttgctttcacccttggggtcaagcagatgatttgctgctgcaacaagatggatgcgaccactcccaagtattccaaggcccgttacgatgagattgtgaaggaagtttcatcctacctcaagaaggttggatacaaccctgacaagattgcctttgtccctatctctggttttgagggtgacaacatgattgagaggtccaccaaccttgactggtacaagggtccaaccctgcttgaggctcttgaccagatcaccgagcccaagaggccttcagacaagcccctgcgtctgcccctccaggatgtgtacaagattggtggtattggaactgttccggttggtcgtgtggagactggtgtcatcaagcctggaatggttgtcaccttcggtccaactggcctgaccactgaggtgaagtctgttgagatgcaccacgaggctctccaggaggcccttcctggtgacaatgttggcttcaatgtgaagaacgttgctgtgaaggatctcaaacgtgggtacgtggcctccaactctaaggatgaccctgccaaggaggctgctagcttcacctcccaagtcatcatcatgaaccaccctgggcagattggcaatggctatgccccagtgctggactgccacacctcccacattgctgtcaagtttgctgagctcataaccaagatcgataggcggtctggcaaggagcttgagaaggagcccaagttcctgaagaatggtgatgccggtatggtgaagatgattcccactaagcccatggtggttgagaccttctctcagtatcctcctctgggtcgttttgctgtccgtgacatgaggcagacggttgctgttggagtcatcaagagcgtggagaagaaggacccaactggtgccaaggtgaccaaggctgcaataaagaagaaatgatgcgtcctcccatgtgccctcgtttattttgtacttgtgcccgtatacttcgatctgttaaaatctattggttgtgtgccctgtgtctgttgtttgggtatctatactgttattttgagacatgttgacttgcatggtcatctggattgggttcgcatttctgagtcatttgtcttgacatgaaaatcttgctttttttcttgatcttaaaatctagcttgtcttagttgcggggttgatcctaatattaaaggggacatttgggattttgcccatgacatcgttccctcgctaaaaatttaatttgtgggttcgtctatgcctatgaatcgagggtctgggcaaaattctgaagctcagtgtctttgaaggaatatgtgctcttgaattgcaagttctgtatatgacatgataaatctgattgttttcttgtagcgaaaacagcaattctgccagtggattagcagtagctgcaatgtaatatc

SEQ ID NO: 519 - DNA, 1782 bp, Zea mays
acattgggctggtccggccactccgacacccttatataaagtcccgaaccctagaggcaagcaccttcctccccaactcgccgtctgccttctgcgcctccatttcggcctctgtcccttgcaagttcaatctcacctccaaccatgggtaaagagaagtcccacatcaacattgtggttattggccacgttgactctggcaagtcgaccaccacaggacacctgatctacaagcttggaggcattgacaagcgtgtgatcgagaggtttgagaaggaggctgctgaaatgaacaagcggtccttcaagtacgcatgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactccgaaatactccaaggcacgttatgatgagattgtgaaggaagtctcatcctacctcaagaaagttgggtacaaccctgataagattgccttcgttcccatttctggttttgagggcgacaacatgattgagaggtccaccaaccttgactggtacaaaggcccaaccctgcttgaggctcttgaccagatcaccgagcccaagaggccttcggacaagcccctgcgtctgcccctccaggatgtgtacaagattggtggtattggaactgtaccggttggtcgtgtggagactggtgtcatcaagcctggtatggtagtcacctttggtccaactggcctgactactgaggtgaagtctgttgagatgcaccatgaggcgcttcaggaggctcttccgggcgacaatgttggcttcaacgtgaagaacgttgctgtcaaggatctcaagcgtgggttcgtggcctccaactccaaggatgaccctgccaaggaggctgccagcttcacctcccaggtcatcatcatgaaccaccctgggcagattggcaacggctatgccccagtgctggactgccacacctcccacatcgccgtcaagtttgctgagctcattaccaagatcgacaggcgatctggcaaggagctcgagaaggagcccaagttcctgaagaacggtgatgctggtatggtgaagatgattcccaccaagcctatggtggtggagacattctccgcgtatcctcccctgggtaggtttgccgtccgcgacatgaggcagacggttgctgttggagtcatcaagagtgtggagaagaaggacccaaccggcgccaaggtgaccaaggcggccgccaagaagaaatgatgcgatcccgtgtctgcttttgcagtgcctggataacttgccactaaagttgtgtatgcggttgttgctgttattgcgtggactgtttgctgcggtgtctcctgtttgtttgggtagcgcagcgtcggcctcttcaggtgtctgttgtctgttgtctttactatcagtaatgctcctgagacttgtatttctccttttggcgccgctaaatggaattttcgaacaatgattttcgtgttattattttacaaccttttcgaacaatatttacacgtctgatgtgttttgctgaga

SEQ ID NO: 520 - DNA, 2070 bp, Medicago truncatula
ctaaaacaaatccaagggtactttcggaatatgaaactatctaggtcactataaaattcttacaaccctaatttcttcattctctcacacttcacttgttcctttatcactcagtctctctctgcggctgaggatccgaacgagtaacaaccttacatttcgtttcagctgagtttaagacatcatgggaaaagaaaagattcatatcaacattgtcgtcattggacatgtcgactctggaaaatcaacaacaactggtcacttgatctacaagctaggaggtattgacaagcgtgtgatcgagagatttgagaaggaagctgctgagatgaacaagcgttcattcaagtatgcatgggttcttgacaaacttaaggctgagcgtgaaagaggaattaccatcgatattgccttgtggaaatttgagaccaccaagtactactgcacagtcattgatgctcccggacatcgtgatttcatcaagaacatgattactggaacctcccaggctgattgtgccgtgcttatcattgactccaccactggtggttttgaagctggtatctctaaggatggacagacccgtgagcacgctcttcttgcatttactcttggagtgaagcagatgatctgttgttgtaacaagatggatgctaccacccccaagtactcaaaggctaggtacgatgaaatcgtgaaggaagtttcatcctacttgaagaaggttggttacaaccctgacaaaatcccatttgttcccatctccggatttgaaggtgacaacatgattgagaggtccaccaaccttgactggtacaagggaccaactctccttgaggctcttgaccagatcaacgagcccaagagacccacagacaagcccctcaggcttccattgcaagatgtttacaagattggtggtattggaactgtgccagtcggacgtgttgagaccggtattgtgaagcccggtatggttgtgacttttggacccactggtctaacaactgaagttaagtctgttgagatgcaccacgaggctctcactgaagctcttccaggagacaatgtcggattcaatgttaagaatgttgctgtgaaggatctcaagcgtggtttcgttgcatccaactccaaggatgaccctgcaaaggaagctgccaacttcacttcccaagtcatcatcatgaaccaccctggacagattggaaatggatatgcaccagtgctcgattgccacacctctcacattgctgtgaagtttgctgaacttgttaccaagattgacaggcgatctggtaaggagattgagaaggagcccaagttcttgaagaatggtgatgctggtatcattaagatggttcccaccaagcccatggtggttgagacctttgctgaatatcctcctcttggacgttttgctgtcagggacatgcgtcaaactgttgctgttggtgtcatcaaggctgtggagaagaaggatcctaccggagccaaggtcaccaaggctgctgccaagaagaagtgatgtcaaaacatggttgctgcacaagctgtcttttatagtagtttatcatttcagtgtcttagttcatttcttttccagttttattttcaagtttttgtcgatttcatgcagctaaacttacagaactgggttcttgatcggcgatggtcaattttcttgtctgtttgattttgatggtactgttattttggttttattaagagtcttttgagaacttgattttctaaaggcagctatataaggtttatagcttcattttgctgctgatggatgatatctttgcatttaaatttcaagacaattttgtcaaccccgtttctgtggtttgtttttattatttatatgtctttgaatgagctgttgctgtgagtgatggttattgatcagataagccctcagcctgtgctcttgagagcttgttgatggttattgatcgttattgatcatacttgatagtgcctgcaatctgtcttgtgatttgttttggctacagctttttgatctacacacgtattatcttccttatagtgcctgcaattacc

SEQ ID NO: 521 - DNA, 2053 bp, Medicago truncatula
ctcacaaaagcatattccatccgccactctccaacgttcacattagggtattttcggaaatccaaaattcagcaaggacacttttggaacataaaaatatctgagaccctataaaaacattgtaaccctaggttttttcattctcactcatttctttcactctcaaatatcactccgtctctctctgcggctgagagttcccaaccctagatttcgattcagctgagttaagacaacatgggaaaagaaaagattcatatcaacattgttgtcattggacatgtcgactctggaaaatcaacaacaactggtcacttgatctacaagctaggaggtattgacaagcgtgtgatcgagagattcgagaaggaagctgctgagatgaacaagaggtctttcaagtacgcatgggttcttgacaagcttaaggctgagcgtgaaagaggaattaccattgatattgctttgtggaaatttgagaccaccaagtactactgcacagtcattgatgctcccggacatcgtgatttcatcaagaacatgattactggaacctcccaggctgattgtgctgtccttatcattgactccaccactggtggttttgaagctggtatctctaaggatggacagacccgtgagcatgctcttcttgcatttactcttggagtgaagcagatgatctgttgttgtaacaagatggatgctaccacccccaagtactcaaaggctaggtacgatgaaatcgtgaaggaagtttcatcctacttgaagaaggttggttacaacccagacaaaatcccatttgttccaatctctggttttgaaggtgacaacatgattgagaggtctaccaaccttgactggtacaagggaccaactctccttgaggctcttgaccagatcaacgagcccaagagacccacagacaagcccctcaggcttccattgcaagatgtttacaagattggtggtattggaactgtgccagttggacgtgttgagaccggtattgtgaagcccggtatggttgtgacttttggacccactggtttgacaactgaagttaagtctgttgagatgcaccacgaggctctcactgaagctcttccaggagacaatgttggattcaatgttaagaatgttgccgtgaaggatctcaagcgtggtttcgttgcatccaactccaaggatgaccctgcaaaggaagctgccaacttcacttcccaagtcatcatcatgaaccaccctggacagattggaaatggatatgcaccagtgctcgattgccacacctctcacattgctgtgaagtttgctgaacttgttaccaagattgacaggcgatctggtaaggagattgagaaggagcccaagttcttgaagaacggtgatgctggtatcattaagatggttcccaccaagcccatggtggttgagaccttcgctgaatatcctcctcttggacgttttgccgtcagggacatgcgtcaaactgttgctgttggtgtcatcaaggctgtggagaagaaggatcccaccggagccaaagtcaccaaagctgctgccaagaagaagtgatctaacaccatggttacttcataagttgttcctttttaatagtttgttatcttgtccgtgtcttagttttttgttattccagttttatttttccagttttagaaacttacagaactgggttcttgatcggcgatggtaccgtttttggttttaattgttaagagtcttgagaacttgaatttcaaagggcagcttaaaggtttgacatcttaattttgctgctgaggaatgttgtaattgcattttatttacaagacagttttgttatgtcaaatcttatatttatctttatggttatgtttttgaatttttgttcgtaatatttgtccttgattgtgtgtttgtggttccgtgcttgcaattttacttggaaagattggctttctgcaggttggttttagcctgtttaagctgtcatgacatgtttgattagtgaattccagagaacatgcctaattcatgtgcagcagca

SEQ ID NO: 522 - DNA, 1627 bp, Pennisetum glaucum
ttcacctgcgaccatgggtaaggagaagtcccacatcaacatcgtggtcattggccatgtcgactctggcaagtcgaccaccactggacacctgatctacaagcttggaggtattgacaagcgtgtgatcgagaggtttgagaaggaggctgctgagatgaacaagcggtccttcaagtacgcgtgggtgcttgacaagctcaaagctgagcgtgagagaggtatcaccattgatattgccctgtggaagttcgagaccaccaagtactactgcaccgtcattgacgcccctggacaccgtgactttatcaagaatatgatcaccggtacctcacaggctgactgtgctgtccttatcattgactccaccactggtggttttgaggctggtatctccaaggatggccagacccgtgagcatgctctccttgctttcactcttggagtcaagcagatgatctgctgctgcaacaagatggatgccaccactcccaagtactccaaggcccgttatgatgagattgttaaggaagtttcctcatacctcaagaaggttggttacaaccctgacaagattgcctttgttcctatctctggttttgagggtgacaacatgattgagaggtcaaccaatcttgactggtacaagggcccaaccctgcttgaggctctggaccagatcaacgagcccaagaggccttcagacaagcccttgcgtctcccccttcaggatgtgtacaagatcggtggtattggaactgtccctgttggccgtgttgagaccggtgtcatcaagcctggtatggttgtcaccttcggtccaactggcctgactactgaggtgaagtctgttgagatgcaccatgaggctctccaggaggcccttcctggtgacaatgttggtttcaatgtgaagaacgttgctgtgaaggatctcaagcgtggttatgtggcctccaactccaaggatgaccctgccaaggaggctgccagctttacctcgcaggtcatcatcatgaaccaccctgggcagattggcaacggctatgccccagtgcttgactgccacacctcccacattgctgtcaagtttgctgaactcattaccaagatcgacagacgatccggtaaggagcttgagaaggagcccaagttcctgaagaatggtgatgctggtatggtgaagatgattcccacgaagcccatggtggtggagaccttctctgagtaccctcctctaggtcgttttgctgtccgtgacatgaggcagacggttgctgtgggagtcatcaagagcgttgagaagaaggacccgaccggtgccaaggttaccaaggctgctgccaagaagaaatgatgttcctggtggttaatcctgtgcctgcttttgtgatacctagataccttttcagtatcgtgtaagttttgtctggttatcatgattggtatcgtgtgaacttttaagttctgctggcggtgtgctatgtgtctgttgtttaggaaccctcttgttaatacctatgtttgcccttttgtgcactgctaaacgcatctgtggggagttgtctagttatccttttatttaatttgttttgtgttttcttagtgatttgcatttggattgtgg

SEQ ID NO: 523 - DNA, 1635 bp, Secale cereale
ccccgccgcgtctttgtccccgtcttcgtctccggccagccaggtagttcacagctccagcagccatgggcaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtcgttcaagtacgcctgggtgcttgacaagctcaaggctgagcgtgagaggggtatcaccattgatatcgctctgtggaagttcgagaccaccaagtactcctgcactgtcattgatgctcctggtcaccgtgatttcatcaagaacatgatcactgggacctcccaggctgattgtgctgtgcttatcattgactccaccactggtggttttgaggctggtatctccaaagatggccagacacgtgagcatgctctccttgctttcactcttggtgtgaagcagatgatctgctgctgcaacaagatggacgccaccactcccaagtactcgaaggcccgttacgatgaaattgtcaaggaagtctcttcatacctgaagaaggtcggttacaaccctgacaaggttccctttgtccctatctctgggtttgagggtgacaacatgatcgagaggtcctccaaccttgactggtacaagggcccaaccctgcttgaggcgcttgaccagatcaatgagcccaagaggccctccgacaagcccctgcgtcttccccttcaggatgtgtacaagattggcggcattggaactgtgccagtgggacgtgttgagactggagtcatcaagccaggcatggttgtcacctttgggcctactggcctgaccactgaggtgaagtccgttgagatgcaccacgagtcccttttggaggcgcttcctggtgacaacgtcggctttaacgtcaagaacgtggctgtcaaggatctcaagcgtgggtatgtcgcttccaactccaaagacgaccctgccaaggaggctgccaacttcacggcgcaggtcatcatcatgaaccaccctggccagatcagcaacggctacgccccagtgctggactgccacacgtcccacatcgctgtcaagttcgctgagatccagaccaagatcgaccggcggtctggcaaggagctggaggcggcgcccaagttcctcaagaatggtgatgccgggttcgtcaagatggtccccaccaagcccatggtagtggagacctttgcccagtaccctcccctgggccgctttgctgtgcgcgacatgaggcagacggtggccgttggcgttatcaagagcgtggaaaagaaggagccgacgggcgccaaggtgaccaaggctgcgatcaagaagaaatgagatggtgtcaggttctttactgcatctatggtggcggtggcggtatttggtggtggtgatagttgtgttagccgttttgaaaacttgttaagcttcggctatttgtgtctagcagtgttcgaagtgcttattgctctggaaattgtatcgttcggttgtgttggtgaaacttcgtcagttgacgtcgctgctatatatagtaatcatgtttggagtcgttctatta

SEQ ID NO: 524 - DNA, 1780 bp, Triticum aestivum
cccgccgcggcttcgactccagcgcctcctcccttcccctcatcgtctccggccagccaggtagttcgtagctccagcagccatgggcaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtctttcaagtacgcctgggtgcttgacaagctcaaggctgagcgtgagagaggtatcaccattgatattgctctgtggaagttcgagaccaccaagtactcgtgcactgtcattgatgctcctggtcaccgtgatttcatcaagaacatgatcactggtacctcccaggctgattgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactcgaaggcccgttacgatgaaattgtcaaggaagtctcttcatacctgaagaaggtcggttacaaccctgacaaggttccctttgtccccatctctgggtttgagggtgacaacatgatcgagaggtcctccaaccttgactggtacaagggcccaaccctgcttgaggcgcttgaccagatcaatgagcccaagaggccctccgacaagcccctgcgtcttccccttcaggacgtgtacaagattggcggcattggaactgtgccagtggggcgtgttgagactggagtcatcaagccaggcatggttgtcacctttggtcctactggcctgaccactgaggtgaagtctgtggagatgcaccacgagtctctcctggaggcgcttcctggtgataatgtcggcttcaacgtcaagaatgtggctgtcaaggatctcaagcgtgggtacgtggcctctaactccaaggacgaccccgccaaggaggctgccaacttcaccgcccaggtcatcatcatgaaccaccccggccagatcagcaacggctacgccccggtgctggactgccacacgtcccacatcgctgtcaagttcgctgagatccagaccaagatcgaccggcggtctggcaaggagattgaggcggcgcccaagttcctcaagaacggtgatgccgggttcgtcaagatgatccccaccaagcccatggtggtggagaccttcgcccagtaccctcccctgggtcgctttgctgtgcgtgacatgaggcagacggtcgccgttggcgtgatcaagagcgtggagaagaaggatccgaccggcgccaaggtgaccaaggctgcggccaagaagaaatgagatggtgtcgggcggtggcgttgttggtggttctttaccacatctatggtggtggtggcggtatacggtggtggtgatagtcgtgttagccgatttgcgaacttgttaagctttggttatttgtgtcgagcagtgttcgaactgcttattactgtggtcatagtatcgttcggttgtgttggtgaaacttcgtcagataaagttgctattttatatttgagtgatatttggagtcgttttatatctgctgcctgtagcatatttgataatggtttttgtgttgcaaaaaaaaaaaaaaaaaaaaactcgagactagacctgcccgggcggccgctcgaaatcactagtgaattc

SEQ ID NO: 525 - DNA, 1958 bp, Cicer arietinum
ggaaaactaaaagacattgaaggacattttgggaatatgaaaaagatatttgtgactataaaatgttgtaaccctagcttgtttgttgtcatcactctttacttattcattcatccttcagtctctctgcggctgaggattccgaacgcgtcttcgtttttcttagctaagatatcatgggtaaagagaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctcccaagctgattgtgctgtccttatcattgactccaccactggtggttttgaggctggtatctctaaggatggacagacccgtgagcacgctcttcttgctttcactcttggagtgaaacagatgatctgttgttgtaacaagatggatgccaccacacccaagtactcaaaggccaggtacgatgaaatcgtgaaggaagtttcttcatacttgaagaaggttggttacaaccctgacaaaatccccttcgttccaatctctggttttgagggagacaacatgattgagaggtccaccaaccttgactggtacaagggaccaactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttggccctactggtctgacaactgaagttaagtctgttgagatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgccccagtcctcgactgtcacacctcccacattgctgttaagttcgctgagcttctcaccaagatcgacaggcgatctggtaaggaacttgagaaggagcctaagtttttgaagaatggtgatgctggtcttgttaagatgattccaaccaagcctatggttgtggaaactttctccgagtatccaccacttggtcgtttcgccgtgagggacatgcgtcaaactgttgctgtcggtgtcatcaagagtgttgagaagaaggatccaactggagccaagatcaccaaagctgcagtgaagaagaagtgatggttgatgcagaagtggatgttgctttatagtagcttattatcttttaagagtcttagtttatttttgccttttaattttgccgtttttatgcagccaaacttgcaaaactgggttcttgatcggcgatggtcgacctttattttgtggttgttttgattttgatggtactgtttttgaattaaattatgagtcttgagaacttattttcagaggcacatcttaatttttaattatgtctgtttaatgatgtgttttttaaattaatgtgctattttctggttgcttttagtttattttacaagttatatttattaaagtaaaattcatggttccttggaattattacaatttatttgaagaaagtgtgatacaaaagtgtttgatggacaaggataattaattttttctttgatttattacagttttatttgaaag

SEQ ID NO: 526 - DNA, 1675 bp, Cicer arietinum
tttcatttcttctttgctaagatatcatgggtaaagaaaagtttcatatcaacattgtcgtcattggacatgtcgattctggtaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatcgcccccggacatcgtgatttcattaagaacatgattactggtacctccaagctgattgtgctgtccttatcattgactccaccactggtggttttgaggctggtatctctaaggatggacagacccgtgagcacgctcttcttgctttcactcttggagtgaaacagatgatctgttgttgtaacaagatggatgccactacccccaagtactccaaggccaggtacgatgaaatcgtgaaggaagtttcttcatacttgaagaaggttggttacaaccctgacaaaatccccttcgtgccaatctctggatttgagggagacaacatgattgagaggtccaccaaccttgactggtacaagggaccaactctccttgaggctcttgaccagatcaacgagcccaagagaccctcagacaagcccctcaggcttccattgcaagatgtttacaagatcggtggtattggaactgtgccagtcggacgtgttgagactggagtcatcaagcctggtgtgatcgttacctttggccctaccggtctgacaactgaagttaagtctgttgagatgcaccacgaggctctcaccgaagctctccctggagacaatgttggattcaatgttaagaatgttgcagtgaaggatctcaagcgtggtttcgttgcatccaactccaaggatgaccctgctaaggaagctgccaacttcacttcccaagtcatcatcatgaaccatccaggacagattggaaacggttatgccccagtcctcgactgtcacacctcccacattgctgttaagttcgctgagcttctcaccaagattgacagacgatctggtaaggaactcgagaaggagcctaagtttttgaagaatggtgatgctggtcttgttaagatgattccaacaaagcctatggttgtggaaactttctccgagtatccaccacttggtcgttttgctgtgagggacatgcgtcaaactgttgctgtcggtgtcattaagagtgttgagaagaaggatccaactggagccaagatcaccaaggctgcagtcaagaagaagtgagtttgcacatcatcatcaccatggttgctgctgaagttgttcctttatagtagtttatctttccggagtcttagtttaattttgtcagtttattttgtcaagtctttgccggtttcattcagccaaacttacaaaactgggttcttgatcggcggtggtcatatttattttgtggttgtttttgatggtgctgtttttgcttatttgatcttttgagaacttcattttgtaaaagcagctaggtttcatggtttaattttgctgctgaaggatgttcaattgcatttaatttataagacattttt

SEQ ID NO: 527 - DNA, 1613 bp, Cicer arietinum
tctctctctgcggctgaggattccgaacgagtcttagatttcatttcttctttgctaagatatcatgggtaaagaaaagtttcatatcaacattgtcgtcattggacatgtcgattctggtaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggagatcgtgatttcattaagaacatgattactggtaccctcccaagctgattgtgctgtccttatcattgactccaccacgtggttggttttgaggctggtatctctaaggatggacagacccgtgagcacgctcttcttgctttcactcttggagtgaaacagatgatctgttgttgtaacaagatggatgccaccacacccaagtactcaaaggccaggtacgatgaaatcgtgaaggaagtttcttcatacttgaagaaggttggttacaaccctgacaaaatccccttcgttccaatctctggttttgagggagacaacatgattgagaggtccaccaaccttgactggtacaagggaccaactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttggccctactggtctgacaactgaagttaagtctgttgagatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgccccagtcctcgactgtcacacctcccacattgctgttaagttcgctgagcttctcaccaagatcgacaggcgatctggtaaggaacttgagaaggagcctaagtttttgaagaatggtgatgctggtcttgttaagatgattccaaccaagcctatggttgtggaaactttctctgagtatccaccacttggtcgtttcgccgtgagggacatgcgtcaaaccgttgctgtcggtgtcatcaagagtgttgagaagaaggatccaactggagccaagatcaccaaagctgcagtgaagaagaagtgatggttgatgcagaagtggatgttgctttatagtagcttattatcttttaagagtcttagtttatttttgccttttaattttgccgtttttatgcagccaaacttgcaaaactgggttcttgatcggcgatggtcgaactttattttgtggttgttttgattttgatggtactgtttttgaattaaattatgagtcttgagaa

SEQ ID NO: 528 - DNA, 1910 bp, Aristolochia fimbriata
tcatctccgcaggctcccggacgtcgcgagggtttttcaaggtcccgatctgtcttcattctgattcgtcgctatgggtaaggagaaggttcacatcaacatcgtcgtcatcggacatgtcgactccgggaagtcgacgaccaccggacacttgatctacaagcttggaggtatcgacaagcgtgtgatcgagaggttcgagaaggaggcggctgagatgaacaagaggtcgttcaagtacgcttgggtgctcgacaagcttaaggccgagcgtgagcgtggtatcaccatcgatatcgctctctggaagttcgagaccaccaagtactattgcactgttattgatgctcccggacatcgtgacttcatcaagaatatgattactggtacttctcaggctgattgcgccgtgctcattatcgattccaccactggtggtttcgaggccggtatttctaaggacggtcagactcgtgagcacgctctgcttgctttcaccctcggtgtcaagcaaatgatctgctgctgtaacaagatggatgccaccacccccaagtactccaaggcacgttatgatgaaattgtgaaggaagtgtcttcctacttgaagaaggtcggatacaaccctgacaaaatccccttcgttcccatctctggttttgagggagacaacatgatcgagaggtccacgaacctcgactggtacaagggccctaccctcctcgatgctcttgaccagatcaatgagccaaagagaccctcggacaagccactccgactcccacttcaggatgtctacaagattggtggtatcggcactgtccccgtcggtcgtgtcgagactggtgtcctgaagcccggtatggttgtgacttttggtccatctgggctcaccactgaagttaagtctgttgagatgcaccacgaggctcttcaggaggctttgcccggtgacaacgttgggttcaacgtgaagaacgttgcggtgaaggatctgaagcgtggtttcgttgcctccaactccaaggatgaccctgccaaggaggctgccaatttcacttcccaggtgatcataatgaaccaccccgggcagattggtaatggatatgcccccgtgctggactgccacacctcccacattgccgtcaagtttgcggagctgttgacgaagatcgacaggcgatctggtaaggagctcgagaaggagcccaaattcttgaagaacggagatgccgggctcgtgaagatgattcccaccaagcccatggtggtggagaccttctccgagtatccacccctcggtcgttttgccgtcagggacatgcgtcaaaccgtggctgtcggagtcatcaagagcgttgagaagaaggatcccaccggtgccaaggtcaccaagtctgctgtcaagaagaagtgaagagtgcggtacaggaaggaatttttgatagacgctttcgttggctattgcttggctgtggtttgttactccattgttcttgatctacttacgcggttgttgttgagcatccaaatgcaaacttgggtgctcgacagaaggtggtccaatgtgagagttatgataacgttcgtgtttttctatattagaagttttgctttgttgtgttgttgtagcagttgttgttgaatttaattatcgcagagataactgttgttccgcttataaggtctcgaagaaagattttttagggtggtgtgtcgaatttcaagtcgagcttgtagttttaagcatacgccataaattgctatacttctttttcttttcgatgattctatttgtcggtaaatgttttgctggagtgtggtgtctggatctggaatgtttattccagggggaattgttgttaccgttttattggtttaattgacgtttgttacgtttggttggttga

SEQ ID NO: 529 - DNA, 1878 bp, Aristolochia fimbriata
gtggtaacaacgcatccgtacggcgggggcattcgaaacgaaagagaggcgagacagcggagacgaggtgctcttagctcccccaaaggtctttaatctctttagcgcgtcgggaatttgatccgccatgggtaaggagaaggttcacattaacatcgtcgtcatcggacacgtcgactccgggaagtcgacgaccaccgggcacttgatctacaagcttggaggtattgacaagcgtgtgatcgagaggttcgagaaggaggctgctgagatgaacaagaggtcgttcaagtacgcctgggtgcttgacaagcttaaggccgagcgtgagcgtggtatcaccatcgatatcgctctctggaagttcgagaccaccaagtactactgcacggtcatcgacgcccccggacatcgtgactttatcaagaacatgattactggtacttctcaggccgattgcgccgttctcattatcgattccaccactggtggttttgaggctggtatttctaaggatggtcagacgcgtgagcacgctttgcttgccttcacccttggtgtcaagcaaatgatttgctgttgtaacaagatggatgccaccacccccaagtactccaaggcacggtatgatgaaattgtgaaggaagtgtcctcctacttgaagaaggtcggatacaaccctgacaaaatccccttcgttcccatctctggtttcgagggagacaacatgatcgagaggtccaccaacctcgactggtacaagggccctaccctcctcgatgctcttgaccagatcaatgagccaaagagaccctcggacaagccactccgactcccacttcaggatgtctacaagattggtggtatcggcaccgtccccgtcggtcgtgtcgagactggtgtcctgaagcccggtatggttgtgacttttggtccatctgggctcaccactgaagtcaagtctgtcgagatgcaccacgaggctcttcaggaggccttgcccggtgacaacgttgggttcaacgtgaagaacgttgcggtgaaggatctgaagcgtggtttcgttgcctccaactccaaggatgaccctgccaaggaggctgccaatttcacttcccaggtgatcataatgaaccaccccgggcagattggtaatggatatgcccccgtgctggactgccacacctcccacattgccgtcaagtttgcggagctgttgacgaagatcgacaggcgatctggtaaggagctcgagaaggagcccaaattcttgaagaacggagatgccgggctcgtgaagatgattcccaccaagcccatggtggtggagaccttctccgagtatccacccctcggtcgttttgccgtcagggacatgcgtcaaaccgtggctgtcggagtcatcaagagcgttgagaagaaggatcccaccggtgccaaggtcaccaagtctgctgtcaagaagaagtgagacctgtctgtgtgctaatagatgtccttatactcgaggtagcggttttctctagatggttgttttatggtttactttttaaagttttctgacctcgatttttcgaggttagcttgagcggaggcagggtccggcgtgtttattacctgagagaggaagaaatacttgtctttattttttgtcaggtcgttatgttatatcaaactccagtagtatttagaattatgttttgtctcctgtttttgaactccaaagttaaatctgtattcaagtctacattgtcctgcatgtttttttttaactccaggtgtcctttcaatcaatctgttttctattttcagtgaaaagttttagctgatggaggatggatctgggagatacaacaatatcgtcaattattaaatata

SEQ ID NO: 530 - DNA, 2329 bp, Musa acuminata
atgatgatcacaaattatattaacaagaggagttcttcagctttcgatcaaaaatctcttgaaatcctcatatacttaagcaaatcttatcaatcaatcaatacaaagaaatggacactaaattcggtcaccttttgtgtactcggatggttagtcgtccaattacagacgtccattccgccttacacccagcgtgctgaatgggtagatgcggcgggtacggaagagacgggtgcgaataaaaacatcggtcgccaccgcgccgccgccacaaagtatgctggacatagtaaaggtttctgtctctctttgcaaatcgatctcgaaggagcgcggcggccgccgatctctccatctctcctcggctccctcttccttaggtccttagttcaacaagaaataagcaatgggaaaggagaaggttcacattaacattgtcgtcattggccatgtcgactctggaaagtctacaacaactggacatctcatttacaaacttggtggcattgacaagcgtgttattgagagatttgagaaggaagctgctgaaatgaacaagagatcattcaagtatgcctgggtgcttgacaagctgaaggctgagcgagaacgtggcatcaccattgatattgctctgtggaagtttgagaccacgaagtactattgcacagtcattgatgctcctggtcatagggatttcatcaagaacatgattacaggaacttctcaggctgactgtgcagttctcatcattgattccacaactggtggttttgaagcaggtatatcaaaggatggacagactcgtgaacacgcacttcttgctttcactcttggtgtcaaacagatgatttgttgctgcaacaagatggatgccacaacacccaaatactcgaaggcacgatatgatgaaattgttaaggaggtctcgtcctacttgaagaaagtcggctacaaccctgataagattccttttgtgcccatttctggttttgaaggtgataacatgattgagagatccaccaaccttgactggtacaagggcccgacactccttgaagcccttgacttgattaatgagcccaagcgtccaacggacaagcctcttcgccttcctcttcaggatgtttacaagattggaggcattggaactgttcctgttggtcgtgttgaaactggagtactgaaacctggtatggttgtcacctttggtcctacaggactcactacagaagtcaaatccgtggagatgcaccatgaggcactccaggaggctttacctggtgacaatgttggcttcaacgtaaagaatgttgctgtgaaggatttgaaacgtggttttgttgcctcaaactccaaggatgacccagcgaaggaggctgctaacttcacctctcaagttatcatcatgaaccaccctggccaaattgggaatggttatgctcctgtcttggattgccacacctctcacattgcagtcaaattcgctgagttgttaaccaagattgataggcgatctggcaaggagctggagaaggagcccaagttccttaagaatggtgatgcaggttttgtgaagatgattcctacgaagcctatggtggtggaaaccttctctggctaccctccactaggtaggtttgctgtgagagacatgaggcagactgttgctgtgggtgtcatcaagagcgtggagaagaaggatccctctggcgctaaggttaccaaagcagctcagaagaagaaatgaaatgaggattggggatcattcgtgtctggagtcattaatagtcttgttgtcatgtctccgtgccgacgtgttgacgagctctcaggtatggtatctggtggtgtctggaagcagaactgggtgctcgacaggcggtggcggggttgatggttggcttctattttattattgttctacgttaaaacttgagacaattgtcgtatgtctgctctttcccaaggatttttgtgagtctggtagtcttgttttctgtatcgtcttctgctatgcatggattttgagatctaaataatttagtatttgaactatatatcgtggccttgcgtgtgtagtggatggtcttagcctagaataaatcgttctgtttgttgcctgttgtggtgctatatgtttgtgtcaggtgctccgaaagatggtctgaagcactttggtggatggcgaaaagctcatagaaaccagccggctccggacaagaacaaaccgggagttcgagcaagaatattttaatatgttctcacatattaatgcgtgtgtttctttttaggttcctctcgtaattgtataacccatttctgcaat

SEQ ID NO: 531 - DNA, 1743 bp, Gossypium hirsutum
aacccagttcttcattttcattttcttgttccttccttcgccgtctattgctttttgttacctcgatttcaagtgaatcagaatgggtaaggaaaagactcacattaacattgtggttatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcagggctgagcgtgagcgtggtatcaccattgatattgccttgtggaaatttgagaccaccaaatactactgcactgtgattgatgcacctggacaccgtgactttatcaagaatatgattactggtacgtcacaggctgactgtgctgttttgattattgattccaccactggtggttttgaggctggtatctcaaaggatggtcagactcgtgagcacgcattgcttgcttttacccttggtgtcaagcaaatgatttgctgttgcaacaagatggatgccactacccctaaatactcgaaggctaggtatgatgaaattgtgaaggaagtctcttcctacttgaagaaggtgggatacaaccctgacaagattccatttgttcccatttctggttttgagggtgacaacatgattgagaggtctaccaacttggactggtacaagggccctactcttcttgaggctcttgaccagatcaacgagcccaagaggccttcagacaagcctctccgtctcccacttcaggatgtgtacaagattggtggtattggaactgttccagtcggccgtgttgaaaccggtgtcttgaagcctggtatggttgtgacctttggcccgtctggtctgacaactgaagttaagtcagttgagatgcaccatgaagctcttacagaagcacttcccggtgataatgttgggttcaatgttaaaaacgttgctgttaaggatctcaagcgtggttttgttgcatccaactccaaggatgaccctgctaaggaggctgccaacttcacttctcaggtcatcattatgaaccaccctggacaaattggaaatggatatgccccagtccttgactgccacacgtcacacattgctgttaagtttgctgagcttttgaccaagattgacaggcgatctggtaaggagcttgagaaggaacccaagttcttgaagaacggtgatgctggtatgattaagatgattcctaccaagcccatggttgtggagaccttctctgagtacccacccctgggtcgttttgctgtgagggacatgcgtcagaccgtggctgttggtgttatcaagagtgtcgagaagaaggacccaaccggtgccaaggtcaccaagtctgctgctaagaagaagtgaagaggccaaaaggttttagcggtgaagcagattgagtgtttttatctttggttatatgtggtttgaagtttttgcctgttttatgtaggatttttaaagtttgagatgctttggtttgccaaggcatcttagtcaagttttgtgtctgatcttgcggactatactttgtttttcctatatatttgtctgtttcttttttctattttactagtttcattgcctagagaggtaagggccctctggatttttatttcttattcgtttcgtttctctgacacccgacaacggagggtagtcgacgagcacaggaggtagcg

SEQ ID NO: 532 - DNA, 1767 bp, Gossypium hirsutum
ttttattgttccttccttcgccgtctactgcacttgtgacatcgatttcaagtgaatcagaatgggtaaggaaaagagtcacattaacattgtggtcattggccacgtcgattccggaaaatcgaccaccactggccacctgatctacaagcttggtggtattgacaagcgtgtgattgaaaggtttgagaaagaagctgcggagatgaacaagaggtcattcaagtatgcttgggtgcttgacaagctcaaggctgaacgtgagcgtggtatcaccattgatattgccttgtggaaatttgagacgaccaaatactactgcactgtgattgatgcgcctggacaccgtgactttatcaagaacatgattactggtacctcgcaggctgattgtgctgttttgattattgattccaccactggtggttttgaggctggtatctccaaggatggtcagactcgtgagcatgctttgcttgcttttacccttggtgtcaagcaaatgatttgctgttgcaacaagatggatgccactacccctaaatattcgaaggctaggtatgatgaaatcgtgaaggaagtctcttcctacttgaagaaggttggatacaaccctgacaagattccatttgttcccatttctggttttgagggtgataacatgattgagaggtctaccaacttggactggtacaagggccctacacttcttgaggctcttgaccagatcaatgagcccaagaggccttcagacaagcctctccgtctaccacttcaggatgtgtacaagattggtggtattggaactgtcccagttggtcgtgttgaaactggtgtcttgaagcctggtatggttgtgacctttggtcctactggtctgaccactgaagttaagtctgttgagatgcaccatgaagctcttacggaggcgcttcctggtgataatgttgggttcaatgttaagaatgtcgctgttaaggatctcaagcgtggttatgttgcatccaactccaaggatgatcctgctaaggaggctgcaaacttcacttctcaggtcatcatcatgaaccatcctggacaaattggaaacggatatgccccagtcctcgactgccacacctcacacattgctgttaagtttgctgaacttttgaccaagattgacaggcgatctggtaaggagcttgagaaggaacccaagttcttgaagaatggtgatgctggtatgattaagatgattcccaccaagcccatggttgtggagaccttctccgagtacccacccttgggtcgttttgctgtgagggacatgcgtcagaccgtggctgttggtgttatcaagaatgttgagaagaaggacccaaccggtgccaaggtcaccaagtctgctgctaagaagaagtgaaccgtgctggctaaacctaatgaagtttccgcagatggagtattttattatgataataatagtttgatagactttatcatttatgatatagttggtcttttgcttggttttgcatgttatagtgtggtgccattgttgtctggtaactgttctcagtattgggtgcttgacagacggtggcatagctatggcaggtggtctctagcgttatctggttttgtttaatttactactgtatcttgtcattgtcaagagggtgccccctttggttttccaaggtggctcgaaacttttgtttatgattttcgttgaagctgcggaattatatattatgaaatcatgctgtatttttgggttttggt

SEQ ID NO: 533 - DNA, 1638 bp, Cucurbita pepo
gaggctgcttctttcttctgatttctcttcaaattcttgtgggctcatttggttaatatcaaatgggtaaggaaaagattcatattaacatcgtggttattggccatgtcgactctggaaagtcgaccaccaccggtcatcttatctacaagcttggaggaattgacaagcgtgtgatcgagagattcgagaaggaagctgctgagatgaacaaaaggtcattcaagtatgcttgggtgctcgacaaacttaaggcagagcgtgaacgtggtattaccattgacattgctctgtggaagtttgagaccaccaagtactattgcacagtcattgatgcccccggacatcgtgactttatcaagaacatgattactggaacctcacaggctgactgtgccgtccttattattgactccaccactggtggttttgaagctggtatttccaaggatggacagacccgtgagcacgctctccttgctttcacccttggtgtcaagcaaatgatctgttgctgcaacaagatggatgctaccactcccaaatactcaaaggctaggtatgatgagatcgtgaaggaagtgtcatcttacctgaagaaggttggatacaacccagacaaaattcccttcgttcccatctctggatttgagggtgacaacatgattgagaggtccaccaacctcgactggtacaagggaccgaccctccttgaggctcttgacttgatctcggagcccaagaggccctcagacaagcccctccgtctcccacttcaggacgtttacaagatcggtggtattggaactgtccctgtcggtcgtgttgagactggtgtcctcaagcctggtatggttgtcaccttcggaccaactggactgaccactgaagttaagtctgttgaaatgcaccacgagtctctcccagaggccttgcctggtgacaatgttgggttcaacgttaagaacgttgctgtcaaggatctcaagcgtggtttcgttgcctcaaactccaaggatgacccagcaaaggaagctgccaacttcacctcacaggttatcatcatgaaccaccctggccagatcggtaatggttatgccccagtccttgattgccacacctcccacattgctgttaagttcgctgagatcctcactaagatcgatcgtcgatctggtaaggaactcgagaaggagcccaagttcttgaagaacggagatgctggtatggttaagatgattcccaccaagcccatggttgtggagaccttctcctcatacccaccattgggtcgttttgccgtccgtgatatgcgtcaaaccgttgctgttggtgtgatcaagagcgtggagaagaaggacccaacgggagccaaggtgaccaagtccgccgtcaagaagaaataagccatccaaacaacaaagccagcctagagtctgcattttgtgtgtcaattggtttgaagaatatgagaaaagacttgtggttttgttagttgtatgagtggctttaccttgtatagggcggctctctctctcgtagtagcttttacttatttagttttatgtgtctgaatttgtgttgtttaattttggtttgttgttattgagtcattttgagacattatgtgatacagtc

SEQ ID NO: 534 - DNA, 1644 bp, Cucurbita pepo
ctgcttgctcctgcgtaagatttaggctgcttctttcttctgatttctcctcaaattcttgtggttccatttgattagtatcagatgggtaaggaaaagattcacatcaacatcgtggtcattggtcatgtcgactctggtaagtcgaccaccactggtcaccttatctacaagcttggaggaattgacaagcgtgtgatcgagaggttcgagaaggaagctgctgagatgaacaaaaggtcattcaagtatgcttgggtgctcgacaaacttaaggcagagcgtgaacgtggtattaccattgacattgctctgtggaagtttgagaccaccaagtattactgcacagtcattgatgctcccggacatcgtgactttatcaagaacatgattactggaacctcacaggctgattgtgccgtcctcatcattgactcgaccactggtggttttgaagctggtatttccaaggatggtcagacccgtgagcacgctctccttgctttcacccttggtgtcaagcaaatgatctgctgctgtaacaagatggatgccaccacccccaaatactcaaaggcaaggtatgatgaaatcgtgaaggaagtgtcgtcttacctcaagaaggttggatacaatccagacaaaatccccttcgtgcccatctctggtttcgagggtgacaacatgattgagaggtccaccaaccttgactggtacaagggaccaacacttcttgaggctcttgacttgatccaggagcccaagaggccctcagacaagcccctccgtctcccacttcaggacgtttacaagattggtggtattggaactgtccctgtcggtcgtgttgagactggtgtcctcaagcctggtatggttgtcaccttcggaccaactggactgaccactgaagttaagtccgttgaaatgcaccacgagtctctcccagaggccttgcctggtgacaatgttggattcaacgtgaagaacgttgcagtcaaggatctcaagcgtggtttcgttgcctcaaactccaaggatgaccctgccaaggaggctgccaacttcacatctcaggttatcatcatgaaccaccctggccaaatcggtaatggttatgccccagtccttgattgccacacctcccacattgctgttaagttcgccgagatcctcaccaagatcgatcgtcgatctggtaaggaactcgagaaggagcccaagttcttgaagaacggtgatgctggtatggttaagatgattcccaccaagcccatggttgtggagaccttctcttcatacccacctttgggtcgttttgctgttcgtgacatgcgtcaaactgttgctgttggtgtgatcaagagcgtggagaagaaggacccaacgggagccaaggtgaccaagtccgctgtgaagaagaaataagccaaccaacaacaatgaaacgaacttgcattttgtgtcgaagacagaacattttagtttgcaaaacatgagaaagacttttgggttgatgctagttgcgagtggcttttactttgtgttagagcggctcttgactcgtagcagttttcatttattttagtttatctgtctggtttgtgttgttaattttagacatttacatcgttggatactgtt

SEQ ID NO: 535 - DNA, 1673 bp, Setaria italica
cagccaccccgactagtagccgcttcctccccccacgccgcctccttcgcttccgcggcggtttaagcttcacctgcaaccatgggtaaggagaagtcccacatcaacatcgtggtcattggccatgtcgactctggcaagtcgaccaccaccggtcacctgatctacaagcttggaggtatcgacaagcgtgtgatcgagaggttcgagaaagaggccgctgagatgaacaagcggtccttcaagtacgcgtgggtgcttgacaagctcaaggctgagcgtgagaggggtatcaccattgatattgccctgtggaagttcgagaccaccaagtactactgcacagtcattgatgcccctggacaccgtgacttcatcaagaacatgattactggtacctcccaggcagactgtgctgtccttatcattgactccactactggtggttttgaggctggtatctccaaggatggccagacccgtgagcatgctctccttgctttcacgcttggagtgaagcagatgatctgctgctgcaacaagatggatgccaccactcccaagtactccaaggcccgctatgatgagattgttaaggaagtctcctcctacctgaagaaggtgggttacaaccctgacaagattgccttcgtcccaatctctggttttgagggtgacaacatgattgagaggtccaccaaccttgactggtacaagggcccaaccctgcttgaggctcttgaccagatcaacgagcccaagaggccttcggacaagcccctccgtcttccccttcaggatgtgtacaagattggtggtattggaaccgtccctgttggccgtgttgagaccggtatcatcaagcctggtatgcttgtcacctttggtcccactggcctgactactgaggtgaagtcagttgagatgcaccacgaggctctccaggaggcccttcctggtgacaacgttgggttcaacgtgaagaacgttgctgtgaaggatctcaagcgtgggtttgtggcctccaactccaaggatgaccctgccaaggaggctgccagcttcacctcccaggtcatcatcatgaaccaccctgggcagatcggcaatggctacgccccagtgctggactgccacacctcccacattgctgtcaagtttgctgagctcattaccaagatcgacagacgatccggtaaggagcttgagaaggagcccaagttcctgaagaatggtgatgctggtatggtgaagatgattcccaccaagcccatggtggtggagaccttctctgagtaccctcctcttggtcgttttgctgtccgtgacatgaggcaaacggttgctgttggagtcatcaagagcgtggagaagaaggacccaacgggcgccaaggtgactaaggctgcagccaagaagaaatgatgtgtctggtggttgattccacttctgcttttggcatgcctagatgctataatatcacttaagttttgtctatggccattgctgttatctcgtgaactattaatctcagctggcaatgtgtcctcggtctgtttgatgtttacatacagtttttatatttggatttggcaaaacttaaattacctgagattgatgtgctcctgcgattgttcaatgcaagtgcctgggtgtcattaagttttgtttca

SEQ ID NO: 536 - DNA, 1594 bp, Setaria italica
ttgctcgtttgctctcatgcagcggtttaagcttcacctgcagccatgggtaaggagaagtcccacatcaacatcgtggtcattggccatgtcgactctggcaagtcaaccaccaccggccacctgatctacaagcttggaggtatcgacaagcgtgtgatcgagaggttcgagaaggaggccgctgagatgaacaagaggtccttcaagtacgcgtgggtgcttgacaagctcaaggctgagcgtgagaggggtatcaccattgatattgccctgtggaagtttgagaccaccaagtactactgcacagtcattgatgcccctggacaccgtgacttcatcaagaacatgatcactggtacctcccaggctgactgtgctgtcctcatcattgactccaccactggtggttttgaggctggtatctccaaggatggccagacccgtgagcatgctctccttgctttcactcttggagtgaaacagatgatttgctgctgcaacaagatggacgccaccactcccaagtactccaaggcccgttatgatgagattgttaaggaagtctcctcctacctgaagaaggtgggttacaaccctgacaagattgccttcgtccccatctccggtttcgagggtgacaacatgattgagaggtccaccaaccttgactggtacaagggcccaaccctgctcgaggctcttgaccagatcaacgagcccaagaggccttcggacaagcccctgcgtctcccccttcaggatgtgtacaagattggtggtattggaaccgtccctgttggccgtgttgagaccggtatcatcaagcctggtatgcttgtcacctttggtccaactggcctgactactgaggtgaagtctgttgagatgcaccacgaggctctccaggaggcccttcctggtgacaacgttggcttcaacgtgaagaacgttgctgtcaaggatctcaagcgtgggttcgtggcctccaactccaaggatgaccctgccaaggaggctgccagcttcacctcccaggtcatcatcatgaaccaccctgggcagatcggcaacggctacgccccagtgctggactgccacacctcccacatagctgtcaagtttgctgagctcattaccaagatcgacaggcgatccggtaaggagcttgagaaggagcccaagttcctgaagaacggtgatgctggtatggtgaagatgattcccacgaagcccatggtggtggagaccttctctgagtaccctcctcttggtcgcttcgctgtccgtgacatgagacagacagttgctgtgggagtcatcaagagcgtggagaagaaggacccgaccggcgccaaggttaccaaggctgccgccaagaagaaatgatgcgcctggtgttgctctaatcctgtgtctgcttttgcgatacctagataactttcactatcacatattagttttgtccccggtcattgctgttgtcgttgaacttttaaaggtccgctggcggtgtgccatgtgtttgttgtttaggtaccctcttattatatctgcttgggcaaaacttgaatgctttaatacctatttgtta

SEQ ID NO: 537 - DNA, 1753 bp, Setaria italica
caggtagcctcccctccttgccgtcacccgcgccgcctccgccccgcgccccctctccttcgcttcctcagcagtttaagcctcacctgcagccatgggtaaggagaagtcccacatcaacatcgtggtcattggccacgtcgactctggcaagtcgaccaccaccggccacctgatctacaagcttggaggtattgacaagcgtgtgatcgagaggttcgagaaggaggctgctgagatgaacaagaggtccttcaagtatgcgtgggtgcttgacaagctcaaggctgagcgtgagaggggtatcaccattgatattgccctgtggaagttcgagaccaccaagtactactgcacagtcattgatgcccctggacaccgtgacttcatcaagaacatgatcactggtacctcccaggctgactgtgctgtcctcatcattgactccaccactggtggttttgaggctggtatctccaaggatggccagacacgtgagcatgctctccttgctttcactcttggagtgaaacagatgatttgctgctgcaacaagatggatgccaccactcccaagtactccaaggcccgttatgatgagattgtgaaggaagtctcctcctacctgaagaaggtgggatacaaccctgacaagattgccttcgtcccaatctctggttttgagggtgacaacatgattgagaggtccaccaaccttgactggtacaagggcccaaccctgcttgaggctcttgaccagatcaacgagcccaagaggccttcggacaagcccctccgtcttccccttcaggatgtgtacaagattggtggtattggaaccgtccctgttggccgtgttgagaccggtatcatcaagcctggtatgcttgtcacctttggtcccactggcctgactactgaggtgaagtcagttgagatgcaccacgaggctctccaggaggcccttcctggtgacaacgttgggttcaacgtgaagaacgttgctgtgaaggatctcaagcgtgggttcgtggcctccaactccaaggatgaccctgccaaggaggctgccagcttcacctcccaggtcatcatcatgaaccaccctgggcagatcggcaacggctacgccccagtgctggactgccacacctcccacatcgctgtcaagtttgctgagctcattaccaagatcgacagacgatccggtaaggagcttgagaaggagcccaagttcctgaagaatggtgatgctggtatggtgaagatgattcccactaagcccatggtggtggagaccttctccgagtaccctcctctgggtcgctttgctgtccgtgacatgaggcagacggtagctgttggagtcatcaagagtgtggagaagaaggaccctaccggcgccaaggttaccaaggctgcagccaagaagaaatgatgtgtctggtggttgattccgcttctgcttttgttatacctagatgcttcaatatcgctgaagttttgtctatggccattgctgttgtcatgtgtgtcatcattctgtttgtcagttcaacacagttttaatattttggattcggcaaaacttaaattacctgagactgatttgtgcccctgtcggtgcttgttaaatgcaagtacttgggttcttcctatcgttgttccgttgattaaatttcgtttctggtatgttctgaggttcaaatcgttgttaacctgatgatgtttcgagatttctgttcctaatttg

SEQ ID NO: 538 - DNA, 1861 bp, Setaria italica
ggcagcctcccgacgcgccgtcgcctccgcctcctccccacgccatccttcgcttcctcagcggtttaagcttcacctgcgaccatgggtaaggagaagtcccacatcaacatcgtggtcattggccacgtcgactccggcaagtcgaccaccaccggccacctgatctacaagcttggaggtatcgacaagcgtgtgatcgagaggttcgagaaggaggccgctgagatgaacaagcggtccttcaagtacgcgtgggtgcttgacaagctcaaggctgagcgtgagaggggtatcaccattgatatcgccctgtggaagttcgagaccaccaagtactactgcacagtcattgatgcccctggacaccgtgatttcatcaagaacatgatcactggtacctcccaggctgactgtgctgtccttatcattgactccaccactggtggttttgaggctggtatctccaaggatggccagacccgtgagcatgctctccttgctttcacccttggagtgaagcagatgatctgctgctgcaacaagatggatgccaccactcccaagtactccaaggcccgctatgatgagattgttaaggaagtctcctcctacctgaagaaggtgggttacaaccctgacaagattgccttcgtcccaatctctggttttgagggtgacaacatgattgagaggtccaccaaccttgactggtacaagggcccaaccctgcttgaggctcttgaccagatcaacgagcccaagaggccttcggacaagcccctccgtcttccccttcaggatgtgtacaagattggtggtattggaaccgtccctgttggccgtgttgagaccggtatcatcaagcctggtatgcttgtcacctttggtcccactggcctgactactgaggtgaagtcagttgagatgcaccacgaggctctccaggaggcccttcctggtgacaacgttgggttcaacgtgaagaacgttgctgtgaaggatctcaagcgtgggtttgtggcctccaactccaaggatgaccctgccaaggaggctgccagcttcacctcccaggtcatcatcatgaaccaccctgggcagatcggcaatggctacgccccagtgctggactgccacacctcccacattgctgtcaagtttgctgagctcattaccaagatcgacagacgatccggtaaggagcttgagaaggagcccaagttcctgaagaatggtgatgctggtatggtgaagatgattcccaccaagcccatggtggtggagaccttctctgagtaccctcctcttggtcgttttgctgtccgtgacatgaggcaaacggttgctgttggagtcatcaagagtgtggagaagaaggacccaacaggcgccaaggtgaccaaggctgcagccaagaagaaatgatgtgtctggtggttgattatgtgtctacttttgggagacttagatgctctatatcatgtcttattttttgtccatggccatttctgttatcgtttgaactctttgcaggcaaagtgcgccttggtcaattgtactagtactgttttgttatttcagcctaggcaaaactggaatgcttggacttatttgtgctgttatcgtccatgttcaatccgagtctttatatagctaccagtaaagctttgttttcttctagttctgtttgctctggttattatgttgttagcgttggcttccttttgcattttggacatgaagccttatgctacatccatgaacactaaatagtttttggtttacttcgagtgtcgttttgtagcgtctacctgtacttgtgtattttgatacgcatcctacctgacattttaaactt

SEQ ID NO: 539 - DNA, 1906 bp, Setaria italica
gctccatcccatccgcaaatcccccagacgcagtcggccgccgcagaccgggagtgcacgagcgacgcgagggcgagcacgcgagcggcgagtcgccagcgcgccgtcacctgcgcctccgcctcctcctcctcctcctctcgacgccgtttccttcgcttcctcagcggttcaagcttcacctgcagccatgggtaaggagaagtcccacatcaacattgtggtcattggccacgtcgactctggcaagtcgaccaccaccggccacctgatctacaagcttggaggtatcgacaagcgtgtgatcgagaggttcgagaaggaagctgcagagatgaacaagcggtccttcaagtatgcatgggtgcttgacaagctcaaggctgagcgtgagaggggtatcaccattgatattgccctgtggaagttcgagaccaccaagtactactgtaccgtcattgacgcccctggacaccgtgacttcatcaagaacatgatcactggtacctcccaggctgactgtgctgtcctcatcattgactccaccactggtggttttgaggctggtatctccaaggatggccagacccgtgagcatgctctccttgctttcactcttggagtcaagcagatgatctgctgctgcaacaagatggacgccaccactcccaagtactccaaggcccgttatgatgagattgttaaggaagtctcctcctacctgaagaaggtgggttacaaccctgacaagattgccttcgtccccatctccggtttcgagggtgacaacatgattgagaggtccaccaaccttgactggtacaagggcccaaccctgctcgaggctcttgaccagatcaacgagcccaagaggccttcggacaagcccctgcgtctcccccttcaggatgtgtacaagattggtggtattggaaccgtccctgttggccgtgttgagaccggtatcatcaagcctggtatgcttgtcacctttggtccaactggcctgactactgaggtgaagtctgttgagatgcaccacgaggctctccaggaggcccttcctggtgacaacgttggcttcaacgtgaagaacgttgctgtcaaggatctcaagcgtgggttcgtggcctccaactccaaggatgaccctgccaaggaggctgccagcttcacctcccaggtcatcatcatgaaccaccctgggcagatcggcaacggctacgccccagtgctggactgccacacctcccacatagctgtcaagtttgctgagctcattaccaagatcgacaggcgatccggtaaggagcttgagaaggagcccaagttcctgaagaacggtgatgctggtatggtgaagatgattcccacgaagcccatggtggtggagaccttctctgagtaccctcctcttggtcgcttcgctgtccgtgacatgagacagacagttgctgtgggagtcatcaagagcgtggagaagaaggacccgaccggcgccaaggttaccaaggctgccgccaagaagaaatgatgcgcctggtggttaatcctgtgtctgcttttgcgatacctagataactttcactatcacatattagttttgtccccggtcattgctgttgtcgttgaacttttaaaggtccgctggcggtgtgccatgtgtttgttgtttaggtaccctcttattatatctgcttgggcaaaacttgaatgctttaatacctatgtgtgctcttttgggcatctttaaacgagttgggagtcgtctagttatctttatgcaatttgtttcgtgttctctaaatgtttgctccactgatttgcatttggattgtggtttcagccttcctgcaactgaaaatgctgtattcagcttgttctgctgtgtagtatactatttgtc

SEQ ID NO: 540 - DNA, 1981 bp, Gossypium raimondii
ctaaccctagctcttgttgctttttctcaatatatatactaggcagagcccttaccgcttaccccaattcttcattttcattttattgttccttccttcgccgtctactgcacttgtgacatcgatttcaagtgaatcagaatgggtaaggaaaagagtcacattaacattgtggtcattggccacgtcgattccggaaaatcgaccaccactggccacctgatctacaagcttggtggtattgacaagcgtgtgattgaaaggtttgagaaagaagctgcggagatgaacaagaggtcattcaagtatgcttgggtgcttgacaagctcaaggctgaacgtgagcgtggtatcaccattgatattgccttgtggaaatttgagacgaccaaatactactgcactgtgattgatgcgcctggacaccgtgactttatcaagaacatgattactggtacctcgcaggctgattgtgctgttttgattattgattccaccactggtggttttgaggctggtatctccaaggatggtcagactcgtgagcatgctttgcttgcttttacccttggtgtcaagcaaatgatttgctgttgcaacaagatggatgccactacccctaaatattcgaaggctaggtatgatgaaatcgtgaaggaagtctcttcctacttgaagaaggttggatacaaccctgacaagattccatttgttcccatttctggttttgagggtgataacatgattgagaggtctaccaacttggactggtacaagggccctacacttcttgaggctcttgaccagatcaatgagcccaagaggccttcagacaagcctctccgtctaccacttcaggatgtgtacaagattggtggtattggaactgtcccagttggtcgtgttgaaactggtgtcttgaagcctggtatggttgtgacctttggtcctactggtctgaccactgaagttaagtctgttgagatgcaccatgaagctcttacggaggcgcttcctggtgataatgttgggttcaatgttaagaatgtcgctgttaaggatctcaagcgtggttatgttgcatccaactccaaggatgatcctgctaaggaggctgcaaacttcacttctcaggtcatcatcatgaaccatcctggacaaattggaaacggatatgccccagtcctcgactgccacacctcacacattgctgttaagtttgctgaacttttgaccaagattgacaggcgatctggtaaggagcttgagaaggaacccaagttcttgaagaatggtgatgctggtatgattaagatgattcccaccaagcccatggttgtggagaccttctccgagtacccacccttgggtcgttttgctgtgagggacatgcgtcagaccgtggctgttggtgttatcaagaatgttgagaagaaggacccaaccggtgccaaggtcaccaagtctgctgctaagaagaagtgaaccgtgctggctaaacctaatgaagtttccgcagatggagtattttattatgataataatagtttgatagactttatcatttatgatatagttggtcttttgcttggttttgcatgttatagtgtggtgccattgttgtctggtaactgttctcagtattgggtgcttgacagacggtggcatagctatggcaggtggtctctagcgttatctggttttgtttaatttactactgtatcttgtcattgtcaagagggtgcccccttggttttccaaggtggctcgaaacttttgtttatgattttcgttgaagctgcggaattatttattatgaaatcatgctgtatttttgcgttttggtagatttcagtctctaatcatatcatttccttaatttgctttttgcctgtaaaagataattgatttgctttcataaactaattatttgcaaatttattaaataaacttctaaatcgtaccatacaacaaataaaaa

SEQ ID NO: 541 - DNA, 1869 bp, Lotus japonicus
actctgctcttaattttgctatcgctcagtctctgcggctgagaattccgaacatcgtttgaatctgagttcaattagtcatgggtaaagagaagtttcacattaacatcgtggtcattggtcatgtcgactctgggaagtcgactaccactggccacttgatttacaagcttggaggtattgacaagcgtgttattgagaggtttgagaaagaagctgctgaaatgaacaagaggtcattcaagtatgcttgggtgcttgacaagctcaaggctgagcgtgaaagagggattaccattgatattgcattgtggaagtttgagaccaccaaatactactgcacagtcattgatgctcctggacatcgtgactttatcaagaacatgattactggaacttctcaggctgactgtgctgtccttatcattgattccacaactggtggtttcgaagctggtatttccaaggatggacagactcgtgagcacgcactgcttgctttcactcttggagtcaagcaaatgatctgttgctgtaacaagatggatgccactacccccaagtactccaagggtaggtatgaagaaattgtgaaggaagtttcttcctacctgaagaaggttggttacaacccagacaaaattccatttgttcccatctctggttttgagggtgacaacatgattgagaggtccactaaccttgactggtacaagggcccaactcttcttgaggctcttgaccagatcaatgagcccaagagaccctcagacaagcctttgaggcttccccttcaggatgtctacaagattggtggtattggaactgtgcctgttggacgtgttgaaactggtgtcttgaagcctggttttgtggtgacttttgctccaactggtctgacaactgaagttaagtcagtggagatgcaccatgagtccctcactgaggccctacctggtgacaatgtgggatttaatgtgaagaatgttgcagtcaaggatctcaagcgtggtttcgtggcttcaaactcaaaggatgaccctgccaaggaagctgcaaacttcacctcccaagtcattatcatgaaccatcctggccagattggaaatggctatgctccagtgcttgactgccacacttctcatattgctgtcaaatttgccgagcttttgaccaagattgacaggcgatctggtaaggagattgagaaggagcccaaattcttgaaaaatggagatgcaggtatggttaagatggttcccaccaagcccatggtggtcgagactttctccgagtatcctcctcttggtcgttttgctgtcagggacatgcgtcaaacggttgctgtgggagtcatcaagagtgtggagaagaaggacccaactggcgccaaggtcaccaaggctgcacagaaaaagaagtaaatggatcttagcattctgcaagttcatgtgaaccattattataattatggttacagaaatcagtggtgacttgttagcaattatcttttgagactttaggtgtttttacctgttatagttttatgtttgtcatttttatgcggccacagttttcaaactgagttctggacctgcgatgttgagttatgtgtttcagtcttgcttttacttttaatttctgcatgagaactcaagcagctttagggttttaaagttctcctttgctgacgagtatgttttaattatttgtgtttacatttataagtaaattttgtcacatgttttgttacctgaattgtcccattgtgttatgaggtttttaccgtttaattgtttatcagttttacagactagatttgtgacattggataaattattattttagtgtcaaaacttatgtgttgtt

SEQ ID NO: 542 - DNA, 1593 bp, Pennisetum glaucum
aaggagaagagtcacattaacatcgtggtgattggccatgtcgactctggcaagtcgaccaccactggccacctgatctacaagcttggaggtattgacaagcgtgtgatcgagaggttcgagaaggaggccgcggaaatgaacaagaggtccttcaagtacgcgtgggtgcttgacaagctgaaggctgagcgtgagagaggtatcaccatcgacattgccctgtggaagttcgagaccaccaagtactactgcacggtcatcgatgcccctggtcaccgtgacttcatcaagaacatgatcaccggcacctcccaggctgactgcgctgtcctcatcattgactctaccactggtggttttgaggctggtatctctaaggatggccagacccgtgagcatgctctgcttgctttcactcttggagtgaagcagatgatctgctgctgtaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctgcgtctcccccttcaggacgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcctggtgacaatgttggtttcaatgtgaagaacgttgctgtgaaggatctcaagcgtggttatgtggcctccaactccaaggatgaccctgccaaggaggctgccagcttcacctcccaggtcatcatcatgaaccaccctgggcagatcggcaatggctatgccccagtgctggactgccacacctcccacattgctgtcaagtttgctgagcttgtcaccaagatcgacaggcggtctggtaaggagctcgagaaggagcccaagtttctgaagaacggtgatgctggtatggtgaagatgattcccacgaagcccatggttgtggagacattctctgagtacccccctcttggtcgctttgctgttcgtgacatgaggcagacggttgctgttggtgtcatcaagagcgtcgagaagaaggatcccactggtgccaaggttaccaaggctgctgccaagaagaaatgaggggtctgagggttattgtcgtcgtagtagtcctagtgcggttttgaggttttgttaggccattgttcttgcagcagggccttgcagttccacgcgactgtaatttctgctggcaatgcgctctactgtctggtgtctatgtaaacgctactgttatttggttgtggtgaaacctttactggctgattcataatttcatatcacttatatttgctgtgtggttctggaatgcagcccttcttgattcaaaaaaaa

SEQ ID NO: 543 - DNA, 1603 bp, Papaver somniferum
gaagctctgtgctgcggagctttctatcgccgtttcagttattttctaagaattcaatatgggtaaagagaaggttcacatcaacattgtcgtcattggacatgtcgactctggaaaatcgaccaccaccggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgatcactggtacttctcaggctgattgtgccgtcctcattatcgattctaccactggaggttttgaggctggtatctcaaaggatggtcagactcgtgagcacgctcttcttgctttcacccttggtgtcaagcagatgatctgttgttgtaacaagatggatgccaccacccccaagtactcaaaggctaggtatgatgaaattgtcaaggaggtctcatcttacttgaagaaggttggatacaacccagaaaaaattgcctttgttcctatctctggatttgagggagacaacatgattgaaaggtccaccaaccttgactggtacaagggaccaactctccttgaggctcttgacaacatctctgagccaaagagaccctcagacaagccccttcgtcttccccttcaggatgtttacaagattggaggtattggaactgtgccagtgggacgggttgaaactggagtcatcaagcctggtatggttgttacttttggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactcaaaggatgaccctgccagggaagctgccaacttcacctcccaggtcatcatcatgaaccatcctggtcagatcggtaatggttatgctccagttcttgactgtcacacatctcacattgctgtcaagtttgctgagatccaaaccaagatcgataggcgatctggaaaggagcttgagaaggagcccaagttcttgaagaacggtgatgctggtattattaagatgattccaaccaagcccatggttgtagagacctttgctcagtacccacctcttggacgttttgctgttagggacatgaggcagacagttgctgttggtgtcatcaagggagttgagaagaaggacccaacaggagccaaggttaccaagtctgctgtcaagaagaaatgaagtgtgctgccaaggttaactacaggagggacttatttctttactattagtcagttttgtttttgttgtggtgcattagataccagtgtggtcttttgttttgtttcaccttcgttcagttgcgcattcagttgcaaacctgggtgcttgacaggcggtggcaacaaggtgttgggctgttttgttgaatttcctttaaaa

SEQ ID NO: 544 - DNA, 1705 bp, Papaver somniferum
tctgtgctgcggagcttttcttatcgccgttctgttattttctaagaattcaatatgggtaaagagaaggttcacatcaacattgtcgtcattggacatgtcgactctggtaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgcactgtggaagtttgagaccaccaagtactactgcacagttattgatgctcctggacatcgtgactttatcaaaaacatgattactggtacttctcaggctgattgtgccgtcctcattatcgattccaccactggaggttttgaggctggtatctcaaaggatggtcagactcgtgagcatgctcttcttgctttcacccttggtgtcaagcagatgatctgttgttgtaacaagatggatgccaccacccccaagtactcaaaggctaggtacgatgaaattgtcaaggaggtctcatcttacttgaagaaggttggatacaacccagaaaaaattgcctttgttcctatctctggattcgagggagacaacatgattgaaaggtccaccaaccttgactggtacaagggaccaactctccttgaggctcttgacaacatctctgagccaaagagaccctcagacaagccccttcgtcttccccttcaagatgtttacaagattggaggtattggaactgtgccagttggacgtgttgaaactggagtcatcaagcctggtatggttgttacctttggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactccaaggatgacccagccagggaagctgccaacttcacctcccaggtcatcatcatgaaccatcctggtcagattggtaatggttatgctccagttcttgactgtcacacatctcacattgctgttaagtttgctgagatccaaaccaagatcgataggcgatctggaaaggagcttgagaaggagcccaagttcttgaagaatggtgatgctggtattattaagatgattccaaccaagcccatggttgtagagaccttcgctcagtatccacctcttggacgttttgctgttagggacatgaggcagacagttgctgttggtgtcatcaagggggttgagaagaaggacccaaccggagccaaggttaccaagtctgctgtcaagaagaagtaaagtactccagtgagtacagggatggtgctaagagggtctgcagaatggttttgtcttgtttacttcagtagtagtcatttttgtttctggtttgctttggttagctatcattgcagttttatatcttttgttgcctttgttttgttgagcatccagatgcaaacctgggtgcttgataggcggtggcaacatgagtttgggctgttcagttaattgaaaacttgttatggattttggtttgtaagttgctgttaacaactttttatttgcatctctctttcccagttaaatgaaaacagtgttctag

SEQ ID NO: 545 - DNA, 1712 bp, Papaver somniferum
tttcagtaatgaaaacccattactactacttttccgaagaagctctgtgctgcggagcttttctaatcgccgtttctgttattttctaagaattcaatatgggtaaagagaaggttcacatcaatattgttgtcattggacatgtcgactctggtaaatcgaccaccactggtcacttgatctacaagcttggaggtattgacaagcgtgttattgaaagattcgagaaggaggctgctgagatgaacaagaggtcattcaagtacgcttgggttcttgacaagcttaaggctgaacgtgagcgtggtattaccattgatattgccttgtggaagtttgagaccaccaagtactactgcacagttattgatgctcctggacatcgtgactttatcaaaaacatgatcactggtacttctcaggctgattgtgccgtcctcattatcgattctaccactggaggttttgaggctggtatctcaaaggatggtcagactcgtgagcacgctcttcttgctttcacccttggtgtcaagcagatgatctgttgttgtaacaagatggatgccaccacccccaagtactcaaaggccaggtacgatgaaattgtgaaggaggtctcatcttacttgaagaaggttggatacaacccagaaaaaattgcctttgttcctatctctggattcgagggagataacatgattgaaaggtccaccaaccttgactggtacaagggaccaactctccttgaggctcttgacaacatctctgagccaaagagaccatcagacaagccccttcgtcttccccttcaggatgtttacaagattggaggtattggaactgtgccagtgggacgtgttgaaactggagtcatcaagcctggtatggttgttacttttggacccaccggtttgaccactgaagttaagtctgtggagatgcaccacgaagcccttctagaagctcttccaggagacaatgttgggttcaatgtcaagaatgttgcagtgaaggatctcaagcgcggtttcgtcgcctccaactccaaggacgatcctgccagggaagctgccaacttcacctcccaggtcatcatcatgaaccatcctggtcagatcggtaatggttatgctccagttcttgactgtcacacatctcacattgctgttaagtttgctgagatccaaaccaagatagataggcgatctggaaaggagcttgagaaggagcccaagttcttgaagaacggtgatgctggtattattaagatgattccaaccaagcccatggttgtagaaacctttgctcagtacccacctcttggacgttttgctgttagggacatgaggcagacagttgctgttggtgtcatcaagggagttgagaagaaggatccaacaggagccaaagttaccaagtctgctgtcaagaagaagtaaagtactccagtaagtacagggatggtgctaagagggtctgcagaagggttttgtcttgtttacttcagtagtagtcatttttgtttcttgtttgctttggttagctatcattgcagttttatatcttttgttgcctttgttttgttgagcatccagatgcaaacctgggtgcttgataggcggtggcaacatgagtttgggctgttcagttaattgaaaacttgttatggattttggtttgtaagttgctgttaacaactttttatttgc

SEQ ID NO: 546 - DNA, 1791 bp, Papaver somniferum
tctgtgctgcggagcttatctattcggcgattcagttaatttctaagaattcaatatgggtaaagagaaggttcacatcaacattgtcgtcattggacatgtcgactctggtaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgccgtcctcattatcgattcaaccactggaggttttgaggctggtatttcaaaggatggtcagactcgggagcatgctcttcttgctttcacccttggtgtcaagcagatgatctgttgttgtaacaagatggatgccaccacccccaagtactcaaaggctaggtacgatgaaattgtgaaggaggtctcatcttacttgaagaaggttggatacaacccagaaaaaattgcctttgttcctatctctggattcgagggagacaacatgattgaaaggtccaccaaccttgactggtacaagggaccaactctccttgaggctcttgacaacatctctgagccaaagagaccctcagacaagccccttcgtcttccccttcaggatgtttacaagattggaggtattggaactgtgccagtgggacgtgttgaaactggagttatcaagcctggtatggttgttacttttggacccaccggtttgaccactgaagttaagtctgtggagatgcaccacgaagcccttctagaagctcttccaggagacaatgttgggttcaatgtcaagaatgttgcagtgaaggatctcaagcggggtttcgtcgcctccaactcaaaggacgaccctgccagggaagctgccaacttcacctcccaggtcatcatcatgaaccatcctggtcagatcggtaatggttatgctccagttcttgactgtcacacatctcacattgctgtcaagtttgctgagatccaaaccaagatcgataggcgatctggaaaggagcttgagaaggagcccaagttcttgaagaacggtgatgctggtattattaagatgattccaaccaagcccatggttgtagagacctttgctcagtacccacctcttggacgttttgctgttagggacatgaggcagacagttgctgttggtgtcatcaagggagttgagaagaaggacccaacaggagccaaggttaccaagtctgctgtcaagaagaaatgaagtgtgctgccaaggttaactacaggagggacttatttctttactattagtcagttttgttttttgttgtggtgcattaggtaccagtgtggtcttttgttttgtttcaccttcgttcagttgcgcattcagttgcaaacctgggtgcttgacaggcggtggcaacaaggtgttgggctgttttgttgaatttcctttaaaaacttatgttggattttgggttttcaagtttctgttcacaactttacttaaaaccctctgcctttaattgaaaaccatatttgctagttattgtcttcagagttacttcagattgctttcatgtgcatcttattcttggagaactgcatattctagcactggtttcactttggtgaaccctggcagttctc

SEQ ID NO: 547 - DNA, 1782 bp, Papaver somniferum
ttcggcgattcagttaatttctaagaattcaatatgggtaaagagaaggttcacatcaacattgtcgtcattggacatgtcgactctggtaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgccgtcctcattatcgattctaccactggaggttttgaggctggtatctcaaaggatggtcagactcgtgagcacgctcttcttgctttcacccttggtgtcaagcagatgatctgttgttgtaacaagatggatgccaccacccccaagtactcaaaggccaggtacgatgaaattgtgaaggaggtctcatcttacttgaagaaggttggatacaacccagaaaaaattgccttcgttcctatctctggattcgagggagataacatgattgaaaggtccaccaaccttgactggtacaagggaccaactctccttgaggctcttgacaacatctctgagccaaagagaccatcagacaagccccttcgtcttccccttcaggatgtttacaagattggaggtattggaactgtgccagtgggacgtgttgaaactggagtcatcaagcctggtatggttgttacttttggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactccaaggacgatcctgccagggaagctgccaacttcacctcccaggtcatcatcatgaaccatcctggtcagatcggtaatggttatgctccagttcttgactgtcacacatctcacattgctgttaagtttgctgagatccaaaccaagatagataggcgatctggaaaggagcttgagaaggagcccaagttcttgaagaacggtgatgctggtattattaagatgattccaaccaagcccatggttgtagaaaccttcgctcagtacccacctcttggacgttttgctgttagggacatgaggcagacagttgctgttggtgtcatcaagggagttgagaagaaggatccaacaggagccaaggttaccaagtctgctgtcaagaagaagtaaagtactccagtaagtacagggatggtgctaagagggtctgcagaagggttttgtcttgtttacttcagtagtagtcatttttgtttcttgtttgctttggttagctatcattgcagttttatatcttttgttgcctttgtttgttgagcatccagatgcaaacctgggtgcttgataggcggtggcaacatgagtttgggctgttcagttaattgaaaacttgttatggattttggtttgtaagttgctgttaacaactttttatttgcgcatctctttcccagtttaatgaaaatagtgtctgctagaattgttttactctaataacctaaaaaaaaaaaaactagtaagactagtaccaaggtaccaacgaacgaaggggtaagttaacgggtagtagtatag

SEQ ID NO: 548 - DNA, 1729 bp, Papaver somniferum
ttgtgaaaactctctgtgctgcggagcttatctattcggcgattcagttaatttctaagaattcaatatgggtaaagagaaggttcacatcaacattgtcgtcattggacatgtcgactctggtaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgccgtcctcattattgattccaccactggaggttttgaggctggtatctcaaaggatggtcagactcgtgagcatgctcttcttgctttcacccttggtgtcaagcagatgatctgttgttgtaacaagatggatgccaccacccccaagtactcaaaggctaggtacgatgaaattgtcaaggaggtctcatcttacttgaagaaggttggatacaacccagaaaaaattgcctttgttcctatctctggattcgagggagacaacatgattgaaaggtccaccaaccttgactggtacaagggaccaactctccttgaggctcttgacaacatctctgagccaaagagaccctcagacaagccccttcgtcttccccttcaagatgtttacaagattggaggtattggaactgtgccagttggacgtgttgaaactggagtcatcaagcctggtatggttgttacctttggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactccaaggatgacccagccagggaagctgccaacttcacctcccaggtcatcatcatgaaccatcctggtcagattggtaatggttatgctccagttcttgactgtcacacatctcacattgctgttaagtttgctgagatccaaaccaagatcgataggcgatctggaaaggagcttgagaaggagcccaagttcttgaagaatggtgatgctggtattattaagatgattccaaccaagcccatggttgtagagaccttcgctcagtatccacctcttggacgttttgctgttagggacatgaggcagacagttgctgttggtgtcatcaagggggttgagaagaaggacccaaccggagccaaggttaccaagtctgctgtcaagaagaagtaaagtactccagtgagtacagggatggtgctaagagggtctgcagaatggttttgtcttgtttacttcagtagtagtcatttttgtttctggtttgctttggttagctatcattgcagttttatatcttttgttgcctttgttttgttgagcatccagatgcaaacctgggtgcttgataggcggtggcaacatgagtttgggctgttcagttaattgaaaacttgttatggattttggtttgtaagttgctgttaacaactttttatttgcatctctctttcccagttaaatgaaaacagtgttctaaagttaaaaaaa

SEQ ID NO: 549 - DNA, 1750 bp, Papaver somniferum
aaagctctctgtgctgcggagcttatctaattcggcgtttcagttattttctaagaattcaatatgggtaaagagaaggttcacatcaacattgtcgtcattggacatgtcgactctggaaaatcgaccaccaccggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgatcactggtacttctcaggctgattgtgccgtcctcattatcgattctaccactggaggttttgaggctggtatctcaaaggatggtcagactcgtgagcacgctcttcttgctttcacccttggtgtcaagcagatgatctgttgttgtaacaagatggatgccaccacccccaagtactcaaaggccaggtacgatgaaattgtgaaggaggtctcatcttacttgaagaaggttggatacaacccagaaaaaattgccttcgttcctatctctggattcgagggagataacatgattgaaaggtccaccaaccttgactggtacaagggaccaactctccttgaggctcttgacaacatctctgagccaaagagaccatcagacaagccccttcgtcttccccttcaggatgtttacaagattggaggtattggaactgtgccagtgggacgtgttgaaactggagtcatcaagcctggtatggttgttacttttggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactccaaggacgatcctgccagggaagctgccaacttcacctcccaggtcatcatcatgaaccatcctggtcagatcggtaatggttatgctccagttcttgactgtcacacatctcacattgctgtcaagtttgctgagatccaaaccaagatcgataggcgatctggaaaggagcttgagaaggagcccaagttcttgaagaacggtgatgctggtattattaagatgattccaaccaagcccatggttgtagagacctttgctcagtatccacctcttggacgttttgctgttagggacatgaggcagacagttgctgttggtgtcatcaagggggttgagaagaaggacccaaccggagccaaggttaccaagtctgctgtcaagaagaagtaaagtactccagtgagtacagggatggtgctaagagggtctgcagaatggttttgtcttgtttacttcagtagtagtcatttttgtttctggtttgctttggttagctatcattgcagttttatatcttttgttgcctttgttttgttgagcatccagatgcaaacctgggtgcttgataggcggtggcaacatgagtttgggctgttcagttaattgaaaacttgttatggattttggtttgtaagttgctgttaacaactttttatttgcatctctctttcccagttgaataaaacagtgttctagttaatgtcttgttttttcttattaatgtcttttactc

SEQ ID NO: 550 - DNA, 1649 bp, Papaver somniferum
aattcggcgtttcagttatttctaagaattcaatatgggtaaagagaaggttcacatcaacattgtcgtcattggacatgtcgactctggaaaatcgaccaccaccggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgatcactggtacttctcaggctgattgtgccgtcctcattatcgattctaccactggaggttttgaggctggtatctcaaaggatggtcagactcgtgagcacgctcttcttgctttcacccttggtgtcaagcagatgatctgttgttgtaacaagatggatgccaccacccccaagtactcaaaggctaggtatgatgaaattgtcaaggaggtctcatcttacttgaagaaggttggatacaacccagaaaaaattgcctttgttcctatctctggatttgagggagacaacatgattgaaaggtccaccaaccttgactggtacaagggaccaactctccttgaggctcttgacaacatctctgagccaaagagaccctcagacaagcccctccgtcttccccttcaggatgtttacaagattggaggtattggaactgtgccagtgggacgtgttgaaactggagtcatcaagcctggtatggttgttacttttggacccaccggtttgaccactgaagttaagtctgtggagatgcaccatgaagcccttctagaagctcttccaggagacaatgttgggttcaatgtcaagaatgttgcagtgaaggatctcaagcggggtttcgtcgcctccaactcaaaggatgaccctgccagggaagctgccaacttcacctcccaggtcatcatcatgaaccatcctggtcagatcggtaatggttatgctccagttcttgactgtcacacatctcacattgctgtcaagtttgctgagatccaaaccaagatcgataggcgatctggaaaggagcttgagaaggagcccaagttcttgaagaacggtgatgctggtattattaagatgattccaaccaagcccatggttgtagagacctttgctcagtacccacctcttggacgttttgctgttagggacatgaggcagacagttgctgttggtgtcatcaagggagttgagaagaaggacccaacaggagccaaggttaccaagtctgctgtcaagaagaaatgaaatgtgctgccaaggttaactagagggatggtgctaggaggatctacaggaaggacttgtctctattgctttactattagtcagtttcatttttgctttttgttggttaggtatctgtgcagtctcttgttctgtaacgcttttgttttgttgcgcgtccggatgcaaacctgggtgcttgacaggcggtggcaacaaaatgttaggttgttcagttgaagttcctttaaaaacatatgtttgattttgggttttcaattcaagacttttt

SEQ ID NO: 551 - DNA, 1728 bp, Papaver somniferum
gttttgtgaaaaaagctctgtgccgcggagcttatctaatcgccgtttcagttaatttctaagaattcaatatgggtaaggagaaggttcatatcaatattgttgtcattggacatgtcgactctggtaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgccgtcctcattatcgattctaccactggaggttttgaggctggtatctcaaaggatggtcagactcgtgagcacgctcttcttgctttcacccttggtgtcaagcagatgatctgttgttgtaacaagatggatgccaccacccccaagtactcaaaggctaggtacgatgaaattgtcaaggaggtctcatcttacttgaagaaggttggatacaacccagaaaaaattgcctttgttcctatctctggattcgagggagacaacatgattgagaggtccaccaaccttgactggtacaagggaccaactctccttgaggctcttgacaacatctctgagccaaagagaccctcagacaagccccttcgtcttccccttcaggatgtttacaagattggaggtattggaactgtgccagttggacgtgttgaaactggagtcatcaagcctggtatggttgttacctttggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactcaaaggatgaccctgccagggaagctgccaacttcacctcccaggtcatcatcatgaaccatcctggtcagatcggtaatggttatgctccagttcttgactgtcacacatctcacattgctgttaagtttgctgagatccaaaccaagatcgataggcgatctggaaaggagcttgagaaggagcccaagttcttgaagaacggtgatgcgggtattattaagatgattccaaccaagcccatggttgtggagacctttgctcagtacccacctcttggacgttttgctgttagggacatgaggcagacagttgctgttggtgtcatcaagggagttgagaagaaggacccaacaggagccaaggttaccaagtcagctgtcaagaagaaatgaagtgtgctgccgaggttaactagagggagagggatggtgctaagaggatcttcaggagggacttatttctttactattagtcagttctgtttttgttttcgtgcattaggtatcagtgtggtcttttgttttgtttcaccctcgttttgttgtgcattcagttgcaaacctgggtgcttgacaggcggtggcaacaaggtgttgggctgttttgttgaatttcctttaaaaacttgcgttggattttgggttttcaagtttctgttcacaactttgcttaaaaccctctgccatggtaattgaaaactatatt

SEQ ID NO: 552 - DNA, 1949 bp, Papaver somniferum
gaaaaagctctgttgctgcggagcttatctaattcggcgtttcagttaatttctaagaattcaatatgggtaaagagaaggttcacatcaacattgtcgtcattggacatgtcgactctggaaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgctgtcctcattatcgattccaccactggaggttttgaggctggtatctcaaaggatggtcagactcgtgagcatgctcttcttgctttcacccttggtgtcaagcagatgatctgttgttgcaacaagatggatgccaccacccccaagtactcaaaggcgaggtatgatgaaattgtcaaggaggtctcatcttacttgaagaaggttggatacaacccagaaaaaattgcctttgttcctatctctggattcgagggagacaacatgattgaaaggtccaccaaccttgactggtacaagggaccaactctcctcgaggctcttgacaacatctctgagccaaagaggccctcagacaagccccttcgtcttccccttcaggatgtttacaagattggaggtattggaactgtgccagttggacgtgttgaaactggagtcatcaagcctggtatggttgttacctttggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctcgaactcaaaggatgaccctgccagggaagctgccaacttcacctcccaggtcatcatcatgaaccatcctggtcagatcggtaatggttatgctccagttcttgactgtcacacatctcacattgctgttaagtttgctgagatccaaaccaagatcgataggcgatctggaaaggagcttgagaaggagcccaagttcttgaagaacggtgatgcgggtattattaagatgattccaaccaagcccatggttgtggagacctttgctcagtacccacctcttggacgttttgctgttagggacatgaggcagacagttgctgttggtgtcatcaagggagttgagaagaaggacccaacaggagccaaggttaccaagtcagctgtcaagaagaaatgaagtgtgctgccgaggttaactagagggagagggatggtgctaagaggatcttcaggagggacttatttctttactattagtcagttctgtttttgttttcgtgcattaggtatcagtgtggtcttttgttttgtttcaccctcgttttgttgtgcattcagttgcaaacctgggtgcttgacaggcggtggcaacaaggtgttgggctgttttgttgaatttcctttaaaaacttgcgttggattttgggttttcaagtttctgttcacaactttgcttaaaaccctctgccatggtaattgaaaactatatttgttagttattgtcttcagagttacttcagattgcttattgttctgcttcatgtgcatcttattcttggagaacttcatattctggttcactttggtgaacactggcagttctctatcagttgtgcatacattgatattcttgcatagaaattgaggttggagcgttgtactagctaggtatcatttgtattcattttattttaatccattccttctggaaaaaaaa

SEQ ID NO: 553 - DNA, 1722 bp, Papaver somniferum
tgaaaacgctctgtgctgcggagcttatctttttcggcgattcagttaatttctaagaattcaatatgggtaaagagaaggttcacatcaacattgtcgtcattggacatgtcgactctggtaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgctgtcctcattatcgattccaccactggaggttttgaggctggtatctcaaaggatggtcagactcgtgagcatgctcttcttgctttcacccttggtgtcaagcagatgatctgttgttgcaacaagatggatgccaccacccccaagtactcaaaggctaggtatgatgaaattgtcaaggaggtctcatcttacttgaagaaggttggatacaacccagaaaaattgcctttgttcctatctctggattcgagggagacaacatgattgaaaggtccaccaaccttgactggtacaagggaccaactctccttgaggctcttgacaacatctctgagccaaagagaccctcagacaagccccttcgtcttccccttcaggatgtttacaagattggaggtattggaactgtgccagttggacgtgttgaaactggagtcatcaagcctggtatggttgttacctttggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactccaaggatgaccctgccagggaagctgccaacttcacctcccaggtcatcatcatgaaccatcctggtcagatcggtaatggttatgctccagttcttgactgtcacacatctcacattgctgtgaagttcgctgagatccaaaccaagattgataggcgatctggaaaggagcttgagaaggagcccaagttcttgaagaacggtgatgcgggtattattaagatgattccaaccaagcccatggttgtagagacctttgctcagtacccacctcttggacgttttgctgttagggacatgaggcagacagttgctgttggtgtcatcaagggagttgagaagaaggacccaacaggagccaaggttaccaagtctgctgtcaagaagaaatgaaatgtgctgccaagattaactagagggatggtgctaggaggatctacaggaaggacttgtctctattgctttactattagtcagtttcatttttgctttttgttggttaggtatctgtgcagtctcttgttctgtaacgcttttgttttgttgcgcgtccggatgcaaacctgggtgcttgacaggcggtggcaacaaaatgttaggttgttcagttgaagttcctttaaaaacatatgtttgattttgggttttcaattcaagactttttacttgtttaaccctgttaattgaattgaatatcgtatttggta

SEQ ID NO: 554 - DNA, 1829 bp, Glycine max
atcactctgtgctccctcgctctatttctcagtctctgtgtttgcggctgaggattccgaacgagtgaccttcttcgtttctcgcaaagtttaagtaatcatgggtaaggaaaaggttcacatcaacattgtcgtcattggacatgtcgactctgggaagtcaactaccactggtcacttgatctacaagcttggaggtattgacaagcgtgtgattgagaggttcgagaaggaggctgccgagatgaacaagaggtcattcaagtatgcctgggtgctcgacaagctcaaagctgagcgtgaaagaggaattaccattgatattgctttgtggaagtttgaaaccaccaagtactactgcacggtcattgatgctcctggacatcgtgactttatcaagaacatgattactggtacctcccaggccgactgtgctgtccttattattgactccaccactggtggttttgaagctggtatttctaaggatggacagacccgtgagcatgctcttcttgctttcaccctaggtgtgaagcagatgatctgttgctgtaacaagatggatgccactacccccaagtactctaaggctaggtatgatgaaatcgtgaaggaagtctcttcttacttgaagaaggttggttacaacccagacaagattccctttgttcccatctctggttttgagggtgacaacatgattgagaggtccaccaaccttgactggtacaagggaccaactctccttgaggctcttgaccaaatcaatgagcccaagaggccctccgacaagcctctaaggcttccattgcaggatgtctacaagattggtggtattggtactgtgccagtgggacgtgtagagactggggttgtgaagcctggtatggtggtgacttttggtcccactgggctgacaactgaggttaagtctgttgagatgcaccatgaggctctcacagaggctcttccaggtgacaatgttggatttaatgtgaagaatgttgcagtcaaggatctcaagcgtggttttgttgcatccaactccaaggacgaccctgccaaggaagctgccaacttcacatcccaagtcattatcatgaaccatcctggccagattggtaatggatacgcaccagtccttgactgccacacttctcacattgctgtgaagttttctgaaatcttgaccaagattgacaggcgatctggtaaggagcttgagaaggagcccaaatttttgaagaatggtgatgctggtatggttaagatggttccaaccaagcccatggtggttgaaactttctctgagtatcctccccttggtcgttttgctgtgagggacatgcgtcagaccgtagctgttggagtcatcaagagtgttgagaagaaagaccccaccggagccaaggtcacaaaggctgccgccaagaagaagtgattgcattttggcaattttgctagcacatgtgatcatcaacgtggtttcaaaaaaacttgttcctttacagtagtttatctttgcagagtcttaggtgtttgttttaccagttatattttgaagtgtccgccgatttcatgtagccgtagccttcaaaactgggttcttgatcggcggtaacattttcgttgctgtttgtttttgatgagtactgttttttgttttgatggtaaaagtctgagattttcaaattcacaagcagccatagggttttagtccatttcctttgctgctgaggagggatgtcttaaatttgcatttaatttataaggaagttttgttaactgttttttatggtttattattccctttgaatttgaagcca

SEQ ID NO: 555 - DNA, 1732 bp, Saccharum officinarum
cctagctccattctgttctcaaaccccaagacgcagtcggccgccgcagaccgggagtagccgacgcgccgtcaccgtatcctcagatcagcggcgagccgtaaccaagccactctgctgacgcccgacgagcagtgtagcgtttcccttcagccatgggtaaggagaagactcacatcaacattgtggtcattggccatgtcgactctggcaagtcgaccaccactggccacctgatctacaagcttggtggtattgacaagcgtgtgatcgagaggttcgagaaagaggctgcggagatgaacaagcgttcattcaagtatgcgtgggtgcttgacaagctcaaggctgagcgtgagagaggtatcacaattgatatcgccctgtggaagtttgagaccaccaagtactactgtactgtcattgatgcccctggacaccgtgacttcatcaagaatatgatcactggtacttcccaggctgactgtgctgttcttatcattgactccaccactggtggttttgaggctggtatctccaaggatggtcagacccgtgagcatgctctccttgctttcacacttggagtgaagcagatgatttgctgctgcaacaagatggacgccaccacacccaagtactccaaggcccgttatgatgagattgtgaaggaagtctcttcctacctgaagaaggttgggtacaaccctgacaagatccactttgttcccatctctggattcgaaggtgacaacatgattgagaggtccactaaccttgactggtacaagggcccaaccctccttgaggctttggacttgatcaatgagccgaagaggccttcagacaagcccctgcggctcccccttcaggatgtgtacaagattggtggtattggaactgttcctgttgggcgtgttgagactggtgtcatcaagcccggtatggtggttaccttcggtcccagtggccttactactgaggttaagtctgttgagatgcaccatgaggctctccaggaggctcttcctggtgacaacgttggcttcaacgttaagaatgttgctgtgaaggatctgaagcgtgggtatgtggcctccaactccaaggatgaccctgccaaggaggctgctagcttcacctcccaggtcatcatcatgaaccaccctgggcagatcggcaacggctacgccccagtgctggactgccacacctcacacattgctgtcaagtttgctgagctcgttaccaagattgataggcggtctggcaaggagcttgagaaggagcccaaattcctcaagaacggtgatgctggtatggtgaagatggttcccactaagcccatggtggtggagaccttctctgaatatcctcctcttggtcgctttgctgtgcgggacatgaggcaaacggtggctgtcggagtcatcaagagtgtggagaagaaggacccaactggagccaaggtgaccaaggctgccgccaagaagaaatgaggtgtctggctggttctgtgtttgcttggggatacctagtgggagcttaaaatatctcgtcttgttcacgttattgctgttatttgcgtgagcaactaaactgtgctggcaatgtttgtctggtcgatttagtactcttattttcgttggttaaaaccaggttgctattaagactcgtttctgttattttatatcgaacatcgggtgtgagccatgcatggttatgagttttg

SEQ ID NO: 556 - DNA, 1631 bp, Saccharum officinarum
aatccagaaccaccaggtagccgtcaccttgcggttctgcgcctccagtccagctcttgctaagtttaagcttcaccaccagccatgggtaaggagaagtcccacatcaacattgtggttattggccacgttgactctggcaagtcgaccaccaccggccacctgatctacaagcttggaggcattgacaagcgtgtgatcgagaggttcgagaaggaggccgctgaaatgaacaagcggtccttcaagtacgcgtgggtgcttgacaagctcaaggctgagcgtgagagaggtatcaccattgatatcgctctgtggaagttcgagaccaccaagtactactgcactgtcattgatgcccctggacaccgtgacttcatcaagaacatgatcactggtacctcccaggctgactgtgctgtccttatcattgactccaccactggtggttttgaggctggtatctccaaggatggccagacccgtgagcatgctctccttgctttcacccttggagtgaagcagatgatttgctgctgcaacaagatggatgcgaccactcccaagtactctaaggcccgttatgatgagattgtgaaggaagtctcatcctacctcaagaaggttggatacaaccctgacaagattgctttcgtcccaatctctggttttgagggtgacaacatgattgagaggtccaccaaccttgactggtacaagggcccaaccctgcttgaggctcttgaccagatcaccgagcccaagaggccttcggacaagcccctgcgtctgccccttcaggatgtgtataagattggtggtattggaactgtcccggttggtcgtgtggagactggtgtcatcaagcctgggatggttgtcacctttggtccaactggcctgaccactgaggtgaagtctgttgagatgcaccacgaggctctccaggaggcccttcctggtgacaatgttggcttcaacgtgaagaacgtcgctgtgaaggatctgaagcgtgggtatgtggcctccaactccaaggatgaccctgccaaggaggctgccagcttcacctcccaggtcatcatcatgaaccaccctgggcagatcggcaacggctatgccccagtgctggactgccacacctcccacattgctgtcaagtttgctgagctcattaccaagatcgacaggcggtctggcaaggagcttgagaaggagcccaagttcctgaagaacggtgacgccggtatggtgaagatgattcccaccaagcccatggtggtggaaaccttctctgagtatcctcctctgggtcgttttgctgtccgtgacatgaggcagacggttgctgttggagtcatcaagagcgtggagaagaaggatcctacgggtgccaaggtgaccaaggctgctgccaagaagaaatgatgcccctgccactttgtggtcaaccctgtgtcttcttttgggatacctagatgctttattaccatggcttaaattttgtcaatggccgttgctgtgatcgtgtgaactgttaaggtcttacagcaatgcgccttttggttgtggttcttgtcctgtttcattatgtcttcagcaaaacttgaatgctcttcgactgatttgag

SEQ ID NO: 557 - DNA, 2022 bp, Glycine max
cagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaagtttaagtaatcatgggtaaggaaaaggttcacatcaacattgtcgtcattggacatgtcgactctgggaagtcaactaccactggtcacttgatctacaagcttggaggtattgacaagcgtgtgattgagaggttcgagaaggaggctgccgagatgaacaagaggtcattcaagtatgcctgggtgctcgacaagctcaaagctgagcgtgaaagaggaattaccattgatattgctttgtggaagtttgaaaccaccaagtactactgcacggtcattgatgctcctggacatcgtgactttatcaagaacatgattactggtacctcccaggccgactgtgctgtccttattattgactccaccactggtggttttgaagctggtatttctaaggatggacagacccgtgagcatgctcttcttgctttcaccctaggtgtgaagcagatgatctgttgctgtaacaagatggatgccactacccccaagtactctaaggctaggtatgatgaaatcgtgaaggaagtctcttcttacttgaagaaggttggttacaacccagacaagattccctttgttcccatctctggttttgagggtgacaacatgattgagaggtccaccaaccttgactggtacaagggaccaactctccttgaggctcttgaccaaatcaatgagcccaagaggccctccgacaagcctctaaggcttccattgcaggatgtctacaagattggtggtattggtactgtgccagtgggacgtgtagagactggggttgtgaagcctggtatggtggtgacttttggtcccactgggctgacaactgaggttaagtctgttgagatgcaccatgaggctctcacagaggctcttccaggtgacaatgttggatttaatgtgaagaatgttgcagtcaaggatctcaagcgtggttttgttgcatccaactccaaggacgaccctgccaaggaagctgccaacttcacatcccaagtcattatcatgaaccatcctggccagattggtaatggatacgcaccagtccttgactgccacacttctcacattgctgtgaagttttctgaaatcttgaccaagattgacaggcgatctggtaaggagcttgagaaggagcccaaatttttgaagaatggtgatgctggtatggttaagatggttccaaccaagcccatggtggttgaaactttctctgagtatcctccccttggtcgttttgctgtgagggacatgcgtcagaccgtagctgttggagtcatcaagagtgttgagaagaaagaccccaccggagccaaggtcacaaaggctgccgccaagaagaagtgattgcattttggcaattttgctagcacatgtgatcatcaacgtggtttcaaaaaaacttgttcctttacagtagtttatctttgcagagtcttaggtgtttgttttaccagttatattttgaagtgtccgccgatttcatgtagccgtagccttcaaaactgggttcttgatcggcggtaacattttcgttgctgtttgtttttgatgagtactgttttttgttttgatggtaaaagtctgagattttcaaattcacaagcagccatagggttttagtccatttcctttgctgctgaggagggatgtcttaaatttgcatttaatttataaggaagttttgttaactgttttttatggtttattattccctttgaatttgaagccatgtgagtgtgtgaggtgtgcgcctgatctgggatttttatttgagctctaaataatgcgatcgtagattcgtagtttcactaattactaaagaacatttgttgcttg

SEQ ID NO: 558 - DNA, 2362 bp, Panicum virgatum
tcccccgttccccagacgcagccgccacaaacccggagagagccagagctgcgacgcgccgtcccctgcgcctcctcctcccggcgcagcctcctccccttgctcaggtgccgtttcttcttgccccctcctcgcttgatctgtgctacccgatgctgtcgcgaacgggatcgatcttgtcttgagtcggctcctcgcgtctgtggcgatttggcggtctggtagtgactgggttgttggtaccagcgtctccaattccctagggtttgtgggttttgcgtgctctaatgattccaggattagattcttatggttggattcatctggatccggatagttacatcggtagtgtaggttgatttgttaatttatacctgtggatcggatgtctagggtttagggtacctctgattcctttatatttagcagcctgctcctgtgtatcctgctgcatagttgatgtttatgtagatgcaccgtccttgtttgatctagtttccgatctgatttgtgaaactgtattgttactgcctttaattttttatatattccttgatttcaaattcggtgcagatacttgctcgtttgctctgtttagtatttctaacaactgattcatctgatgcatctgtttaatcttcacctgcagccatgggtaaggagaagacccacatcaacatcgtggtcattggccatgtcgactctggcaagtcaaccaccaccggccacctgatctacaagcttggaggtatcgacaagcgtgtgatcgagaggttcgagaaggaggccgctgagatgaacaagaggtccttcaagtatgcgtgggtgcttgacaagctcaaggctgagcgtgagagaggtatcaccattgatattgccctgtggaagtttgagaccaccaagtactactgcacggtcattgatgcccctggacaccgtgacttcatcaagaacatgatcacgggtacctcccaggctgactgtgctgtccttatcattgattccaccaccggtggttttgaggctggtatctccaaggatggacagacccgtgagcatgctctccttgctttcactcttggagtcaagcagatgatctgctgctgcaacaagatggatgccaccactcccaagtactcgaaggcccgttatgatgagatcgttaaggaagtctcctcctacctgaagaaggtgggctacaaccctgacaagattgcattcgtccccatctctggttttgagggtgacaacatgattgagaggtccaccaaccttgactggtacaagggccccaccctgcttgaggctcttgaccagatcaacgagcccaagagaccttcggacaagcccctgcgtctcccccttcaggatgtgtacaagattggtggtattggaactgtccctgttggccgtgtcgagaccggcatcatcaagcctggtatggttgttacctttggtcccagcggccttactactgaggtgaagtctgttgaaatgcaccacgaggctctccaggaggcccttcctggtgacaatgttggcttcaatgtgaagaatgttgctgtgaaggatctgaagcgtgggtatgtggcctccaactccaaggatgaccctgccaaggaggctgcaagcttcacctcccaggtcatcatcatgaaccaccctgggcagatcggcaatggctatgccccagtgctggactgccacacctcccacattgctgtcaagttcgctgagctcattaccaagatcgacaggcgatctggcaaggagcttgagaaggagcccaagttcctcaagaacggtgatgctggtatggtcaagatggttcccaccaagcctatggtggtggagaccttctctgagtaccctcctcttggtcgctttgctgtccgtgacatgaggcaaacggtcgctgtgggagtcatcaagagtgtggagaagaaggacccgaccggcgccaaggtgaccaaggctgctgccaagaagaaatgatgtgcctggtgttttatcctgcgtctgcttttgcgatacctagatacctttccgttatctcataagttttgtctgcggttgttgctgttgtcgtgtgaacttttagtgtctgccggcggtgtgccatttgtatgtttaggtactttttttttcagcctcgcgaaacttgaatgctctaagacctatggtgtgcccttgtgggcgtcgttaaacgtatttctcaggagtcatctcgttatatgtatgcattttcttttctttttattatggtttgctcttctgatttgcatttgggttgtggccttggtttctgtagccttcctggaaccttttcttactagtgtttgccctcttgttttgatttgtg

SEQ ID NO: 559 - DNA, 1933 bp, Malus domestica
ttataaccgttagatcaaataccaaacatccaacggctcagaaagaaaccctaacgaaactgatgcagcactcgctcccctttaaatccccgaggtcctcactgccatcttcctctactcgatctcgctcctgattacaaagtctgcggcgagagagaacccccttccatctttcactcctcgattacttgagataacttgctgagatcccatcatgggtaaggaaaagtttcacatcaacattgtggtcattggccatgtcgactctgggaagtcaaccaccactggtcacttgatctacaagcttggaggtattgacaagcgtgtcattgagaggtttgagaaggaggctgctgagatgaacaagaggtcattcaagtatgcttgggtgttggacaagctcaaggctgagcgtgagcgtggtattaccattgatattgccttgtggaagtttgagaccaccaagtactactgcactgttattgatgctcccggacatcgtgatttcatcaagaacatgatcactggtacctcccaggctgattgtgctgtcctcattattgattccaccactggtggttttgaggccggtatttccaaggatggtcagacccgtgagcatgctctgcttgcattcactcttggtgtcaagcagatgatttgctgctgcaacaagatggatgccactactcccaagtactcgaaggcaaggtacgatgaaatcgtgaaggaagtctcatcctacctcaagaaggttgggtacaaccctgacaaaattgcctttgtccccatttctggatttgagggtgacaacatgattgagaggtccaccaacctagactggtacaagggaccaacccttcttgaggcccttgacctgatcaatgagcccaagaggccctcagacaagcccctccgtctcccacttcaggatgtgtacaagattggtggcattggaactgtgcctgtgggacgagttgaaactggtgttgtgaagcctggtatggttgtgaccttcggtcccactggtctgaccactgaagttaagtctgttgagatgcaccatgaagctcttcaggaggctcttcccggtgacaatgtcgggttcaatgttaagaatgttgctgtcaaggatctgaagcgtggttttgttgcttccaactccaaggatgatcctgcaaaggaggctgccaactttacctctcaggtcatcatcatgaaccaccctgggcagattggaaatggttatgctccagtgctcgattgccacacctcccacattgctgtcaagtttgctgagatcttgaccaagattgacaggcgatccggtaaggagcttgagaaggagcccaaattcttgaagaacggagatgctggtatggttaagatgattcccaccaagcccatggttgtcgagaccttctctgagtacccccctctcggacgttttgctgtgagagacatgcgccagaccgttgctgtgggtgtgatcaagagtgtggagaagaaggagccaactggtgccaaggtgaccaaggccgcagccaagaagaagtgaagtgttttatgttatcgtccgcccttagctagatcagttttgtctgatgtcgtttattttccatttttgtgccactctcggagttacttggacaggttttacaagttttacatcgtagccctcttgccttgcttgcaaggattgtggaggagctgagcggctagaagcgattctggttgctcggcaagctgtgttgtattctatttgttggtttatacattgaaatcggtcgtttagtgggtcattggacaactttatattaatgtccgcaatctgtgttaaatctgcttgtgttaaaattgtcttcttggcttttgcttttatgttttctttttagatctgaatttcgggcgtgccgagtttttatgtggtgaa

SEQ ID NO: 560 - DNA, 1733 bp, Malus domestica
tctcgctcctgagtctgaagtcggccgcgagatcttcttacgctcctccattttcttgagataatttgctgaaattccatcatgggtaaggaaaaatttcacatcaacattgtggtcattggacatgtcgactctgggaagtcgaccaccactggtcacttgatctacaagcttggaggaattgacaagcgtgtcatcgagaggttcgagaaggaagctgccgagatgaacaagaggtcattcaagtatgcctgggtgttggacaagctcaaggctgagcgtgagcgtggtattaccattgatattgccttgtggaagtttgagaccaccaagtactactgcactgttattgatgctcccggacatcgtgatttcattaagaacatgattactggtacctcccaggctgattgtgctgtcctcattattgactccaccactggtggttttgaagccggtatttccaaggatggtcagactcgtgagcatgctttgcttgctttcactcttggtgtcaagcagatgatttgctgctgcaacaaaatggatgccaccactcccaagtactcaaaagcaaggtatgatgaaattgttaaggaagtttcatcctacctcaagaaggttgggtacaaccccgacaaaattgcctttgtccccatttccggatttgagggtgacaacatgattgagaggtccaccaaccttgactggtacaagggaccaacccttcttgaggcccttgacctgatcaatgagcctaagaggccctcagacaagcccctccgtctcccacttcaggacgtgtacaagattggtggcattggaactgtgcctgtgggacgagttgaaactggtgttgttaagcctggtatggttgtgacctttggtcccactggtctgaccactgaagttaagtctgttgagatgcaccatgaagctctccaggaggctctcccaggtgacaatgttgggttcaatgtgaagaacgttgctgtcaaggatctcaagcgtggttttgttgcttccaactccaaggatgatcctgcaaaggaggctgccaactttacctctcaagtcatcatcatgaaccaccctggccagattggaaatggttatgctccagttctcgattgccacacctcccacattgccgtcaagtttgctgagatcttgaccaagattgacaggcgatctggtaaggagcttgagaaggaaccgaagttcttgaagaatggagacgctggtatggttaagatgattcccaccaagcccatggtcgtcgagaccttctctgagtacccaccgcttggtcgctttgctgtgagagacatgcgtcagacggttgccgtcggtgtgatcaagagtgtggagaagaaggagccaaccggtgccaaggtgaccaaggctgcagccaagaagaaatgaagtgtgttgtgttatcatccggccttaactggattagttttgtcgaatgtcgcttattttccatttttgcgctactctcgtagtttatttggacagttttatgagttttacatcgtagccctctaactttgcttgcaaggattgttggaggagctgagcggcaagaatcgattcgggttgctcggcaagctgtgttgtatgctatttgttatggtttttggttgctttatacattgagatgagtcgtgtagttggttattggacaatttcgtattaatgtctgcaacttctgcgctttgtctctttaa

SEQ ID NO: 561 - DNA, 1840 bp, Musa acuminata
tggtaatcgtgtcctccataagtatagatcgctggggctcctctcccctcctcccaccgcgacggacgtggttgtagccgccgccgatctctctctctgccggacttctcttctctgatctctttggaaattagaaatgggaaaggagaaggttcacattaacatcgtggttattggccatgtcgactctggaaaatcaaccacaactggacatttgatttacaaacttggagggattgataagcgtgttattgagaggtttgagaaggaagctgctgagatgaacaagaggtcattcaagtatgcctgggttcttgacaagttaaaggctgagcgtgagcgtggtatcactattgatattgccctttggaagtttgagactacaaagtactactgcaccgtcattgatgctcctggacatcgtgatttcatcaagaacatgattactggaacttctcaggctgattgtgctgtccttattattgattctacaactggtggtttcgaagctggaatttccaaggatggacagactcgtgaacatgcacttctagctttcactcttggtgttaaacagatgatttgttgctgcaacaagatggatgccactacacctaaatactcaaaggcacggtatgatgaaatcatcaaggaggtctcatcttatctcaagaaggttggttacaatcctgacaagatcccattcgtgccaatttctggtttcgaaggtgataatatgattgagagatccaccaatcttgactggtacaaaggcccaactcttttggatgctcttgacatgatccaagagcccaaacgtccgtccgacaagcctctccggctccctctgcaggatgtctacaagattggagggattggaaccgtgcctgtaggtcgtgttgagactggaaccttaaagcctggtatggttgttacctttggtcctacaggccttactactgaagttaagtctgtggaaatgcaccatgaggctctccaggaggctcttcctggtgacaatgttggtttcaatgtcaagaacgttgctgtgaaggacctcaagcgtggttttgttgcctcaaactccaaggacgacccggcaaaggaggctgccaacttcacctcgcaagttatcatcatgaaccatccaggtcaaattgggaacggttatgctcctgtcctcgattgtcacacctcccacattgctgtcaagtttgcagagcttgtgactaagattgacaggcgatccggcaaggagctggagaaggaacccaagttcctcaagaatggagatgcaggtttcgtgaagatggttcctacaaagccaatggttgtcgagactttttctacctacccacctctgggtaggtttgctgtcagagacatgagacagacagttgctgttggtgtcatcaagagtgtggagaagaaggatcctactggagccaaggttaccaaagctgctcaaaagaagaaatgaaccgaggagaattctgcattggtcttgtttggtgtcagcaacaattttaatatgcatccttcttgtcagctttacgagtctataggtttggtatctggtgcgtcgatgcagaactgggtgctcgataggcggtggcagtgttgcatttaaggtgcctgttctagcaagtttttttttccttttttgagcggtctctctctatattttaaactggtacttgaagcgaatttgagttgtttggattcgacaatagtgggtctagtttgattctggtatttgactttataaatcagtacttggatttattatatttgttcatcgaatcttgataattgctctatgaagtttgtttctttatct

SEQ ID NO: 562 - DNA, 1843 bp, Citrus clementina
aaccgtcagatctgcctttccgatccaacggctgagagaaaaaccctagacgcaaagcccaagtctctctataaaatcacagcaccctctcacgcagaaaccctcttttacaatacactctctcaatttccgaagggcggcgagagagaaccattttcgcgaatatcattttaataaggttttttctagatttgcctaatgggtaaggagaagactcacatcaacattgtggtcatcggccatgtcgactctggaaagtcgaccaccaccggacacttgatctacaagcttggtggtattgacaagcgtgtgatcgagaggttcgagaaggaagctgctgagatgaacaagaggtcattcaaatacgcctgggtgctcgacaagctcaaggctgagcgtgaacgtggtattaccattgatattgccttgtggaagttcgagaccaccaagtactactgcaccgtcattgatgctcccggacatcgtgactttatcaagaacatgattaccggtacctcacaggctgactgtgccgtcctcatcattgactccaccaccggtggttttgaagctggtatctccaaggatggtcagactcgtgagcatgctttgcttgctttcacccttggtgtgaagcagatgatttgctgctgtaacaagatggacgccaccacccccaagtattcaaaggctaggtacgatgaaattgtgaaggaggtctcttcctacctgaagaaggttggatacaaccccgagaaagtcccattcgtgcccatctctggtttcgagggtgacaacatgattgagaggtctaccaaccttgactggtacaagggtccaaccctgctggacgctcttgacaatatcaatgagccgaagaggccctcagacaagccccttcgtctgccactccaggacgtgtacaagattggtggcattggaaccgtcccagtgggtcgcgttgagaccggtgtcctcaagcctggtatggtggtgacatttggcccctctggattgacaactgaggttaagtctgttgagatgcaccacgaagctctgcaggaggcccttccgggtgacaatgttggcttcaacgtgaagaacgttgctgtcaaggatctcaagcgtggttttgttgcttccaactcgaaggatgatccggccagggaagctgccaacttcacctcacaggtcatcatcatgaaccaccctggccagattggaaatggatatgccccagtgcttgactgccacacctcccacattgccgtcaagttttctgagctcgtgacgaagattgataggcgatcaggcaaggagcttgagaaggagcccaagttcttgaagaatggagatgctggaatggttaagatgattcccaccaagcccatggttgttgagaccttctccgattacccaccccttggtcgttttgctgttagggacatgcgtcagactgttgctgtgggtgttatcaagagtgttgagaagaaggatcccacaggtgcgaaggtcaccaagtccgcagccaagaagaaatgagaaatttttatgggtctgtctacaatagttagggtttattttctgtctttttttattttcttgtctgtttttgttttgcatcaatgtttctgcaaacagccctatttggttccaccagtttgctgttgagcaattgggatgttatctttctgcttaactggctgtggtgggggttcggatttttatattctgaatttggttaatagcattaaattgagttgtgaagtttatagaccagctgctggatgtcaaagttggtggttttaatacatttggaagctcattttaagctctttgatta

SEQ ID NO: 563 - DNA, 1895 bp, Citrus clementina
cactctttgccctccctcttttcttgcttgctctgcggctaggtttcaattgtctcttcgaagtttcagttaatttaacagccatgggtaaggagaagactcacatcaacattgtggtgattggccatgtcgactctggaaagtcgaccaccaccggacacttgatctacaagcttggtggtattgacaagcgtgtgatcgagaggttcgagaaggaagctgctgagatgaacaagaggtcattcaagtacgcctgggtgctcgacaagctcaaggctgagcgtgaacgtggtattaccattgatattgccttgtggaagttcgagaccaccaagtactactgcaccgtcattgatgctcccggacatcgtgactttatcaagaacatgattaccggtacctcacaggctgactgtgccgtccttatcattgactccaccaccggtggttttgaagctggtatctccaaggatggtcagactcgtgagcatgctttgcttgctttcacccttggtgtgaagcagatgatttgctgctgtaacaagatggacgccaccacccccaagtactcaaaggctaggtacgatgaaattgtgaaggaggtctcttcctacctgaagaaggttggatacaaccccgagaaagtcccattcgtgcccatctctggtttcgagggtgacaacatgattgagaggtctaccaaccttgactggtacaagggtccaaccctgctggacgctcttgacaatatcaatgagccaaagaggccctcagacaagccccttcgtctgccactccaggacgtgtacaagattggtggcattggaaccgtcccagtgggtcgcgttgagaccggtgtcctcaagcctggtatggtggtgacatttggcccctctggattgacaactgaggttaagtctgttgagatgcaccacgaagctctgcaggaggcccttccgggtgacaatgttggcttcaacgtgaagaacgttgctgtcaaggatctcaagcgtggttttgttgcttccaactcgaaggatgatccggccagggaagctgccaacttcacctcacaggtcatcatcatgaaccaccctggccagattggaaatggatatgccccagtgcttgactgccacacctcccacattgccgtcaagttttctgagctcgtgacgaagattgataggcgatcaggcaaggagcttgagaaggagcccaagttcttgaagaatggagatgctggaatggttaagatgattcccaccaagcccatggttgttgaaaccttctctgactacccacctcttggtcgttttgccgttagggacatgcgtcagactgttgctgttggtgtgattaagaatgttgaaaagaaggatccaacaggtgccaaggtcaccaagtctgcagccaagaagaagtgaatcgggttggttaatgttgctttatccgcagatggagtctattttaataattgtagttatacaaacttggttatttttggtactgttatagttcgatgcatgctttcctttttaggttttagtttgttgcctttggtgtcgggtaccgattcccagaattgggtgcttgacaggcggtggcgcagctctaacctggagtctcaattttattaatagttatggtctttgtttgtattgatacttgaggtggttcggtttcatctgaatcggctcagaagttttgtcattgtgttgtttctgcggaattgatatctacttttcgtttttctattctagttactgtgctctctacttagctgtggtctattctttacatgcatattaatattcggtttaattttttcatgcatgtgattcacttgtgcctatgttagtctatattataataattctgaattgcttgtttca

SEQ ID NO: 564 - DNA, 1745 bp, Gossypium hirsutum
ttttattgttccttccttcgccgtctactgcacttgtgacatcgatttcaagtgaatcagaatgggtaaggaaaagagtcacattaacattgtggtcattggccacgtcgattccggaaaatcgaccaccactggccacctgatctacaagcttggtggtattgacaagcgtgtgattgaaaggtttgagaaagaagctgcggagatgaacaagaggtcattcaagtatgcttgggtgcttgacaagctcaaggctgaacgtgagcgtggtatcaccattgatattgccttgtggaaatttgagaccaccaaatactactgcactgtgattgatgcgcctggacaccgtgactttatcaagaacatgattactggtacctcgcaggctgactgtgctgttttgattattgattccaccactggtggttttgaggctggtatctccaaggatggtcagactcgtgagcatgctttgcttgcttttacccttggtgtcaagcaaatgatttgctgttgcaacaagatggatgccactacccctaaatactcgaaggctaggtatgatgaaatcgtgaaggaagtctcttcctacttgaagaaggttggatacaaccctgacaagattccatttgttcccatttctggttttgagggtgataacatgattgagaggtctaccaacttggactggtacaagggccctacacttcttgaggctcttgaccagatcaatgagcccaagaggccttcagacaagcctctccgtctaccacttcaggatgtgtacaagattggtggtattggaactgtcccggttggtcgtgttgaaactggtgtcttgaagcctggtatggttgtgacctttggtcctaccggtctgaccactgaagttaagtctgttgagatgcaccatgaagctcttacagaggcacttcctggtgataatgttgggttcaatgttaagaatgttgctgttaaggatctcaagcgtggttatgttgcatccaactccaaggatgatcctgctaaggaggctgcaaacttcacttctcaggtcatcatcatgaaccatcctggacaaattggaaacggatatgccccagtcctcgactgccacacctcacacattgctgttaagtttgctgaacttttgaccaagattgacaggcgatctggtaaggagcttgagaaggaacccaagttcttgaagaatggtgatgctggtatgattaagatgattcccaccaagcccatggttgtggagaccttttctgagtacccacccttgggccgttttgctgtgagggacatgcgtcagaccgtggcagttggtgttataaagaatgttgagaagaaggacccatccggtgccaaggtcaccaagtctgctgctaagaagaagtgaaccgtgctggttaaatctaatgaagtttccgcagatggagtattttattatcataataatagtttgatagactttatcatttatgatatagttggtcttttgcttggttttgcatgttatagtgtgttgccattgttgtctggtaactgttctcagtattgggtgcttgacagacggtggcatatctatgggtggtctctagcgttacctggttttgtttaatttactactgtatcttgtcattgtcaagaggtgcccccttggttttccaaggtggcttgaaacttttgtttatgattttcgttgaagttgcggaattatttattatgaaatcatgctg

SEQ ID NO: 565 - DNA, 1744 bp, Vigna unguiculata
gcggctagggttttagcgcagcttcttctagatactcaaaggcagttatgggtaaggaaaaggttcacatcagtattgtggtcattggtcatgtcgactctgggaagtcgactaccactggtcatctaatctacaagcttggaggaattgacaagcgtgtgattgagagattcgagaaggaagctgctgagatgaacaagaggtcattcaagtatgcctgggtgcttgacaagcttaaggctgagcgtgaaagaggaatcacaattgatattgccttgtggaagtttgaaaccaccaagtactactgcacagtcattgatgctcctggacacagggatttcattaagaatatgattacagggacatcccaagctgactgtgctgtgctgatcattgattccaccactggtggttttgaagctggaatttccaaggatgggcaaactcgtgaacatgctcttctttccttcactctcggtgtgaagcagatgatctgttgctgtaacaagatggatgccaccactcccaagtactccaaggctaggtatgatgaaattgtgaaggaagtctcctcgtatttgaagaaagtgggatacaacccagacaagattccttttgttccaatctctggttttgagggagacaacatgattgagaggtccacaaacctcgactggtacaagggacctaccctgcttgaggctcttgaccaaatcactgagcccaagaggccatctgacaagcccctcaggcttcctcttcaggatgtctacaagattggaggtattggaactgtgcctgtgggacgtgttgagactggtgtcatcaagcctggaatggtggtgacttttgcaccaactggattgacaactgaagttaaatctgttgagatgcaccatgaagctctcacagaagctctccctggtgacaatgtggggttcaatgtgaagaatgttgctgttaaggatctcaagcgtggttatgttgcttcaaactccaaggatgatcctgctaaggaggctgctaacttcacctcccaggttatcatcatgaaccaccctggtcagattggaaatggctatgctcctgttctggattgccacacctcccacattgctgtcaagtttgctgaacttatgaccaagattgacaggcgttctggtaaggagctcgagaaggagcctaagttcttgaagaatggtgatgctggtttcgtgaagatgattccaaccaagccaatggtggtggagaccttctctgagtacccacctcttggacgttttgctgtgagggatatgcgtcagactgttgctgtgggagtcatcaagaacgttgagaagaaagaccctactggagccaaggtcaccaaggccgcccagaagaagaagtgaatcgtgctgggtggtggttcatcaggggatggttacaataaatgctggtttcttgcttgtactcttgtgtcatcgctaggtagattgtttttcgtacttagtttgaagtttccaccatcatctcccaacttttgttcccagaattgggttcttgatcgacggtggcggctcttttattattattattatgtgtttttatgtgtttttgtgtttttgtgagaacccctgattacatttttgtaagcgcagcaagttttaccgctttgctgcgttgtttgtttgcattttaaatatcagactttttatatttgtgttttaaatccttgctttgaattttatttatagtctgttaa

SEQ ID NO: 566 - DNA, 1805 bp, Vigna unguiculata
ctctattgtttgcctttcttctcttgcggctagggttttagcgcagcttcttctagatactcaaaggcagttatgggtaaggaaaaggttcacatcagtattgtggtcattggtcatgtcgactctgggaagtcgactaccactggtcatctaatctacaagcttggaggaattgacaagcgtgtgattgagagattcgagaaggaagctgctgagatgaacaagaggtcattcaagtatgcctgggtgcttgacaagcttaaggctgagcgtgaaagaggaatcacaattgatattgccttgtggaagtttgaaaccaccaagtactactgcacagtcattgatgctcctggacacagggatttcattaagaatatgattacagggacatcccaagctgactgtgctgtgctgatcattgattccaccactggtggttttgaagctggaatttctaaggatgggcaaactcgtgaacatgctcttctttccttcactctcggtgtgaagcagatgatctgttgctgtaacaagatggatgccaccactcccaagtactccaaggctaggtatgatgaaattgtgaaggaagtctcctcgtatttgaagaaagtgggatacaacccagacaagattccttttgttccaatctctggttttgagggagacaacatgattgagaggtccacaaacctcgactggtacaagggacctaccctgcttgaggctcttgaccagatcactgagcccaagaggccatctgacaagcccctcaggcttcctcttcaggatgtctacaagattggaggtattggaactgtgcctgtgggacgtgttgagactggtgtcatcaagcctggaatggtggtgacttttgcaccaactggattgacaactgaagttaagtctgttgagatgcaccatgaagctctcacagaagctctccctggtgacaatgtggggttcaatgtgaagaatgttgctgttaaggatctcaagcgtggttatgttgcttcaaactccaaggatgatcctgctaaggaggctgctaacttcacctcccaggttatcatcatgaaccaccctggtcagattggaaatggctatgctcctgttctggattgccacacctcccacattgctgtcaagtttgctgaacttatgaccaagattgacaggcgttctggtaaggagctcgagaaggagcctaagttcttgaagaatggtgatgctggtttcgtgaagatgattccaaccaagccaatggtggtggagaccttctctgagtacccacctcttggacgttttgctgtgagggatatgcgtcagaccgttgctgtgggagtcatcaagaacgttgagaagaaagaccctactggagccaaggtcaccaaggccgcccagaagaagaagtgaatcgtgctgggtggtggttcatcaggggatggttacaataaatgctggtttcttgcttgtactcttgtgtcatcgctaggtagattgtttttcgtacttagtttgaagtttccaccatcatctcccaacttttgttcccagaattgggttcttgatcgacggtggcggctcttttattattattatgtgtttttatgtgtttttgtgtctttgtgagaacccctgattacatttttgtaagcgcagcaagttttaccgctttgctgcgttgtttgtttgcattttaaatatcagactttttatatttgtgttttaaatccttgctttgaattttatttatagtctgttaattgttattgcactttttatattttaaaaaaaaaaaaaaa

SEQ ID NO: 567 - DNA, 1447 bp, Setaria italica
agttaagctctacttgtagccatgggcaaggagaagtctcacattaacatcgtggtcattggccatgtcgactctggcaaatcgaccaccactggccacctgatctacaagcttggaggtattgacaagcgtgtgatcgagaggttcgagaaggaggccgcagaaatgaacaagaggtccttcaagtatgcgtgggtgcttgacaagctcaaggctgagcgtgagagaggtatcaccatcgacattgccctgtggaaattcgagaccaccaagtactactgcacggtcattgatgcccccggtcaccgtgacttcatcaagaacatgattaccggtacctcccaggctgactgtgctgtcctcatcattgactccaccactggtggttttgaggctggtatctccaaggatggccagacccgtgagcatgctctgcttgctttcactcttggagtgaagcagatgatctgctgctgcaacaagatggatgccaccacacccaagtactcgaaggcccgctatgatgagattgtgaaggaagtctcttcgtacctcaagaaggttggatacaaccctgacaagattcactttgttcccatctctggtttcgagggcgacaacatgattgagaggtccaccaacctggactggtacaagggcccaacactgcttgaggctcttgacttgatcaatgagccaaagaggccttcggacaagcccctgcgtctcccccttcaggatgtgtacaagattggtggtattggaactgtgcctgttggtcgtgtagagactggtgtcatcaagcctggtatgcttgtcacctttggtcccagcggcctgaccactgaggtgaagtctgttgagatgcaccatgaggcgctccaggaggcccttcccggtgacaatgttggcttcaacgtgaagaacgttgctgtgaaggatctcaagcgtgggtacgtggcctccaactccaaggatgaccctgccaaggaggctgccaacttcacctcccaggtcatcatcatgaaccaccctggccagatcggcaatggctacgccccagtgctggactgccacacctcacacattgctgtcaagtttgccgagcttgttaccaagattgacagacgatctggcaaggagctcgagaaggagcccaagttcctgaagaacggtgatgctggtatggtgaagatggttcccaccaagcccatggttgtggagacattctctgagtaccctcctcttggtcgctttgctgttcgtgacatgaggcagacggttgctgttggtgtcatcaagagcgtggagaagaaggaccccaccggtgccaaggttaccaaggctgctgccaagaagaaatgaggcgtttgatagtttgctccaattatccagtagtgttgatctaagtcttgaacgtggtatacctcttttgtgtctttgaagt

SEQ ID NO: 568 - DNA, 1696 bp, Setaria italica
cttcttcccctgcagccgccgcctctcgttcccctcttctcctcgaggttaagctctacttgtagccatgggcaaggagaagtctcacattaacatcgtggtcattggccatgtcgactctggcaaatcgaccaccactggccacctgatctacaagcttggaggtattgacaagcgtgtgatcgagaggttcgagaaggaggccgcagaaatgaacaagaggtccttcaagtatgcgtgggtgcttgacaagctcaaggctgagcgtgagagaggtatcaccatcgacattgccctgtggaaattcgagaccaccaagtactactgcacggtcattgatgcccccggtcaccgtgacttcatcaagaacatgattaccggtacctcccaggctgactgtgctgtcctcatcattgactccaccactggtggttttgaggctggtatctccaaggatggccagacccgtgagcatgctctgcttgctttcactcttggagtgaagcagatgatctgctgctgcaacaagatggatgccaccacacccaagtactcgaaggcccgctatgatgagattgtgaaggaagtctcttcgtacctcaagaaggttggatacaaccctgacaagattcactttgttcccatctctggtttcgagggcgacaacatgattgagaggtccaccaacctggactggtacaagggcccaacactgcttgaggctcttgacttgatcaatgagccaaagaggccttcggacaagcccctgcgtctcccccttcaggatgtgtacaagattggtggtattggaactgtgcctgttggtcgtgtagagactggtgtcatcaagcctggtatgcttgtcacctttggtcccagcggcctgaccactgaggtgaagtctgttgagatgcaccatgaggcgctccaggaggcccttcccggtgacaatgttggcttcaacgtgaagaacgttgctgtgaaggatctcaagcgtgggtacgtggcctccaactccaaggatgaccctgccaaggaggctgccaacttcacctcccaggtcatcatcatgaaccaccctggccagatcggcaatggctacgccccagtgctggactgccacacctcacacattgctgtcaagtttgccgagcttgttaccaagattgacagacgatctggcaaggagctcgagaaggagcccaagttcctgaagaacggtgatgctggtatggtgaagatggttcccaccaagcccatggttgtggagacattctctgagtaccctcctcttggtcgctttgctgttcgtgacatgaggcagacggttgctgttggtgtcatcaagagcgtggagaagaaggaccccaccggtgccaaggttaccaaggctgctgccaagaagaaatgagggggtttgagggtggtcatcttctgcttttcatctatcttagtagtgttagtgctgttaagttttgttaggccattgttcttacagggccttgcagttgctcacaactgtaatttcgccctgtccggtgtcgcttaaacgctactgttattttggttgtggtggaacatgggtatttttgcggctgattcatatcacctattagctgtgtagttccggaatgtgacaatgcgagtcccttcattgctagtttatacatgggtccaagttatgagatgctttctt

SEQ ID NO: 569 - DNA, 1759 bp, Carpinus betulus
tctctcgctattaacaaagaagacggcgagagagtctcttcagctatttcttatcttccttcttcgtctgccgcaggctttttagaagttcataatgggtaaagagaaggttcacatcaacattgtggtcattggccatgtcgactctggaaagtcgaccaccactgggcacttgatctacaagcttgggggtattgacaagcgtgtcattgagaggtttgagaaggaggctgctgagatgaacaagaggtcattcaagtatgcctgggtgttggacaagctcaaggctgagcgtgagcgtggtattaccattgatattgccttgtggaagttcgaaaccaccaagtactactgcactgtcattgatgctcccggacatcgtgactttattaagaacatgatcaccggtacctcacaggctgactgtgctgtcctcattattgactccacaaccggaggttttgaagctggtatttccaaggatggtcagacccgtgagcatgccttgcttgcctttactctcggtgtcaagcagatgatttgctgctgcaacaagatggatgccacaaccccaaaatactcgaaggcaaggtatgaggaaatcgttaaggaagtctcctcctatctgaagaaggttgggtacaaccctgacaaaatcccctttgtccccatctctggttttgagggtgacaacatgattgagaggtcaaccaacctggactggtacaagggccccaccctccttgaggctcttgacttgatctcggagcccaagaggcccacagacaagcccctacgtctccctctccaggatgtctacaagattggcggtattggaactgtccctgttggacgtgttgagactggtatcatcaagcctggtatggttgtgacctttgggcctactggactgacaactgaagtcaagtccgttgagatgcaccatgaagccctcctggaagcccttcccggtgacaacgttggcttcaacgtgaagaatgttgccgtcaaggatctgaagcgtggttttgttgcttccaactccaaggatgatcctgccaaggaggctgctaacttcacctcccaggtcatcatcatgaaccatcctggtcagattggtaacggttatgctccagtgctcgactgccacacctgccacattgcggtgaagtttgctgagatcgtgaccaagattgacaggcgatctggtaaggagctcgagaaggagcccaagtttttgaagaacggtgatgcagggttcgtgaagatgattcccacaaagcccatggttgttgagactttctctgattacccgccacttggtcgttttgccgtgagggacatgcgccagaccgttgctgttggtgtcattaagagtgttgagaagaaggaccctactggtgccaagcttaccaagtctgcagtaaagaagaagtgaagtgtgtttttcatatccatggtagttagacatgttttcccaatctttgctgttaatcattttcaattttgttttggtcgtacttgaagttttgaggacatttacataaagtttccatcacagccccaaagctgcggtggaagctttggtttccatttcatgtattttgttttatagcattgagatgatgagttgtgtagtgaacttattgtcgatgaacaacttcattttgatgtcaactacatggttttttagctgttaaatcagcatatctcctatcatatgcttttttttaaaactacttttatgttctagttaaac

SEQ ID NO: 570 - DNA, 1740 bp, Actinidia deliciosa
gcttgctctctacgccgtctcctctgcgagagagcatcaagcggatcaatcccgtctctctctctcttcaactgttcgtcgcttaattgctgtcccaatatgggtaaagagaaagttcacattaacattgtggtcattggccatgtcgactctgggaagtcaaccaccaccggtcacttgatctacaagcttggaggtattgacaaacgtgtgattgagaggttcgagaaggaggctgctgagatgaacaaacgttcattcaagtacgcctgggtcttggacaagctcaaggctgaacgtgaacgtggtattaccattgatattgcattgtggaagtttgagaccaccaaatactactgcacagtcattgatgctcctggccatcgcgactttatcaagaacatgatcacaggcacctcacaggctgactgtgcagttcttatcattgactccaccactggtgggtttgaagctggtatttccaaggatggtcagacacgtgagcatgctttgcttgccttcacccttggtgtcaggcaaatgatctgctgttgcaataagatggacgcaactaccccaaaatattcgaaggcaaggtatgatgaaattgttaaggaagtctcctcatatctcaagaaggtggggtacaaccctgataagattccttttgtcccaatctctgggttcgagggtgacaacatgattgagaggtcaaccaaccttgactggtacaagggcccaaccctgcttgacgcccttgacttgattagtgaacccaagaggccgtcggacaagcctcttcgtctcccacttcaggatgtctacaagattggtgggattggcactgtccctgtgggccgtgttgagactggtgttatcaaacctggcatggttgtcacttttggcccaactggtctcaccactgaagtcaagtccgtagaaatgcaccacgaggctctcttggaggcctcgccaggcgacaatgttgggtttaacgtgaagaatgttgccgtcaaagatctcaagcgtgggtttgttgcctcaaattccaaggatgatcctgcaaaggaagctgccaacttcacttcccaggttattatcatgaaccatccaggtcaaattggaaatgggtatgccccggttttggattgccacacctcccacatcgcagttaagtttgctgagcttttgaccaagattgataggaggtctggcaaagagctcgagaaggagcccaagttcttgaagaatggtgactctgggatggtgaagatgattcccaccaaacccatggtggtggagactttctcggagtacccaccgctcggtcgttttgctgtgagagacatgcgtcaaactgtggcggttggtgtcatcaagagcgtggagaagaaggatccgaccggtgccaaggtcaccaaggctgctctgaagaagaagtgaggccttcaattaaaggttttggtattaagaacagtagagtttaagtgtcctaggttggtaagttttgtctcagactcttgtggtggaccctgttgctgttcactagcctcacttgtggggatggtggtggtgttgagcattcaggtgcggatctgggtgcttgacagtcggtaacaactgggtttttattggttttctattctctgccatttattttccttttttttaatatatgttttgaacaatgcccttttgctggtatggaacttgcagtctattgaatttgaaaaaaaaaaa

SEQ ID NO: 571 - DNA, 1752 bp, Zea mays
tggctgagtttatgggtcctgggcctccattcggtagtcaattttattgggctggtccggcctacaccgacgcccttatataaatcccgaaccctagaaggcagcaccttcctccccaacacgccgccgtcttctgcggttctgccgtttactcctccactttggcctcctcacttgcaagtttaatcttcgcctccagccatgggtaaggagaagtctcacatcaacattgtggttattggccacgtcgactctggcaagtcgacaaccaccggccacctgatctacaagcttggaggcattgacaagcgtgtgatcgagaggtttgagaaggaggccgctgaaatgaacaagcggtcctttaagtatgcttgggtgcttgacaagctcaaggctgagcgtgagaggggtatcaccattgatattgctctgtggaagtttgagaccaccaagtactattgcaccgttattgatgcccctggacaccgtgactttatcaagaacatgatcactggtacctcccaggctgactgtgctgtccttatcattgactccaccactggtggttttgaggctggtatctccaaggatggccagacacgtgagcatgctctccttgcgttcacacttggagtgaagcagatgatttgctgctgcaacaagatggatgcaaccactcccaaatactccaaggcacgttatgatgagattgtgaaggaagtctcatcttacctcaagaaagttgggtacaaccctgataagatagcatttgttcccatctctggttttgagggtgacaacatgattgagaggtccaccaaccttgactggtacaaaggcccaaccctgcttgaggctcttgaccagatcaccgagcccaagagaccctcggacaagcccctgcgtctccccctccaggatgtgtacaagattggtggtattggaactgtgccagttggtcgtgtggagactggtgtcatcaagcctggtatggttgtcacctttggtccaactggcctgactactgaggtgaagtctgttgagatgcaccatgaggctcttcaggaggcccttcctggtgacaatgttggcttcaacgtgaagaacgtcgctgtgaaggatatcaagcgtggttatgtggcctccaactccaaggatgaccctgccaaggaggctgccagcttcacctcccaggtcatcatcatgaaccaccctgggcagatcggtaacggttatgccccagtgctggactgccacacctcccatattgctgtcaagtttgctgagctcattaccaagatcgacaggcgttctggcaaggagcttgagaaagagcccaagttcttgaagaacggtgatgctggtatggtgaagatgattcccaccaagcccatggtggtggagacattctcgcagtatcctcccctgggtaggtttgctgtccgtgacatgagacagacggttgctgttggagtcatcaagagtgtggagaagaaggacccgaccggtgccaaggtgaccaaggctgctgccaagaagaaatgatgcgacctgtcgttgatgcagcgtctgcttttccaatacgtagctgagatgttccattttgacataagttttgtatgctgtggttgctgcttgtttaccttgtgaactgttgagctctactattgggtgtccgtttatctgtttatgtagcatcttgttatttcacctattgcaatacaagaatgctatatgacatatatgttagac

SEQ ID NO: 572 - DNA, 1698 bp, Cucumis melo
gctgcttgctcctgcgttaaatttaggctgcttctttcttttgatttctctgcaaattcttgtggttcgattaataccaaatgggtaaggaaaagactcatatcaacatcgtggttattggccatgtcgactctgggaagtcgaccaccactggtcatcttatctacaagcttggaggaattgacaagcgtgtgattgagagattcgagaaggaagccgctgagatgaacaagaggtcattcaagtatgcttgggtgctcgacaaacttaaggcggagcgtgaacgtggtattaccattgacattgccctgtggaagtttgagaccaccaagtactactgcacagtcatcgatgctcccggacatcgtgactttatcaagaacatgattactggaacctcacaggctgactgtgctgtcctcattattgactccaccactggtggttttgaggctggtatttctaaggatggtcagactcgtgagcatgctcttctcgctttcacccttggtgtcaagcaaatgatctgctgctgcaacaagatggatgccaccactcccaaatactccaaggcaaggtacgatgaaatcgtgaaggaagtctcatcttacctcaagaaggtcggatacaacccagacaaaatccccttcgttccaatctctggtttcgagggtgacaacatgattgagaggtccaccaaccttgactggtacaagggaccaacccttcttgaggctcttgacttgatctctgagcccaagaggccctcagacaagcccctccgtctcccacttcaggacgtttacaagattggtggtattggaactgtccctgttggacgtgttgaaactggtatcctcaagcctggtatggttgttacgttcggaccaactggactgaccactgaagttaagtctgttgaaatgcaccacgagtctctcccagaagctttgcccggtgacaatgttggattcaacgtcaagaacgttgctgtcaaggatctcaagcgtggttttgttgcctcgaactccaaggacgaccctgccaaggaagctgccaacttcacatctcaggttatcatcatgaaccaccccggtcagatcggtaatggttatgctccagtccttgattgccacacctcccacattgctgttaagttcgctgagatcctcaccaaaatcgatcgtcgatctggtaaggagcttgagaaggagcccaagttcttgaagaatggagatgccggtatggttaagatggttccaaccaagcccatggttgtggagaccttctcttcatacccaccattgggtcgttttgctgttcgtgatatgcgtcaaaccgttgctgttggtgttatcaagagtgtggagaagaaggacccaacaggagccaaggtcaccaagtccgccgtgaagaagaaataagtgatcaaagcctgcattttgtgtcattgagaaaacatggttttaatatgcaaaatatgagacttttggtttttggtactcttagtagttcttatttatttagtttacatgtctggttttgtgtttttctctttttaattttggtatgctgtttttgagtcattttgagacattaaattgttggatactgctgagggttaaatgtttttaatctaagttttaatttctcttcaaaaaaaactgagacacgcaacaggggataggcaaggcacac

SEQ ID NO: 573 - DNA, 1814 bp, Quercus alba
gtcgctctcatattctctctctcgcggctagggttttagcgcagctctctcttgttctctctctctcatcagtcgattcagaatgggtaaggaaaaggttcacattaacattgtggtcattggccatgtcgactctgggaagtcaaccaccactggtcacttgatctacaagcttggaggtattgacaagcgtgttattgagaggttcgagaaggaagctgctgagatgaacaagaggtcattcaagtacgcctgggtgcttgacaagctcaaggctgagcgtgagcgtggtatcaccattgatattgccttgtggaagttcgagaccaccaggtactactgcacggtcattgatgcccctggacatcgtgatttcatcaagaacatgattactggaacctcccaggctgattgtgccgtcctcattattgactccaccactggtggttttgaagctggcatttccaaggatggacagacccgtgagcatgctctccttgctttcaccctcggtgtcaagcaaatgatttgctgctgcaacaagatggatgccactacccccaagtactcaaaggctaggtacgatgaaatcgtgaaggaagtctcttcctacttgaagaaggttgggtacaaccctgacaagattccttttgtccccatctccggatttgagggtgacaatatgattgagaggtccaccaaccttgactggtacaagggtccaacccttcttgatgcacttgaccagatcaatgagccaaagaggccctcagacaagcccctccgtctcccacttcaggatgtttacaagattggaggcattggaactgtccctgtgggtcgtgttgagaccggtatcatcaagcctggtatggttgtgactttcggccccactggactgaccactgaagtaaagtctgttgaaatgcatcatgaggctctcctagaggctcttcctggtgacaatgttggcttcaacgttaagaatgttgctgtgaaggatctcaagcgtgggtttgttgcctccaactccaaggatgatcctgccaaggaggcagccaacttcacctcccaagttatcatcatgaaccaccctggccagattggaaatggttacgcccctgtcctcgattgccacacctcccacattgctgtcaaatttgctgagctcttgaccaagattgacaggcggtctggtaaggagcttgagaaggagcccaaattcttgaagaatggtgatgctggaatggttaagatgcttcccaccaagcccatggttgtggaaaccttttccgagtatcccccacttggtcgttttgccgtcagggacatgcgtcaaactgtggctgttggtgtcatcaagagtgtggagaagaaggatccatctggagccaaggtgaccaagtctgctgccaagaagaagtgaattgtgctgcacccagtttctgcaagtgctgggtatcgtagtccttacagtaaggactgggttcttgctattaatctatccatagaaggtctaagtgtttgttttgttggtaatagcttcaagtctctgccatcgtcatgtagcttcaattcccagaattgggtgcttgaccgacggtggcggggccatggagtatcctagtgttttttgtatttgcttaaggtgtcatgtgagacttatttattttcataagcagctatggagttttaggtctgttttcatgctgcccggattttttgctatttacatttatagttatctagtctgtgtgttttctaattgaacaattttaactttgtctgcatctctactgatatgttttttaagg

SEQ ID NO: 574 - DNA, 1986 bp, Quercus alba
ctctctctctctctctcacactcgctctcatattctctctctcgcggctagggttttagcgcagctctctcttgttctctctctctcctcagtcgattcagaatgggtaaggaaaaggttcacattaacattgtggtcattggccatgtcgactctgggaagtcgaccaccactggtcacttgatctacaagcttggaggtattgacaagcgtgttattgagaggttcgagaaggaagctgctgagatgaacaagaggtcattcaagtacgcctgggtgcttgacaagctcaaggctgagcgtgagcgtggtatcaccattgatattgccttgtggaagttcgagaccaccaggtactactgcacggtcattgatgcccctggacatcgtgatttcatcaagaacatgattactggaacctcccaggctgattgtgccgtcctcattattgactccaccactggtggttttgaagctggtatttccaaggatggacagacccgtgagcatgctctccttgctttcaccctcggtgtcaagcaaatgatttgctgctgcaacaagatggatgccactacccccaagtactcaaaggctaggtacgatgaaatcgtgaaggaagtctcttcctacttgaagaaggttgggtacaaccctgacaagattccttttgtccccatctctggatttgagggtgacaatatgattgagaggtccaccaaccttgactggtacaagggtccaacccttcttgatgcacttgaccagatcaatgagccaaagaggccctcagataagcccctccgtctcccacttcaggatgtttacaagattggaggcattggaactgtccctgtgggtcgtgttgagaccggtatcatcaagcctggtatggttgtgactttcggccccactggactgaccactgaagtaaagtctgttgaaatgcatcatgaggctctcctagaggctcttcctggtgacaatgttggcttcaacgttaagaatgttgctgtgaaggatctcaagcgtgggtttgttgcctccaattccaaggatgatcctgccaaggaggcagccaacttcacctcccaagttatcatcatgaaccaccctggccagattggaaatggttacgcccctgtcctcgattgccacacctcccacattgctgtcaaatttgctgagctcttgaccaagattgacaggcggtctggtaaggagcttgagaaggagcccaaattcttgaagaatggtgatgctggaatggttaagatgcttcccaccaagcccatggttgtggaaaccttttccgagtatcccccacttggtcgttttgccgtcagggacatgcgtcaaactgtggctgttggtgtcatcaagagtgtggagaagaaggatccatctggagccaaggtgaccaagtctgctgccaagaagaagtgaattgtgctgcacccagtttctgcaagtgctgggtatcgtagtccttacagtaaggactgggttcttgctattaatctatccatagaaggtctaagtgtttgttttgttggtaatagcttcaagtctctgccatcgtcatgtagcttcaattcccagaattgggtgcttgaccgacggtggcggggccatggagtatcctagtgttttttgatttgcttaaggtgtcatgtgagacttatttattttcataagcagctatggagttttaggtctgttttcatgctgcccggatttttgctatttacatttatagttatctagtctgtgtgttttcaattgaacaatttttacttgctgcatctctactgatatgttttttaaggttcgctacttttattctttattatagatctttactggttgaattgttttcggaagaatagaccttattactggttgaattgaattgtgacaaattatattatgttcaactcatctactgatgttgaattatattatgttcattatggtgaagttcta

SEQ ID NO: 575 - DNA, 2645 bp, Oryza sativa
agttagcttcctcttattcaaccatgggtaaggagaagacgcacatcaacattgtggtcattggccacgtcgactccggcaagtcgaccaccacgggccatctgatctacaagcttggaggtatcgacaagcgtgtgattgagaggttcgagaaggaagccgctgagatgaacaagaggtccttcaagtacgcgtgggtgcttgacaagctcaaggccgagcgtgagagaggtatcaccatcgatatcgccctgtggaagttcgagaccaccaagtactactgcacggtcatcgatgcccctggtcaccgtgacttcatcaagaacatgatcacgggtacctcccaggctgactgtgccgtgctcatcattgactccaccactggtggttttgaggctggtatctccaaggatggccagacccgtgagcacgctcttcttgctttcactcttggagtgaagcagatgatctgctgctgcaacaaggtatatatcactcccaagtactccaaggcccgttacgatgaaatcgtgaaggaagtctcatcctacctgaagaaggtcggctacaaccctgacaagattcccttcgttcccatctctgggtttgagggtgacaacatgattgagaggtccaccaaccttgactggtacaagggccccaccttgcttgaggctcttgaccagatcaacgagcccaagaggccatcagacaagcccctgcgtcttccccttcaggacgtgtacaagatcggtggtattggcaccgtgcctgtgggtcgtgttgagactggagtcctcaagcctggtatggtggtgacctttggtcccagcggcctgaccactgaggtcaagtcggttgagatgcaccacgaggctccctcccatctcatcccagccgacgacgccgcagcctcctcctctcgccatctcccgtcctctcgtggaagtcagctacctgcttaatcaaccatgggtaaggagaagacgcacatcaacattgtggtcattggccacgtcgactctggcaagtcgaccaccacgggccatctgatctacaagcttggaggtatcgacaagcgtgtgattgagaggttcgagaaggaagccgctgagatgaacaagaggtccttcaagtacgcgtgggtgctcgacaagctcaaggccgagcgtgagagaggtatcaccatcgatattgccctgtggaagttcgagaccaccaagtactactgcacggtcatcgatgcccctggtcaccgtgacttcatcaagaacatgatcacgggtacctcccaggctgactgtgccgtgctcatcattgactccaccactggtggttttgaggctggtatctccaaggatggccagacccgtgagcacgctcttcttgctttcactcttggtgtgaagcagatgatctgctgctgcaacaaggtatatatagatggatgccaccactcccaagtactccaaggcccgttacgatgaaatcgtgaaggaagtctcatcctacctgaagaaggtcggctacaaccctgacaagattcccttcgttcccatctctgggtttgagggtgacaacatgattgagaggtccaccaaccttgactggtacaagggccccaccttgcttgaggctcttgaccagatcaacgagcccaagaggccatcagacaagcccctgcgtcttccccttcaggacgtgtacaagatcggtggtattggcaccgtgcctgtgggtcgtgttgagactggagtcctcaagcctggtatggtggtgacctttggtcccagcggcctgaccactgaggtcaagtcggttgagatgcaccacgaggctctccaggaggctcttcctggtgacaacgtcgggttcaacgtgaagaacgttgcggtgaaggatctgaagcgtgggtacgtggcctccaactccaaggatgaccctgccaaggaggctgccagcttcacctcccaggtgatcatcatgaaccaccctggccagatcggcaacggctacgccccagtgctggactgccacacctcccacattgccgtcaagtttgctgagctggtgaccaagatcgacagacgatctggtaaggagctggagaaggagcccaagttcctcaagaacggtgatgctggtatggttaagatgattcccaccaagcccatggttgtggagaccttctctgagtaccctcctcttggtcgttttgccgtgcgtgacatgaggcaaacggtggctgttggcgtcatcaagaacgtggagaagaaggacccaaccggtgccaaggtgaccaaggctgccgccaagaagaaatgatcctcgttcaagtggtagttttgtgcacggccatggcactcgttgcattgaccgttattatcatatgctcgctgtgtgcactgtgtcgtttaaaactctctattttctgttcggtttaaacttgttctgagcctgattattgcccttcggctgttgtggaatgcgggtatttacattgctaattcctatgtctttattttggcttgtggcattcgcttgttctactgctattgaaaactgtaatctgtttctgttattaaaaactgaaccttttcttctgctatttgaaactgaagcgagtgggtttcaatttgctgaaa

SEQ ID NO: 576 - DNA, 1289 bp, Secale cereale
cacatcaacatcgtggtcattggacatgtcgactctggcaagtcgaccaccactggccatctgatctacaagcttggaggtatcgacaagcgtgtgatcgagaggttcgagaaggaagccgctgagatgaacaagaggtcgttcaagtatgcgtgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggtccccttcgtccccatctctgggtttgagggtgacaacatgattgagaggtccaccaaccttgactggtacaagggccctaccctgcttgaggcgcttgaccagatcaacgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccatgagtctctcctggaggcgcttcctggtgacaacgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacagttgctgttggtgtcatcaagggcgtggagaagaaggaccccaccgg

SEQ ID NO: 577 - DNA, 1559 bp, Secale cereale
aaggagaagatccacatcagcattgtggtcattggccatgtcgactctggcaagtcaaccacgactggccacctcatctacaagcttggaggcattgacaagcgtgtgatcgagaggttcgagaaggaagctgctgagatgaacaagaggtcgttcaagtacgcctgggtgcttgacaagctcaaggctgagcgtgagagaggtatcaccattgatatcgctctgtggaagttcgagaccaccaagtactcctgcactgtcattgatgctcctggtcaccgtgatttcatcaagaacatgatcactgggacctcccaggctgattgtgctgtgcttatcattgactccaccactggtggttttgaggctggtatctccaaagatggccagacacgtgagcatgctctccttgctttcactcttggtgtgaagcagatgatctgctgctgcaacaagatggacgccaccactcccaagtactcgaaggcccgttatgatgaaattgtgaaggaagtctcttcatacctgaagaaggtcggttacaaccctgacaaggttccctttgtccctatctctgggtttgagggtgacaacatgatcgagaggtcctccaaccttgactggtacaagggcccaaccctgcttgaggcgcttgaccagatcaatgagcccaagaggccctccgacaagcccctgcgtcttccccttcaggacgtgtacaagattggcggcattggaactgtgccagtgggacgtgttgagactggagtaatcaagccaggcatggttgtcacctttgggcctactggcctgaccactgaggtgaagtccgttgagatgcaccacgagtcccttttggaggcgcttcctggtgacaacgtcggcttcaacgtcaagaacgtggctgtcaaggatctcaagcgtgggtatgtcgcttctaactccaaagacgaccctgccaaggaggctgccaacttcacggcgcaggtcatcatcatgaaccaccctggccagatcagcaacggctatgccccagtgctggactgccacacgtcccacatcgccgtcaaattcgctgagatccagaccaagatcgaccggcggtctggcaaggagctggaggcggcgcccaagttcctcaagaatggtgatgccgggttcgtcaagatggtccccaccaaacccatggtggtggagaccttcgcccagtaccctcccctgggccgctttgctgtgcgcgacatgaggcagacggtggccgttggcgttatcaagagcgtggaaaagaaggagccaacgggcgccaaggtgaccaaggctgcgatcaagaagaaatgagatggtgtcaggttctttactgcatctatggtggcggtggcggtatttggtggtggtgatagttgtgttagccgttttggaaacttgttaagcttcggctatttgtgtctagcagtgttcgaagtgcttattgctctggaaattgtatcgttcggttgtgttggtgaaacttcgtcagttgacgtcgctgctatatatagtaatcatgtttggagtcgttc

SEQ ID NO: 578 - DNA, 1803 bp, Sorghum bicolor
accctagggcgccttccttataaaaacctagctctatcctgttctcaaaccttcaaaccctcagacgcagtcggccgccgcagaccgggagaagtcgacacgccgccaccgtatcctcagatcagcggcgggccgtaaccacgccactttgctgccgcccgacgagcagcgtaacagttgccttaagccatgggtaaggagaagactcacatcaacattgtggtcattggccatgtcgactctggcaagtcgaccaccactggccacctgatctacaagcttggtggtattgacaagcgtgtgatcgagaggttcgagaaagaggctgcggagatgaacaagaggtcgttcaagtatgcgtgggtgcttgacaagctcaaggctgagcgtgagagaggtatcacaattgatatcgccctgtggaagtttgagaccaccaagtactactgcactgtcattgatgcccctggacaccgtgacttcatcaagaatatgattacgggtacttcccaggctgactgtgctgttcttatcattgactccaccactggtggttttgaggctggtatctccaaggatggccagacccgtgagcatgctctccttgctttcacacttggagtgaagcagatgatttgctgctgcaacaagatggatgccacgacacccaagtactcgaaggcccgttatgatgagattgttaaggaagtctcttcttacctgaagaaggttggatacaacccagacaagatccactttgttcccatctctggttttgaaggtgacaacatgattgagaggtccaccaaccttgactggtacaagggcccaaccctgcttgaggctctggacttaatcaatgagccaaagagaccttcagacaagcccctgcgtctcccccttcaggatgtgtacaaaattggtggtattggaactgttcctgtgggacgtgttgagactggtatcatcaagcctggtatggttgtcaccttcggtcctagtggccttacaactgaggttaagtctgttgagatgcaccacgaggctctccaggaggcccttcctggtgacaatgttggcttcaatgttaagaatgttgctgtgaaggatctgaagcgtgggtatgtggcctccaactccaaggatgaccctgccaaggaggcggctagcttcacctcacaggtcatcatcatgaaccaccctgggcagattggcaacggctacgccccagtgctggactgtcacacctcacacatagctgtcaagtttgctgagcttgttaccaagattgataggcgatctggcaaggagcttgagaaggagcccaaattcctcaagaacggtgatgctggtatggtgaagatggttcccactaagcccatggtggtggagaccttctctgagtatcctcctcttggtcgctttgctgtccgggacatgaggcaaacggtggctgttggagtcatcaagagcgtggagaagaaggacccaactggagccaaggtgaccaaggctgccgctaagaagaaatgaggtgtctgctagctggttctgtgttttctcgagggatacctagttgaaacttaatatatcgtcattgctgttatcgcgtgagcaactaaactgtgctggcaatgtttgtctggtcgattgagtattgttattttcgttaaaaccagggtactattaagactcaatttctgttatttttgtatcgaacatcgggtgttggccatatgtggttatgagttttgttactacccttgttgaagtgtttgcctgtttacttattttgctcgtcct

SEQ ID NO: 579 - DNA, 1761 bp, Sorghum bicolor
aaaccctaagacgcagtcggccgccgcacaccaggagaagccgacgcgccgccaccgtatccgcggatcagcggcgagccgtcaccacgccacactgcttgccgcccgacgagcagcgtaacagtttcctgcagccatgggtaaggagaagactcacataaacattgtggtcattggccatgtcgactctggcaagtcgaccaccactggccacctgatctacaagcttggtggtattgacaagcgtgtgatcgagaggttcgagaaagaggctgcggagatgaacaagaggtcgttcaagtatgcgtgggtgcttgacaagctcaaggctgagcgtgagagaggtatcacaattgatattgccctgtggaagttcgagaccaccaagtactactgcacggtcattgatgcccctggccaccgtgacttcatcaagaatatgatcactggcacttctcaggctgactgtgctgttcttatcattgactccaccactggtggttttgaggctggtatctccaaggatggccagacccgtgagcatgctctccttgctttcacacttggagtgaagcagatgatttgctgctgcaataagatggatgccaccacacccaagtactcgaaggcccgttatgatgaaattgtgaaggaagtctcttcctacctgaagaaggttggatacaacccagacaagatccactttgttcccatctctggttttgaaggtgacaacatgattgagaggtccaccaaccttgactggtacaagggcccaaccctgcttgaggctctggacttaatcaatgagccaaagaggccttcagacaagcccctgcgtctcccccttcaggatgtgtacaagattggtggtattggaactgttcctgtgggacgtgttgagactggtatcatcaagccgggtatggttgtcaccttcggtcctagtggccttacaactgaggttaagtctgttgagatgcaccacgaggctctccaggaggcccttcctggtgacaatgttggcttcaacgttaagaatgttgctgtgaaggatctgaagcgtgggtatgtggcctccaactccaaggatgaccctgccaaggaggctgctagcttcacctcacaggtcatcatcatgaaccaccctgggcagattggcaatggctatgccccagtgctggactgccacacctcacacattgctgtcaagtttgctgagcttgttaccaagattgataggcgatctggcaaggagcttgagaaggagcccaaattcctcaagaacggtgatgctggtatggtgaagatggttcccactaagcccatggtggtggagaccttctctgagtatcctcctcttggtcgctttgctgtccgggacatgaggcaaacggtggctgttggagtcatcaagagcgtggagaagaaggacccaactggagccaaggtgaccaaggctgccgccaagaagaaatgaggtgtctgtctggctggttctgtgttttctcgatggatacctagttgaaacttaaaatatttcgtcattgctgttatcgacgtgagcaactaaactgtgctagcaatgtttgtctggtcgatttagtattgttattttcgttaaaaccagggtactattaagactcaatttctgttatttttgtatcgaacatcgggtgttggccatatgtggttatgagttttgttactacccttgttgcagtgtttgcctgtttacttgttttgctcgtccttgcctgt

SEQ ID NO: 580 - DNA, 1847 bp, Sorghum bicolor
aaaccctaagacgcagtcggccgccgcacaccgggagaagccgacgctccgccaccgtatccgcagatcagcggcgagccgtaaccacgccacactgcttgccgcccgacgagcagggtaacagttcccttcagccatgggtaaggagaagactcacatcaacattgtggtcattggccatgtcgactctggcaagtcgaccaccactggccacctgatctacaagcttggcggtattgacaagcgtgtgatcgagaggttcgagaaggaggctgcggaaatgaacaagcgttcattcaagtacgcctgggtgctcgacaagcttaaggctgagcgtgagagaggtatcacaattgatattgcgctgtggaagttcgagaccaccaagtactactgcactgtcattgatgcccctggacaccgtgacttcatcaagaatatgatcactggtacttcccaggctgactgtgctgttcttatcattgactccaccactggtggttttgaggctggtatctccaaggatggccagacccgtgagcatgctctccttgctttcacacttggagtcaagcagatgatttgctgctgcaacaagatggacgccaccacacccaagtactcgaaggcccgttatgatgagattgtgaaggaagtctcttcctacctgaagaaggttggatacaacccagacaaaatccactttgttcccatctctggttttgaaggtgacaacatgattgagaggtccaccaaccttgactggtacaagggcccaaccctgcttgaggctctggacttgatcaatgagccaaagaggccttcagacaagccactgcgtctcccccttcaggacgtgtacaagattggtggtattggaactgttcctgtcgggcgtgttgagactggtatcatcaaacctggtatggttgttacctttggtcctagtggccttacaactgaggttaagtctgtcgagatgcaccacgaggctctccaggaggcccttcctggtgacaatgttggcttcaatgttaagaatgttgctgtgaaggatctgaagcgtgggtatgtggcctccaactccaaggatgaccctgccaaggaggctgctagcttcacctcccaggtcatcatcatgaaccaccctgggcagattggcaatggctacgccccagtgctggactgccacacctcacacattgctgtcaagtttgctgagcttgttaccaagattgataggcgatctggcaaggagcttgagaaggagcccaaattcctcaagaacggtgatgctggtatggtgaagatggttcccactaagcccatggtggtggagaccttctctgagtatcctcctcttggtcgctttgctgtccgggacatgaggcaaacggtggctgttggagtcatcaagagcgtggagaagaaggacccaactggagccaaggtgaccaaggctgccgccaagaagaaatgaggtgtctggctgatcctgtgttttcttgagggatacctagttggaactttaaatattgtcattcctgttattgcgcgagcaactaaactgtgctggcaatgtttgtctggtcgatttagtactgttatttttgttaaaaccagggtgcttgacaccaattttctgttatttttggatcgaacatcgggtgttagccaatggttttgagttttgttactctcgttatgtttgcctgtttacatagctgtttctaaataggtgatgattcgctcgtctgtgcctacttttgtagtgtttgcctgttaacctatctagaaatattgttttgtctacgcttttaattgtgaaaagcaatttttgctgattt

SEQ ID NO: 581 - DNA, 1810 bp, Sorghum bicolor
cctagctccatcgtgttctcaaaccctcagacgcagtcggccgccacagaccgggagaagccgacgcgccgccaccgaatcctcagatcagcggcgagccgtaaccgcgccactctgctgccgcccgacgagcagcgtaacagtttcctgcagccatgggtaaggagaagactcacataaacattgtggtcattggccatgtcgactctggcaagtcgaccaccactggccacctgatctacaagcttggtggtattgacaagcgtgtgatcgagaggttcgagaaagaggctgcggagatgaacaagaggtcgttcaagtatgcgtgggtgcttgacaagctcaaggctgagcgtgagagaggtatcacaattgatattgccctgtggaagttcgagaccaccaagtactactgcactgtcattgatgctcctggacaccgtgacttcatcaagaatatgatcactggtacttcccaggctgactgtgctgttcttatcattgactccaccactggtggttttgaggctggtatctccaaggatggccagacccgtgagcatgctctccttgctttcacacttggagtgaagcagatgatttgctgctgcaacaagatggacgccaccacacccaagtactcgaaggcccgttatgatgagattgtgaaggaagtctcttcttacctgaagaaggttggatacaacccagacaagatccactttgttcccatctctggttttgaaggtgacaacatgattgagaggtccaccaaccttgactggtacaagggcccaaccctgcttgaggctctggacttgatcaatgagccaaagaggccttcagacaagccactgcgtctcccccttcaggacgtgtacaagattggtggtattggaactgttcctgtcgggcgtgttgagactggtatcatcaaacctggtatggttgttacctttggtcctagtggccttacaactgaggttaagtctgttgagatgcaccacgaggctctccaggaggcccttcctggtgacaatgttggcttcaatgttaagaatgttgctgtgaaggatctgaagcgtgggtatgtggcctccaactccaaggatgaccctgccaaggaggctgctagcttcacctcccaggtcatcatcatgaaccatcctgggcagatcggcaacggctacgccccagtgctggactgccacacctcacacattgctgtcaagtttgctgagctggttaccaagattgataggcgatctggcaaggagcttgagaaggagcccaaattcctcaagaacggtgatgctggtatggtgaagatggttcccaccaagcccatggtggtggagaccttctctgagtatcctcctcttggtcgctttgctgtccgggacatgaggcaaacggtggctgttggagtcatcaagagtgtggagaagaaggacccaactggagccaaggtgaccaaggctgccgccaagaagaaatgatgcgcctctgtttgctcgtgggatacctagttgaaacttcaaaaatatatcgtcattgctgttgctgttatcgcttgagcaactaaactgtgctggcaatgtttgtctggtccatctagtactgttatttttgctaaaaccagggtgctgttgagactcaattctgttatttttgtatcgaacaacgggtgttagccatatatggttgagtttttgttactaccggtgttgcagtgtttttctgaacttattttgctgtttctaaatagctgatgattcgctcgtcgatacctgtctgctgcgttcaaatt

SEQ ID NO: 582 - DNA, 1722 bp, Camellia sinensis
aatgggtaaggaaaaagttcacatcaacattgtggtcattggccatgtcgactctgggaagtcaaccaccactggtcatctcatctacaagcttggaggtattgacaagcgtgtgattgagaggtttgagaaggaggctgctgagatgaacaaacgttcattcaagtatgcctgggtcttggacaagctcaaggctgaacgtgaacgtggtattaccattgatattgctttgtggaagtttgagaccaccaagtactactgcactgtcattgatgctcctggccatcgtgatttcatcaagaacatgatcactggtacctcacaggctgactgtgctgttcttatcattgactccaccactggtggttttgaagctggtatttccaaggatgggcagacccgtgagcatgctctgcttgcgttcactcttggtgtcaagcaaatgatctgctgttgcaacaagatggatgcaactactcccaagtactcaaaggcaaggtatgatgaaattgtcaaggaagtgtcttcctacctcaagaaggttggatataaccctgacaaaatccccttcgtcccaatctctgggtttgagggtgataacatgattgaaaggtcaaccaacctcgactggtacaagggcccaacccttctggatgctcttgacatgatttcagaacccaagaggccctcagacaagcctcttcgtctcccacttcaggacgtctacaagattggtggcattggcactgtccctgtgggccgtgttgagactggtttgatcaaacccggcatggttgtcacttttggcccaactggtctcaccactgaagttaagtcagtagaaatgcaccacgaggctctcctggaggccctaccaggcgacaatgttggtttcaatgtaaaaaatgttgctgtcaaggatctcaaacgggggtttgttgcctcaaactccaaggacgatcctgcaaaggaagctgccaactttacttcccaggtcattatcatgaaccatcctggccaaattggaaatggttatgccccagttctcgattgccacacttcccacattgcagtcaaatttgctgagattctgaccaagattgacaggaggtctgggaaggagctcgagaaggagcccaaattcttgaagaacggtgatgctgggatggtgaagatgattccaacaaagcccatggtggtggagactttttccgagtacccaccacttggtcgttttgctgtgagagacatgcgtcaaactgttgctgttggtgtcatcaagagtgttgagaagaaggatccatctggtgccaaggtcaccaaggctgctcagaagaagaaatgatcggttcatttaagggttttcatattaagagaagtagacttattgtctgttttaaatttggtaaattctgttttaaatttggtaaattttgtttttatgttctgttggatcttgtagctgctcaatagccctcctttgggggaatggtggtggtgttaaacattcaggtgcagatctgagttctcgacaggcaggcagtcacaaaagtgtttttcgtggtattctatttttctagtatctgtagtttttagttttgagtgatgaaatttgggtcggatgtgaacttgtaagtcgcttgagtttttatccaagtatttgaactcttacatttgtctcttgagtttttatccaagtatttgaactcttacatttggatg

SEQ ID NO: 583 - DNA, 1759 bp, Nicotiana tabacum
cctcctcatcactttgcctgcgattttcttctgctgcgccgcaagggacctatcggagcttaatttctctttctcaaagtctcttagtcactcactatgggtaaagagaaggttcacatcaacattgtggtcattggccacgttgactctggaaagtcgaccaccactggtcacttgatctacaagcttggtggtattgacaagcgtgttattgagaggttcgagaaagaagctgctgagatgaacaagaggtcattcaagtatgcctgggtgcttgacaagcttaaggctgaacgtgagcgtggtatcaccattgatattgccttgtggaagtttgagaccaccaaatactactgcacagtgattgatgcccccggacacagggactttatcaagaacatgatcactggtacttcccaggctgattgtgctgttcttattattgactccaccactggtggttttgaagctggtatttccaaggatggtcagacccgtgagcacgcattgcttgctttcactcttggtgtcaagcaaatgatttgctgctgcaacaagatggatgctaccacccccaaatattccaaggctaggtatgatgaaatcgtgaaggaagtttcttcctacctcaagaaggtaggttacaaccctgacaagatcccctttgtccccatctctggtttcgagggagacaatatgattgagaggtctaccaaccttgactggtacaagggcccaaccctccttgaggctcttgaccagattaatgagcccaagaggccctcagacaaacccctccgtcttccacttcaggatgtttacaagattggtggtatcggaaccgtccctgttggtcgtgtggagactggtgtgctcaagcctggtatggttgtgacctttggccctactggtctgacaactgaagtaaagtctgttgagatgcaccacgaagctctccaggaggcactccctggcgacaatgttgggttcaacgttaagaatgttgctgttaaggatctcaagcgtggttttgttgcctcaaactccaaggatgacccagccaagggagcatccaacttcacctcccaggtcatcatcatgaaccatcctggccagatcggaaatggatatgcaccagttctcgactgccacacttcccacattgctgtcaagtttgctgagatcttgaccaagattgacaggcgttctggtaaggaacttgagaaggagcctaagttcttgaagaatggtgatgctggtatggttaagatgattccgaccaagcctatggttgttgagaccttctctgagtacccaccattgggtcgttttgctgtgagggacatgcgacaaactgttgctgttggtgtcatcaagaatgtcgacaagaaggacccaacaggtgccaaggtcaccaaggctgcccagaagaaaaagtgaacagtgcactgtaatgctggtgtttccagtgctgtctattatcttcaagtgtgttatgtagactctgttttgtttagttctgctatctttttgtctttgattttaggttctagttctctgccatgtatgtcaggtatttctcagaactgggtccttgacaggcggtggccagcaggactgagtctgccttcattttgttgaggaggtgccttggttttccatggcagctcaggatttttgctatttatgttacctaaagtacttaatttgagctttttaaacttttctactctttgccttctgtgagtgaagattaaat

SEQ ID NO: 584 - DNA, 1362 bp, Trigonella foenum-graecum
aaaaggttcatatcaacattgtcgtcattggacatgtcgactctggaaaatcaacaacaactggtcacttgatctacaagctaggaggtatcgacaagcgtgtgattgagaggttcgagaaggaagctgctgaaatgaacaaacgttcattcaagtacgcatgggttcttgacaaacttaaggcagagcgtgaaagaggaattaccatcgatattgctttgtggaaattcgagaccaccaagtactactgcacagtcattgatgctcccggacatcgtgatttcatcaagaacatgattactggaacctcccaggctgattgtgctgttctcatcattgattccaccactggtggttttgaagctggtatctcaaaggatggacagacccgtgagcatgctcttctcgctttcacccttggagtgaagcagatgatctgttgttgtaacaagatggatgctaccacccctaagtactcaaaggctaggtacgatgaaatcattaaggaagtttcttcctacttgaagaaggttggttacaacccagacaaaattccctttgttcccatctccggttttgaaggtgacaacatgattgaaaggtccaccaacctagactggtacaagggaccaactctccttgaggcacttgaccagatcaacgagcccaagagaccctcagacaagcccctcagacttccattgcaagatgtttacaagattggtggtattggaactgtgccagtcggacgtgttgagaccggtgttgtgaagcccggtatggtggtgacttttggaccaactggtttgacaactgaagttaagtctgttgagatgcaccacgaggctctcactgaagctcttccaggagacaatgtcggattcaatgttaagaatgttgccgtgaaggatctcaagcgtggttttgttgcatccaactccaaggatgaccctgccaaggaagctgccaacttcacttcccaagtcatcatcatgaaccaccctggacagattggaaatggatatgcaccagtgctcgattgtcacacctctcacattgctgtgaagtttgctgaacttgtcaccaagatcgacaggcgatctggtaaggagattgagaaggagcccaagtttttgaagaatggagatgctggtatcattaagatgattccaaccaagcccatggttgttgagactttctctgaatatcctccattgggacgttttgctgtcagggacatgcgtcagactgttgctgttggtgtcatcaagggtgtggagaagaaggatcctaccggagccaaggtcaccaaggctgctgccaagaagaagtgatgtcacaacatggttactgcacaagctg

SEQ ID NO: 585 - DNA, 1692 bp, Papaver somniferum
ctgcggagcttttctattcgccgtttcagttaatttctaagaattcaatatgggtaaagagaaggttcacatcaacattgttgtcattggacatgttgactctggtaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaacatgattactggtacttctcaggctgattgtgctgtcctcattatcgattccaccactggaggttttgaggctggtatctcaaaggatggtcagactcgtgagcatgctcttcttgctttcacccttggtgtcaagcagatgatctgttgttgcaacaagatggatgccaccacccccaagtactcaaaggctaggtatgatgaaattgtcaaggaggtctcatcttacttgaagaaggttggatacaacccagaaaaaattgcctttgttcctatctctggattcgagggagacaacatgattgaaaggtccaccaaccttgactggtacaagggaccaactctcctcgaggctcttgacaacatctctgagccaaagagaccctcagacaagccccttcgtcttccccttcaggatgtttacaagattggaggtattggaactgtgccagtgggacgtgttgaaactggagtcatcaagcctggtatggttgttacttttggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactccaaggatgaccctgccagggaagctgccaacttcacctcccaggtcatcatcatgaaccatcctggtcagattggtaatggttatgctccagttcttgactgtcacacatctcacattgctgtcaagtttgctgagatccaaaccaagatcgataggcgatctggaaaggagcttgagaaggagcccaagttcttgaagaacggtgatgctggtattattaagatgattccaaccaagcccatggttgtagagacctttgctcagtacccacctcttggacgttttgctgttagggacatgaggcagacagttgctgttggtgtcatcaagggagttgagaagaaggacccaacaggagccaaggttaccaagtctgctgtcaagaagaaatgaagtgtgctgccattgttaactagagggatggtgctaggaggatctacaggaaggacttgtctctattgctttactattagtcagttttatttttgctttttgttggttaggtatctgtgcagtctcttgttttgtatagcttttgttttgttgcgcgtccggatgcaaacctgggtgcttgacaggcggtggcaacaaaatgttaggctgttcagttgaagttccttaaaaaacatatgtttgattttgggttttcaattcaagactttttactctgttaattgaatatcgtatttggta

SEQ ID NO: 586 - DNA, 1626 bp, Secale cereale
gactctcccctccgttcgttcttcttcgagtttatacatcagccatgggtaaggagaagactcacatcaacatcgtggtcattggccatgtcgactctggcaagtcgacgaccactggccatctgatctacaagcttggaggcattgacaagcgtgtgatcgagaggttcgagaaggaagccgcggagatgaacaagaggtctttcaagtacgcctgggtgcttgacaagctcaaggctgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggttttgaggctggtatctccaaggatggccagacacgtgagcacgctctccttgctttcactcttggagtgaagcagatgatttgctgctgcaacaagatggacgccaccactcccaagtactcaaaggctcgttacgaagaaattgttaaggaggtgtcttcctacctgaagaaggttggctacaaccctgacaaggttccctttgtccccatctctgggttcgagggtgacaacatgatcgagaggtccaccaaccttgactgtacagggcccacctgcttgagcgctgaccagatcaacgagcccaagacggccctcagacaagccccctccgacttccccctcaggatgtctacaagattggtggcattggaactgtgccagtggggcgtgttgagactggtgtcatcaagccaggtatggttgtcacctttggccctactggcctgaccactgaggtgaagtctgtggagatgcaccacgagtctctcctggaggcgcttcctggtgacaatgtcggcttcaacgtcaagaacgtggccgtcaaggatctcaagcgtgggtatgttgcctccaactctaaggacgaccccgccaaggaggctgccaacttcactgcccaggtcatcatcatgaaccaccctggccagatcagcaatggctatgccccagtgctggactgccacacgtgccacatcgccgtcaagtttgctgagatccagaccaagattgacaggcggtccggcaaggagctggaggcggcgcccaagttcctcaagaacggtgacgctgggttcgtcaagatgatccccaccaagcccatggtggtggagacctttgcccagtaccctcccctgggccgctttgctgtgcgcgacatgaggcagacggttgctgtgggtgtgatcaagagcgtggagaagaaggagccgaccggtgccaaggtgaccaaggctgcgatcaagaagaaatgagatggtgtctggcagtgctgttgttggcgggtggtggtgacggtatacggcggttgcggtagtcgtcttagtcgattcaaaaactcgtttaagctttggttatttgtgtcagcagtgttggaactgcttatgtatcatttagttgtgttggtgaaacttcgtcagttaatgttgctatctattatagtcatcttgtttggaatcattttatatctgttgccttcatgtttctgtcttgcaaa

SEQ ID NO: 587 - DNA, 1791 bp, Gossypium hirsutum
tctctcttctgctttgtcgccacgatttcagcttcagatcgcttctatttcttagcttgaagctaatactgcagaatgggcaaggaaaagactcacattaacattgtcgtaattggccatgtcgactctggaaagtcaaccaccactggccacttgatctacaagcttggaggtattgacaagcgtgtcattgaaaggtttgagaaggaagctgccgagatgaacaagaggtcattcaagtatgcttgggtgcttgacaagttgaaggctgagcgtgaacgtggtattaccattgacattgccctgtggaagtttgagaccaccaaatattactgcactgtcatcgatgcccctggacatcgtgactttatcaagaacatgattactggtacctcccaggccgattgtgctgtccttatcattgactctaccactggaggttttgaggcaggtatttccaaggatggacagacccgtgagcatgctctgcttgctttcactctcggtgtcaagcaaatgatttgctgctgcaacaagatggatgccacaacccccaaatactcaaaggctaggtatgatgaaattgtgaaggaagtgtcttcctacttgaagaaggttggttacaaccctgagaagattccttttgtccccatctctggttttgagggtgacaacatgattgaaaggtccaccaaccttgattggtacaagggtccaactcttctcgaggctcttgaccagatcaatgagcccaagagaccctctgacaagccactccgtcttccacttcaggatgtgtacaagattggaggtattggaactgtcccagtgggtcgtgttgaaactggtatcctcaagcctggtatggttgtaacctttggtccctctggattgaccaccgaagttaagtctgttgagatgcaccatgagtctcttcctgaggctcttccaggtgacaatgttggcttcaatgtcaagaatgttgctgtgaaggatctgaagcgaggatatgttgcttcgaactcaaaggatgatcctgccaaggaggcagctaatttcacttcccaagtcatcatcatgaaccacccagggcagattggaaatggatatgcgcctgtccttgattgccacacgtcccacattgcggtcaagtttgcagagttggtgaccaagattgacaggcgttctggtaaggagcttgagaaggaacccaagttcttgaagaatggtgatgcaggatttgttaagatgattcccaccaaacccatggttgtggaaaccttctctgagtatcccccactgggtcgttttgctgtgagggacatgaggcagactgttgctgtcggcgttatcaagagcgtggagaagaaagatccaactggagccaaggtgaccaagtctgctgccaagaagggtgggaagtgaaccgtgcgggtttcagttgatccaaccgaactatatcatggctactacaataaaacattgcttcttattagtaggtcagccatcattggaggattagttgtgtgttttgatggtcatagttttaagtcatcaccgtcttgtagaggatgttgttcacagaactgggttcttgatagacggtggtgaggcttgtgtttttcagagtctgctgtctgtgagagtaattataaactttgaatggtgtctgtgttcccattatttatggcaatcagctcaggagttttaggtctggtcctgggttttctgcttgaatttgttctatcaaacatttatatacagtcaaaactagtttgtttttctgttata

SEQ ID NO: 588 - DNA, 1779 bp, Cajanus cajan
cagatacttaacataaggcagatatgggtaaggaaaaggttcacatcaacattgtggtcattggccacgtcgactctgggaagtccactaccactggccacctgatctacaagcttggaggtattgacaagcgtgttattgagagatttgagaaggaagctgctgagatgaacaagaggtctttcaagtatgcatgggtgcttgacaagcttaaggctgagcgtgaaagaggaatcacaattgatattgccttgtggaagtttgagaccaccaagtactactgcacagtcattgatgctcctggacacagggatttcattaagaatatgattactgggacatcccaagctgactgtgctgttcttatcatcgattccactactggtggttttgaagctggaatttccaaggatggacagactcgtgagcatgctcttcttgcattcactcttggtgtgaagcagatgatttgttgctgtaacaagatggatgccaccacacccaagtactcgaaggccagatatgatgaaatcgtgaaggaagtctcttcctacctaaagaaagttggatacaaccctgataagattccttttgttcctatttcgggttttgagggagacaacatgattgagaggtccacaaaccttgactggtacaagggtcctacccttcttgaggcacttgaccagatcaacgagcccaagagaccatctgacaagcccctcaggctgccccttcaggatgtctacaagattggaggaatcggaactgtgccagtgggacgtgttgagactggtaccttgaagcctggaatggtggtcacttttggaccaactggtttgacaactgaagttaagtctgtggagatgcaccatgaagctctcacagaggcccttcctggtgacaatgtgggattcaatgttaagaatgttgctgttaaggatctcaagcgtggttttgttgcctcaaactcaaaggatgatcctgctaaggaggctgctaacttcacctcccaggttatcatcatgaatcacccaggtcagattggaaacggatatgcccctgttctggactgtcacacctcccacatcgctgtcaagtttgctgaacttgtgaccaagattgacaggcgatctggcaaagagcttgagaaggagcctaaatttttgaagaatggtgatgctggttttgtgaagatgattccaacaaagcctatggtggttgaaactttctctgagtatcccccacttggtaggtttgctgttagggacatgcgtcaaactgttgctgttggagtgatcaagagtgtggagaagaaagaacctagtggagccaaggttaccaaggctgcacagaagaagggtggaaagtgaatcgtgcgggatgtccttttttatggttacaatatatgctggtttctttcttcttgtacttctgtgtcttcttctccagttaacttgtttttcggacgttgtttgaagtctccaccatcatctcgcaacttttgttcccagaactgggttcttgatcgacggtggcaaagtttcttctattataatgtgttttaatgtgttgtgagaacccctgaatacatttttgtgctgttggcttgcttttaaatatcaattttgtgttaaaattgtgtcataaattttaactatcgtctggtaaatttctggccatgtttcatatttcctaacaattcttcctttgaccaacaaggcgcgtcgaatttgagtgatttgtttattaatatttaatggtaattgtttattgttt

SEQ ID NO: 589 - DNA, 1706 bp, Malus domestica
tctgcacttccagttctgttgctgataatccgtcatgggtaaagagaagttccatatcaacattgtggtcattggccatgtcgactctggcaagtcaaccaccactggccacttgatctacaagcttggtggtattgacaagcgtgtgatcgagaggttcgagaaggaggctgctgagatgaacaagaggtcattcaagtatgcctgggtgttggacaagctcaaggctgagcgtgagcgtggaattaccattgatattgccttgtggaaatttgagaccaccaagtactactgcactgtcattgatgctcctggacatcgtgactttatcaagaacatgattacgggaacctcccaggctgactgtgccatcctcatcattgactccaccactggaggttttgaagctggtatttccaaggatggtcagacccgtgagcatgctttgcttgctttcactcttggtgtcaagcaaatgatttgctgctgcaacaaggtgagcagatggatgccaccactcccaagtactcgaaggcaaggtacgaagaaattgtgaaggaagtgtcgtcctatctcaagaaggttggctacaacccagataagattccctttgtccccatttctgggtttgagggtgacaacatgattgagaggtccaccaaccttgactggtacaagggtcccacccttcttgaggctcttgaccagatcaacgagcccaagaggccctcagacaagcccctccggcttccacttcaggatgtgtacaagattggtggtattggtaccgtccctgttggacgagttgagactggtgtcattaagcctggtatggtggtgacttttggcccaactgggctaactactgaggtcaagtctgttgagatgcaccacgaagctatgctggaggcccttccaggtgataatgttggattcaacgtgaagaatgttgctgtcaaggatctcaagcgtggttatgttgcttccaactccaaggatgatcctgcaaaggaggctgctaactttacctctcaggtcatcatcatgaaccaccccgggcagattggacagggatatgcaccagttctcgactgtcatacctcccacattgctgtcaagtttgctgagcttgtgacaaagattgacaggcgatctggcaaggagctcgagaaggagcctaagttcttgaagaatggtgatgccggatttgtgaagatgattccaactaagcccatggttgtcgagaccttctctgagtacccaccactcggacgttttgctgtgagggacatgcgccagactgttgcagttggtgtcatcaagagcgttgagaagaaggatccaactggagctaagatcaccaaggccgccgctaagaagaagtgaaccgctgtggttcatcagatttccgcaggcgaaatctcctatcctaataataataatagtcgtaaaaacttatcttctagtatttctatggattgctggttgcgtaatttgttgtcgttgtcgtcgttgggcattcattctcagaattgggtgctcgaccggcggtggcgttgctagtgtgttcttgtgctgtctcctccgttgagagtctaggtgctctgggtttttcccagtgcggctaaaagcttttgtgactggttcttgctactctcggtataaaaacttagcgtctaataaatatgttcttgtggtatttcata

SEQ ID NO: 590 - DNA, 1553 bp, Cynodon dactylon
atgggtaaggagaagagtcacatcaacattgtggtcattggacatgtcgactctggtaagtcgacgaccactggccacctgatctacaagcttggaggtattgataagcgtgtgatcgagaggttcgagaaggaggctgctgaaatgaacaagaggtccttcaagtacgcgtgggtgctggacaagctcaaggccgagcgtgagagaggtatcaccatcgatattgccttgtggaagttcgagaccaccaagtactactgcaccgtcattgatgcccctggacaccgtgacttcatcaagaacatgatcaccggtacctcccaggctgactgtgctgtccttatcattgactccaccactggtggttttgaggctggtatctccaaggatggccagacccgtgagcatgctctccttgctttcactcttggagtgaagcagatgatttgctgctgcaacaagatggatgccaccacacccaagtactcaaaggcccgttacgacgagattgtgaaggaagtctcttcctacctcaagaaggtcggctacaaccctgacaagatccccttcgttcccatctctggtttcgagggagacaacatgattgagaggtccaccaaccttgactggtacagggcccaacactgcttgaggctcttgaccagatcaacgagcccaagaggccctcggacaagcccctgcgtctcccccttcaggatgtgtacaagattggtggtattggtactgtccctgtcggtcgtgttgagactggtgtcctgaagcctggtatggttgtgacctttggtcccagtggcctgactactgaggtcaagtctgttgagatgcaccatgaggctcttcaggaggcactccctggtgacaatgtgggattcaacgtgaagaatgttgctgtgaaggatattaagcgtggctatgttgcctccaactccaaggatgaccctgccaaggaggctgccagcttcacctcccaggtcatcatcatgaaccaccctggacagattggcaacggctacgccccagtgctggactgccacacctcccacattgctgtcaagtttgctgagctgctgaccaagattgacagacgatctggcaaggagcttgagaaggagcccaagttcctgaagaacggtgatgctggtatggtgaagatgattcccaccaagcccatggtggtggagaccttctctcagtaccctcctcttggacgttttgctgtccgtgacatgaggcagactgttgctgttggagttatcaagagtgttgagaagaaggacccgaccggtgccaaggtgaccaaggctgctgccaagaagaaatgatgtatctggtggttggttttgtgcctgcttttcggataccttgatacttcagtactatcgcttaagttttgtcatggccattgcttttgttgtttgggtttaatttctgacggcaatgtgtccgtggtctgtcgtttaagtaccctgttattttggctttggcgaaacattgatattgtgaaactaaaacatgacgttttgtgctgtgag

SEQ ID NO: 591 - DNA, 1733 bp, Papaver somniferum
cttactttttttttccagaaggaatggattaaataaaatgaatacaaatgatacctagctagtacaacgctccaaccttaatttctaagaattcaatatgggtaaagagaaggttcacatcaacattgtcgtcattggacatgtcgactctggaaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgccgtcctcattatcgattctaccactggaggtttgaggctggtatctcaaaggatggtcagactcgtgagcacgctcttcttgctttcacccttggtgtcaagcagatgatctgttgttgtaacaagatggatgccaccacccccaagtactcaaaggctaggtacgatgaaattgtgaaggaggtctcatcttacttgaagaaggttggatacaacccagaaaaaattgcctttgttcctatctctggattcgagggagacaacatgattgaaaggtccaccaaccttgactggtacaagggaccaactctccttgaggctcttgacaacatctccgagccaaagagaccctcagacaagccccttcgtcttccacttcaggatgtttacaagattggaggtattggaactgtgccagtgggacgtgttgaaactggagtcatcaagcctggtatggttgttacttttggacccaccggtttgaccactgaagttaagtctgtggagatgcaccacgaagcccttcaagaagctcttccaggagacaatgttgggttcaatgtcaagaatgttgcagtgaaggatctcaagcgtggtttcgtggcctccaactcaaaggatgaccctgccagggaagctgccaacttcacctcccaggtcatcatcatgaaccatcctggtcagatcggtaacggttatgctccagttcttgactgtcacacatctcacattgctgttaagttcgctgagatccaaaccaagatcgataggcgatctggaaaggagcttgagaaggagcccaagttcttgaagaacggtgatgctggtattattaagatgattccaaccaagcccatggttgtggagaccttcgctcagtacccacctcttggacggtttgctgttagggacatgaggcagacagttgctgttggtgtcatcaagggagttgagaagaaggacccaacaggagccaaggttaccaagtccgctgtcaagaagaaatgaagtgtgctgccaaggttaactagagggatggtgctaggggggtctataggaggaacttctctttattgctttactactagtcagtttcatttttgctttttgtttgttaggtatctgtgcagtctcttgttttgtatggcttttgttttgttgcgtgtccggatgcaaacctgggtgcttgacaggcggtggcaacaagatgttaggctgttcagtttaagttcctttaaaaacatgtttgattttgggttttcaattcacaacttttttcttgcttaacctgttaattgaaa

SEQ ID NO: 592 - DNA, 1641 bp, Papaver somniferum
agaagctctgtgctgcggagcttttctaatcgccgtttctgttattttctaagaattcaatatgggtaaagagaaggttcacatcaatattgttcgtcattggacatgtcgactctggaaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgccgtcctcattatcgattctaccactggaggttttgaggctggaatctcaaaggatggtcagactcgtgagcatgctcttcttgctttcacccttggtgtcaagcagatgatctgttgttgtaacaagatggatgccaccacccccaagtactcaaaggctaggtacgatgaaattgtcaaggaggtctcatcttacttgaagaaggttggatacaacccagaaaaattgcctttgttcctatctctggattcgagggagacaacatgattgaaaggtccaccaaccttgactggtacaagggaccaactctccttgaggctcttgacaacatctctgagccaaagagaccctcagacaagccccttcgtcttccccttcaggatgtttacaagattggaggtattggaactgtgccagttggacgtgttgaaactggagtcatcaagcctggtatggttgtacctttggaccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactccaaggatgacccagccagggaagctgccaacttcacctcccaggtcatcatcatgaaccatcctggtcagattggtaatggttatgctccagttcttgactgtcacacatctcacattgctgttaagtttgctgagatccaaaccaagatcgataggcgatctggaaaggagcttgagaaggagcccaagttcttgaagaatggtgatgctggtattattaagatgattccaaccaagcccatggttgtagagaccttcgctcagtatccacctcttggacgttttgctgttagggacatgaggcagacagttgctgttggtgtcatcaagggggttgagaagaaggacccaaccggagccaaggttaccaagtctgctgtcaagaagaagtaaagtactccagtgagtacagggatggtgctaagagggtctgcagaatggttttgtcttgtttacttcagtagtagtcatttttgttctggtttgctttggttagctatcattgcagttttatatcttttgttgcctttgttttgttgagcatccggatgcaaacctgggtgcttgataggcggtggcaacatgagtttgggctgttcagttaattgaaaacttgttatggattttggtt

SEQ ID NO: 593 - DNA, 1823 bp, Nicotiana benthamiana
acacttcgcatcattcgttttgcgcagccagggttttagcgaagctctctcgtcttttcttttcgtcttctaaagtttcaaaggaatcatgggtaaagaaaaagttcacatcaacattgtggtcattggccacgtcgattctggaaagtctaccaccactggtcacttgatctacaagcttggtggtattgacaagcgtgttattgagaggttcgagaaggaagccgctgagatgaacaagaggtcattcaagtatgcctgggtgcttgacaagcttaaggctgaacgtgagcggggtatcaccattgatattgccttgtggaagtttgagaccaccaaatactactgcactgtgattgatgcccccggacacagggactttatcaagaacatgatcactggtacttcccaggctgattgtgctgttcttattattgactccaccactggtggttttgaagctggtatttccaaggatggtcagacccgtgaacacgcattgcttgctttcacccttggtgtcaagcaaatgatttgctgctgcaacaagatggatgctaccacccccaagtactccaaggctaggtatgatgaaatcgtcaaggaagtttcttcctacctgaagaaggttggttacaaccctgacaagattcccttcgtccccatctctggttttgagggagacaatatgattgagaggtctaccaaccttgactggtacaaggggccaaccctccttgaggctcttgaccagattaatgagcccaagaggcccacagacaaacccctacgtcttccacttcaggacgtttacaagattggtggtattggtaccgtccccgttggtcgtgttgaaactggtgtcctcaagcctggtatggttgtgacctttgggcctactggtctgacaactgaagtcaagtctgtagagatgcaccacgaagctctcctggaggcactccccggtgacaatgttgggttcaatgttaagaatgttgctgttaaggatctcaagcgtggttatgttgcctcaaattccaaggatgacccagccaaaggggctgccagtttcacctcccaggtcatcatcatgaaccatcctggtcagattggaaatggatatgcaccagttcttgactgccacacttcccacattgctgtcaagttcgctgagatcttgaccaagattgacagacgttctggtaaggaacttgagaaggagcctaagttcttgaagaatggtgatgctggtatggttaagatgatgccgaccaagcctatggttgtggagacctttgccgagtacccaccattgggtcgttttgctgtgagggacatgcgtcagactgttgctgttggtgtcatcaagagtgttgacaagaaggacccaactggcgccaaggtcaccaaagctgctcagaagaagaagtgaggttgtggtgttgatgggattcaacttggatgaactagttttgtttatttgcatcagttttttccaattttgttttggacatttaaccagtgctggatctccaggagctattgtcatggttctctagcctcttttgaggatagtggagtaattgagcaatttggtgcagagctaaattgcttgatgggccatgacaatagctctttggtggttatttctttgcctggttttatctcacattttatgatgagctttagtcagtgaattactgaacttgtttatcttagtgaattttgagcagattttcttcttattatgtggtgattgtttcttccctctttgaggtgtgcatgaattgaggtgttgattcatctaaagggtcaatctttta

SEQ ID NO: 594 - DNA, 1807 bp, Nicotiana benthamiana
cctcctcatcactttgcctgcgattttcttctgctgcgccgcaagggacctatcgaagcttaatttctctttctcaaagtctcttagttactcaatatgggtaaagagaaggttcacatcaatatcgttgtcattggccatgtcgactctgggaagtcgaccaccactggtcacctgatttacaagcttggtggtattgacaagcgtgttattgagaggttcgagaaggaagctgctgagatgaacaagaggtcattcaagtatgcctgggtgcttgataaactgaaggctgaacgtgagcgtggtatcaccattgatattgccttgtggaagtttgagaccactaaatattactgcactgtgattgatgcccctggtcacagggactttatcaagaacatgatcactggtacctcccaggctgactgtgctgtcctgattatcgactccaccactggtggttttgaagccggtatttccaaggatgggcagacccgtgagcacgcattgcttgctttcacccttggtgttaagcaaatgatttgctgttgtaacaagatggatgctaccacacccaagtactccaaggctaggtatgatgaaatcgtgaaggaagtttcttcctacctcaagaaggttggttacaaccctgacaagattccctttgttcccatctctggtttcgagggggacaatatgattgagaggtctaccaaccttgactggtacaaggggccaaccctccttgaggctcttgaccagattaatgagcccaagaggcccacagacaaacccctacgtcttccacttcaggacgtttacaagattggtggtattggtaccgtccctgttggtcgtgttgaaactggtgtcctcaaacctggtatggttgtgacctttgggcctactggtctgacaactgaagtcaagtctgtagagatgcaccacgaagctctcctggaggcactccccggtgacaatgttgggttcaatgttaagaatgttgctgttaaggatctcaagcgtggttatgttgcctcaaattccaaggatgacccagccaaaggggctgccagtttcacctcccaggtcatcatcatgaaccatcctggtcagattggaaatggatatgcaccagttcttgactgccacacttcccacattgctgtcaagttcgctgagatcttgaccaagattgacagacgttctggtaaggaacttgagaaggagcctaagttcttgaagaatggtgatgctggtatggttaagatgatgccgaccaagcctatggttgtggagacctttgccgagtacccaccattgggtcgttttgctgtgagggacatgcgccagactgttgctgttggtgtcatcaagagtgttgacaagaaggacccaactggtgccaaggttaccaaggccgcccagaagaaaaagtgaacagtgcagtgtaatgctggtatttccagtgctatctattatcgtcaagtgtgttgtgtagactctgttttattcagttcatctatagttttgtctttgattttaggttccagttctctgccttgtatgtcaggtagccattctcagaactgggtactcgacaggcggtggcgagcattactttgagtctgtcttcattgtgttgaggaggtgccttggatttccatggcagctcagtattttttctatttatgttgccttaagtacttaatttgagctttttaaaaatttctactttttgccttctttgagtggaagattagatgccttatacaatgcgtttgttgaagatactttatttgttaaa

SEQ ID NO: 595 - DNA, 2466 bp, Panicum virgatum
accctagcggcctcagcttcccacgccaattaccctccccgactccgccgtcacccgcgccgccgcctcctctgctcgccgtctaagcggtttaaggttcgcctgcagccatgggtaaggagaagtcccacatcaacatcgtggtcattggccacgtcgactctggcaagtcgaccaccaccggccacctgatctacaagcttggaggtatcgacaagcgtgtgatcgagaggtttgagaaggaagctgctgagatgaacaagcggtccttcaagtacgcgtgggtgcttgacaagctgaaggctgagcgtgagaggggtatcacaatcgatatcgccctgtggaagttcgagaccaccaagtactactgcactgtcattgatgcccccggacaccgtgacttcatcaagaacatgatcacgggtacctcccaggctgactgtgctgtccttatcattgactcaaccactggtggttttgaggctggtatctccaaggatggccagacccgtgagcatgctctccttgctttcactcttggagtgaagcagatgatctgctgctgcaacaagatggacgctaccactcccaagtactccaaggcccgttatgatgagatcgtgaaggaagtctcctcctacctgaagaaggtgggatacaaccctgataagattgcctttgtccccatctctggttttgagggtgacaacatgattgagaggtccacgaaccttgactggtacaaggggccaaccctgcttgaggctcttgaccagatcaacgagcccaagaggccttcagacaagcctctgcgtctcccccttcaggatgtgtacaagattggtggtattgggactgtgcctgttggccgtgtagagactggtatcatcaagcctggtatggttgttactttcggtcccagcggcctgactactgaggtgaagtctgttgagatgcaccatgaggctctccaggaggcccttcctggtgacaatgttggcttcaacgtgaagaacgttgctgtgaaggatctgaagcgtgggtatgtggcctccaactccaaggatgatcctgctaaggaggctgccagcttcacctcccaggtcatcatcatgaaccaccctgggcagattggcaacggttacgccccagtgctggactgccacacctcccacattgctgtcaagttcgccgagcttattaccaagattgacaggcgatctggcaaggagctagagaaggagcccaaattcctcaagaatggtgatgctggtatggtgaagatggttcccacaaagcccatggtggtggagaccttctctgagtaccctcctcttggtcgcttcgctgtccgtgacatgaggcaaacggttgctgttggagtcatcaagagcgtggagaagaaggacccaaccggagccaaggtgaccaaggctgctgccaagaagaaatgatgtggctggtggtttatccttatctgcttttgcgatacctagatgcctttttaccacataagttgtctggtgtcattgctgttacagtgaacttttaaggtctgctggaggtgtgcaatttgtatgtttggtgacttatttcagcttctgcaaaacttaaatgctctgagacttatgtgggcccttttgggtgtcgttaaatgtactgtcaggagttctctacttcatgcaatttttatctcgttagtgttttctcttctgatttgcattggattgttttttctgaagccttctagcaactatcttattttgatttgctcttttgatttgcatttgaattgttgtttgtgaagcaatggcttctccaattttcgttgacattgcctttatgtatctggtgaaggttgtttttgttatcctcagctgcagcctctacggtaacgtaatatttgttgtccgttggttcagggtaggtgttctatgtgcggtgtgatttgttccttgcggcatctccaagagttaggataccgggagttcaataaaaaaaagagataggatcccgggcccggccataaattaggcgggccgcacggccgctccgtttttagaaaggcaagtcaatctttcctcttcttgataaaagcaaaacttggtacctactgagactgtcaccatcagaaccagattagagcaactccaacagttcccaatctaaattcctcatccataattttttgggaaaaataaaaaagcttttccaacaattccccatcactcttccccattttaatcaacttggcaaaatcttctcacttatcgcgggaagaaatcacgagaggaatcgctggccgccgccacaagtcttcgtggtctacggcgtgctcttccgcggccgaccttctcgtctcctacgtcgccttcgccggccgcgcgtgggcgctgctcaggggacaccacctcgccacaagttttgattgttggggagaaaaaataagaaaatgttggagatgga

SEQ ID NO: 596 - DNA, 1810 bp, Panicum virgatum
aggcccatatcccgacgctgccgcccttctatataatgccccgaaccctagcggcctcaacccccacgccagtagcctccccattcctcccgccgtcacctgcccctctgcctcctccggtcgccgcctcagcggtttaaggttcacctgcagccatgggtaaagagaagtcccacatcaacatcgtggtcattggccacgtcgactctggcaagtcgaccaccaccggccacctgatctacaagcttggtggtatcgacaagcgtgtgattgagaggttcgagaaggaagctgctgagatgaacaagcggtccttcaagtacgcatgggtgcttgacaagctgaaggctgagcgtgagaggggtatcacaatcgatattgccctgtggaagttcgagaccaccaagtactactgcactgtcattgacgcccctggtcaccgtgacttcatcaagaacatgatcacgggtacctcccaggctgactgtgctgtccttatcattgactctaccactggtggttttgaggctggtatctccaaggatggccagacccgtgagcatgctctccttgctttcactcttggagtgaagcagatgatctgctgctgcaacaagatggacgctacaactcccaagtactccaaggcccgttatgatgagatcgtgaaggaagtctcctcctacctgaagaaggtgggatacaaccctgataagattgccttcgtccccatctctggttttgagggtgacaacatgattgagaggtccacgaaccttgactggtacaaggggccaaccctgcttgaggctcttgaccagatcaacgagcccaagaggccttcagacaagcctctgcgtctcccccttcaggatgtgtacaagattggtggtattgggactgtgcctgttggccgtgttgagactggtatcatcaagcctggtatggttgttaccttcggtcccagtggcctgactactgaggtgaagtctgttgagatgcaccatgaggctctccaggaggcccttcctggtgacaatgttggcttcaacgtgaagaacgttgctgtgaaggatctgaagcgtgggtatgtggcctccaactccaaggatgaccctgctaaggaggctgccagcttcacctcccaggtcatcatcatgaaccaccctgggcagattggcaatggttacgccccagtgctggactgccacacctcccacattgctgtcaagtttgccgagcttattaccaagattgacaggcggtctggcaaggagctagagaaggagcccaaattcctcaagaacggtgatgctggtatggtgaagatggttcccacaaagcccatggtggtggagaccttctctgagtaccctcctcttggtcgcttcgctgtccgtgacatgaggcaaacggttgctgttggagtcatcaagagcgtggagaaaaaggacccaaccggcgccaaggtgaccaaggctgctgccaagaagaaatgatgtgccgtgtggtttatcctgcagctgcttttgcgatacctagatgtcttttcattatcacagccgcttttgcgatacctagatgtcttttcattatcacataagttttgtctggtgtcattgctgttattgtgggaagttttaaggtctgctggcgttgtgccatttctttgtttagtgactatctggttactatttctgcttcggcaaaacttaaatgctctgagacctatgtggaaaccttatgcatattttttcgtgatttcttgttaatgtttgttctgatttgctttcggattgttttttctgaa

SEQ ID NO: 597 - DNA, 1800 bp, Panicum virgatum
aatagcccattccggtgccctagtgcactccttaaaacctagcttccatcccgtcccccacccaatccccagacgcagccgccacaaaccgggagagagcaagagccgtcacctgcgcctcctcctcccgccgccgccgccgccttcgcttcctcagccatgggtaaggagaagtcccacatcaacatcgtggtcattggccacgtcgactctggcaagtcaaccaccaccggccacctgatctacaagcttggaggcatcgacaagcgtgtgatcgagaggttcgagaaggaggctgcggagatgaacaagaggtccttcaagtacgcgtgggtgcttgacaagctcaaggccgagcgtgagagaggtatcaccattgatatcgccctgtggaagttcgagaccaccaagtactactgcacggtcattgatgcccctggacaccgtgacttcatcaagaacatgatcacgggtacctcccaggctgactgtgctgtccttatcattgactccaccactggtggttttgaggccggtatctccaaggatggccagacccgtgagcatgctctccttgctttcactcttggagtcaagcagatgatctgctgctgcaacaagatggatgccaccactcccaagtactccaaggcccgttatgatgaaattgtgaaggaagtctcctcctacctcaagaaggtcggctacaaccctgacaagatcgccttcgtccccatctctggttttgagggtgacaacatgattgagaggtccacaaaccttgattggtacaagggcccaaccctgcttgaggctctggaccagatcaatgagcccaagagaccttcggacaagcccctgcgtctcccccttcaggatgtgtacaagattggtggtattggaactgtccctgttggccgtgttgagaccggtatcatcaagcctggtatggttgttacctttggtcccagcggcctgactactgaggtgaagtcagttgaaatgcaccacgaggctctccaggaggcccttcctggtgacaatgttggcttcaacgtgaagaacgttgctgtgaaggatctgaagcgtgggtatgtggcctccaactccaaggatgaccctgctaaggaggctgcaagcttcacctcccaggtcatcatcatgaaccaccctgggcagatcggcaatggctatgccccagtgctggactgccacacctcccacatcgctgtcaagttcgctgagctcattaccaagatcgacaggcgatctggtaaggagcttgagaaggagcccaagttcctcaagaacggtgacgccggaatggtcaagatggttcccaccaagcccatggtggtggaaaccttctctgagtaccctcctcttggtcgctttgctgtccgtgacatgaggcaaacggtcgctgtgggagtcatcaagagtgtggagaagaaggaccccaccggcgccaaggtgaccaaggctgctgccaagaagaaatgatgggcctggtggtttatcctgcgtctgcttttgcgatacctagatacatttccgttataccataagttttgtctgcggttgttggtgttgtcgtgtgaacttttagtgtctgctggccgtgtgccatttgtatcattaggtactgttatttcagctagggtgaaacttgaatgctctaagacctatggtgtacccttttgggtgtcgttaaacgtatttctcatgagtcgtctctaacagtatgtcgttaaatgcattttgtttcgtttaatttttattgcttgctcttctgattta

SEQ ID NO: 598 - DNA, 1892 bp, Panicum virgatum
cggcccaacagcccattccttgtgccctagcgcacctccataaaaacctagcaccatcccgtcctcaaaccccacccagagccagccgccgcagaccgacccgaggcgagcacacgcaaggggcgagccgccgacgctccttcagatcctcggcgagccgtgactggccctctgctgctgtccgccgagcggtttgaacatcacctgcagccatgggtaaggagaagtcccacatcaacattgtggtcattggccatgtcgactccggcaagtcgaccaccaccggccacctgatctacaagcttggaggcattgacaagcgtgtgatcgagaggttcgagaaggaggctgctgagatgaacaagcggtccttcaagtacgcgtgggtgctcgacaagctcaaggctgagcgtgagaggggtatcaccattgatattgccctgtggaagttcgagaccaccaagtactactgcactgtcattgatgcccctggacaccgtgacttcatcaagaacatgatcacgggtacctcccaggctgactgtgctgtccttatcattgactccaccactggtggttttgaggctggtatctccaaggatggccagacccgtgagcatgctctccttgctttcactcttggagtcaagcagatgatctgctgctgcaacaagatggatgccaccactcccaagtactccaaggcccgttatgatgagattgttaaggaagtctcctcctacctgaagaaggtgggatacaaccctgacaagatttccttcgtccccatctctggttttgagggtgacaacatgattgagaggtccaccaaccttgactggtacaagggcccaaccctgcttgaggctcttgaccagatcaacgagcccaagaggccttcggacaagcccctgcgtctcccccttcaggatgtgtataagattggtggtattggaactgtccctgttggccgtgtcgagactggtatcatcaagcctggtatggttgttacctttggtcccagcggtctgactactgaggtcaagtctgttgagatgcaccacgaggctctacaggaggctcttcctggtgacaatgttggcttcaacgtgaagaatgtcgctgtgaaggatctgaagcgtgggtatgtggcctccaactccaaggatgaccctgccaaggaggctgccagcttcacctcccaggtcatcatcatgaaccaccctggacagattggcaatggctatgccccagtgctggactgccacacctcccacatcgccgtcaagtttgctgagctcattaccaagattgacaggcgatctggtaaggagcttgagaaggagcccaagttcctcaagaatggtgatgctggtatggtcaagatggttcccaccaagcccatggtggtggagaccttctctgagtaccctcctcttggtcggtttgctgtccgtgacatgaggcaaaccgttgctgttggagtcatcaagagtgtggagaagaaggacccgaccggtgccaaggtgaccaaggctgctgccaagaagaaatgatgtgcctggtggtttatcctgcgtctggttttgtgataccttacctttgcattatcccataagttgctgctgtcgggtgaacttttaattgctgctggcggtgtgccatttgtatgtttaggtaccgtgttatttcagcttgggcgaaacttttgctagacctatggtgtgcccttttgggcgtcgttaaacgtattatcagagtcatctcgttatctgtatgcattttgcttaagttttctttttattgtttgctcgtctgatttgcatttgggttggggctttggtttctgaagccttcctggagccttttcttactagtgtttgccctcctga

SEQ ID NO: 599 - DNA, 2119 bp, Panicum virgatum
cggttagtcttcacctgcagccatgggtaaggagaagtcccacatcaacatcgtggtcattggccacgtcgactctggcaagtcaaccaccaccggccacctgatctacaagcttggaggtatcgacaagcgtgtgatcgagaggttcgagaaggaggctgcggagatgaacaagaggtccttcaagtacgcgtgggtgcttgacaagctcaaggccgagcgtgagagaggtatcaccattgatatcgccctgtggaagtttgagaccaccaagtactactgcaccgtcattgatgcccctggacaccgtgacttcatcaagaacatgatcacgggtacctcccaggctgactgtgctgtccttatcattgactccaccactggtggttttgaggctggtatctccaaggatggccagacccgtgagcatgctctccttgctttcactcttggagtcaagcagatgatctgctgctgcaacaagatggatgccaccacccccaagtactccaaggcccgttatgatgagattgttaaggaagtctcctcctacctgaagaaggttggctacaaccctgacaagatcgccttcgtccccatctctggttttgagggtgacaacatgattgagaggtccaccaaccttgactggtacaagggcccaaccctgcttgaggctcttgaccagatcaacgagcccaagaggccttcggacaagcccctgcgtctcccccttcaggatgtgtacaagattggtggtattggaactgtccctgttggccgtgttgagaccggtatcatcaagcctggtatggttgttacctttggccccagcggcctgactactgaggtgaagtctgttgagatgcaccacgaggctctccaggaggcccttcctggtgacaatgttggcttcaacgtgaagaatgttgctgtgaaggatctgaagcgtgggtatgtggcctccaactccaaggatgaccctgccaaggaggctgccagcttcacctcacaagtcatcatcatgaaccaccctgggcagatcggcaacggctatgccccagtgctggactgccacacctcccacattgctgtcaagtttgctgagctcattaccaagattgacaggcgatctggtaaggagcttgagaaggagcccaagttcctcaagaatggtgatgctggtatggtcaagatggttcccaccaagcccatggttgtggagaccttctctgagtaccctcctcttggtcgcttcgccgtccgtgacatgaggcaaacggttgctgttggagtcatcaagagcgtggagaagaaggaccctaccggcgccaaggtcaccaaggctgcagccaagaagaaatgatgtgtctggtggttgatagcgtacctagatgcgttattgtcgcttaagttttgttcatggtcattgctgttatctcgtgaactctcagctggcaatgtgtgccctcagtctgtgtgtcgttcgcatacggttttaatattttatttggcaaaacttaaattacctgccactgatttgtgctactgtccctgttggccgtgttgagaccggtatcatcaagcctggtatggttgttacctttggtcccagcggcctgactactgaggtgaagtcagttgaaatgcaccacgaggctctccaggaggcccttcctggtgacaatgttggcttcaacgtgaagaacgttgctgtgaaggatctgaagcgtgggtatgtggcctccaactccaaggatgaccctgctaaggaggctgcaagcttcacctcccaggtcatcatcatgaaccaccctgggcagatcggcaatggctatgccccagtgctggactgccacacctcccacatcgctgtcaagttcgctgagctcattaccaagatcgacaggcgatctggtaaggagcttgagaaggagcccaagttcctcaagaacggtgacgccggaatggtcaagatggttcccaccaagcccatggtggtggaaaccttctctgagtaccctcctcttggtcgctttgctgtccgtgacatgaggcaaacggtcgctgtgggagtcatcaagagtgtggagaagaaggaccccaccggcgccaaggt

SEQ ID NO: 600 - DNA, 1345 bp, Panicum virgatum
catgggtaaggagaagtcccacatcaacatcgtggtcattggccacgtcgactctggcaagtcaaccaccaccggccacctgatctacaagcttggaggtatcgacaagcgtgtgatcgagaggttcgagaaggaggctgcggagatgaacaagaggtccttcaagtacgcgtgggtgcttgacaagctcaaggccgagcgtgagagaggtatcaccattgatatcgccctgtggaagtttgagaccaccaagtactactgcaccgtcattgatgcccctggacaccgtgacttcatcaagaacatgatcacgggtacctcccaggctgactgtgctgtccttatcattgactccaccactggtggttttgaggctggtatctccaaggatggccagacccgtgagcatgctctccttgctttcactcttggagtcaagcagatgatctgctgctgcaacaagatggatgccaccacccccaagtactccaaggcccgttatgatgagattgttaaggaagtctcctcctacctgaagaaggttggctacaaccctgacaagatcgccttcgtccccatctctggttttgagggtgacaacatgattgagaggtccaccaaccttgactggtacaagggcccaaccctgcttgaggctcttgaccagatcaacgagcccaagaggccttcggacaagcccctgcgtctcccccttcaggatgtgtacaagattggtggtattggaactgtccctgttggccgtgttgagaccggtatcatcaagcctggtatggttgttacctttggccccagcggcctgactactgaggtgaagtctgttgagatgcaccacgaggctctccaggaggcccttcctggtgacaatgttggcttcaacgtgaagaatgttgctgtgaaggatctgaagcgtgggtatgtggcctccaactccaaggatgaccctgccaaggaggctgccagcttcacctcacaagtcatcatcatgaaccaccctgggcagatcggcaacggctatgccccagtgctggactgccacacctcccacattgctgtcaagtttgctgagctcattaccaagattgacaggcgatctggtaaggagcttgagaaggagcccaagttcctcaagaatggtgatgctggtatggtcaagatggttcccaccaagcccatggttgtggagaccttctctgagtaccctcctcttggtcgcttcgccgtccgtgacatgaggcaaacggttgctgttggagtcatcaagagcgtggagaagaaggaccctaccggcgccaaggtcaccaaggctgcagccaagaagaaatga

SEQ ID NO: 601 - DNA, 1815 bp, Amorphophallus konjac
ctagctctcctgctgctgccacaggacctgatctcttctttggctgttgcacgttaagacataatgggtaaggagaaggtacacatcaacattgtggtcattggccatgtcgactctggaaagtcgaccacaactggacatctgatctacaagcttggtggcattgataagcgtgtaattgaaagatttgaaaaggaagctgctgagatgaacaagaggtcattcaagtatgcttgggtgcttgacaagctgaaggctgagcgtgagcgtggtattacgattgatattgctctctggaaattcgagaccacaaaatactactgcaccgtgatcgatgcgccggggcacagagatttcatcaagaatatgatcacaggaacttctcaagcagactgtgcagttctcattatcgattccactactggtggttttgaagctggcatttccaaggacggtcagactcgcgagcatgcgctgcttgctttcacacttggagtgaagcagatgatttgttgttgcaacaagatggatgccaccactcccaagtattcaaaggcaaggtatgatgaaatcgtgaaggaggtgtcatcttacctcaagaaggtggggtacaaccctgataagatcccattcgtcccgatctccggatttgagggcgacaacatgattgagaggtccaccaacctcgactggtacaaggggcccactctactcgaagccttggacttgatccaggagccaaagcgccctacggacaagccccttcgccttccccttcaggatgtctacaagattggaggcatcgggactgtgcccgtgggccgtgttgaaactggagtcctcaagcctggtatggtcgtcacctttggcccgactggcctgaccactgaagtcaagtctgttgagatgcatcatgaagccctcccggaggccctccccggtgacaacgtgggcttcaacgtcaagaacgttgctgtgaaggatctgaagcgtggtttcgtggcatccaactccaaggatgaccccgctaaggaggccgcgaacttcacctcccaggtcatcatcatgaaccacccgggccagatcggcaatggctacgccccggtccttgactgccacacctcacacattgccgtcaagtttgcggagatcctgacaaagatcgataggcgttctggtaaggagctggagaaggagcccaagttcctgaagaatggcgatgctgggtttgtgaagatgatccccaccaagcccatggtggtggagactttctccgagtaccccccacttggtaggtttgccgtgagggacatgaggcagacggtcgcggtcggtgtcatcaaggccgtggagaagaaggatccaagcggcgccaaggtgaccaaggctgcccagaagaagaagtgaaccgaaaccgtattgctgctctctgcacctacggtggtggtggttgttgagcctacttccattttatgtcgtcgtcgtcgtcgtcgcagtgtcaagtgtgctagttttgctttttgtgtgttgtccgtggatttcctgtccagcatttggatgcagaactgggttctagactggcggtggcaggggtaaaagaagagggctttgattgcttgcccctgcggcgttcagcccttacgctttggccaccacctcttctctttcattcgagtcatttttctgttgtgcttttattgttgatgcggtctgcagactttttacatccatcaatgcctttctgatttctgtctagtgaattttgagtgctcaatggtaagtgataactggccacataagtatagtttactgtgg

SEQ ID NO: 602 - DNA, 1855 bp, Amorphophallus konjac
ctcctcccccactatataagaacgtctcgcagcaggagaagccctcccactctagagaggcggctagctctcctgctgctgccacgggacctgatctcttctttggctgttgcacgttaagacataatgggtaaggagaaggtacacatcaacattgtggtcattggccatgtcgactctggaaagtcgaccacaactggacatctgatctacaagcttggtggcattgataagcgtgtaattgagagatttgagaaggaagctgctgagatgaacaagaggtcattcaagtatgcttgggtgcttgacaagctgaaggctgagcgtgagcgtggtattacgattgatattgctctctggaaattcgagaccacaaaatactactgcaccgtgatcgatgcgccggggcacagagatttcatcaagaacatgatcacaggaacttctcaagcagactgtgcagttctcattatcgattccactactggtggttttgaagctggcatttccaaggacggtcagactcgcgagcatgcgctgcttgctttcacacttggagtgaagcagatgatttgttgttgcaacaagatggatgccaccactcccaagtattcaaaggcaaggtatgatgaaatcgtgaaggaggtgtcatcttacctcaagaaggtggggtacaaccctgataagatcccattcgtcccgatctccggatttgagggcgacaacatgattgagaggtccaccaacctcgactggtacaaggggcccactctactcgaagccttggacttgatccaggagccaaagcgccctacggacaagccccttcgccttcccctccaggatgtctacaagattggaggcatcgggacggtgcccgtgggccgtgttgaaactggagtcctcaagcctggtatggtcgttacctttggcccgactggcctgaccactgaagtcaagtctgttgagatgcatcatgaagccctcccggaggccctccccggtgacaacgtgggcttcaacgtcaagaacgttgctgtgaaggatctgaagcgtggtttcgtggcatccaactccaaggatgaccccgctaaggaggccgcgaacttcacctcccaggtcatcatcatgaaccacccgggccagatcggcaatggctacgccccggtccttgactgccacacctcacacattgccgtcaagtttgcggagatcctgacaaagatcgataggcgttctggtaaggagctggagaaggagcccaagttcctgaagaatggcgatgctgggtttgtgaagatgatccccaccaagcccatggtggtggagactttctccgagtaccccccacttggtaggtttgccgtgagggacatgaggcagacggttgcggtcggtgtcatcaaggccgtggagaagaaggatccaagcggcgccaaggtgaccaaggctgcccagaagaagaagtgaaccgaaaccgtattgctgctctctgcacctacggtggtggtggtggttgttgagcctacttccattttatgtcgtcgtcgtcgtcgcagtgtcaagtgtgctagttttgcttattgtgtgttgtccgtggatttcctgtccagcatttggatgcagaactgggttctagactggcggtggcaggggtaaaaagaagagggctttgattgcttgcccctgcggcgttcagcccttacgctttggccaccacctcttctctttcattcgagtcatttttctgttgtgcttttattgttgatgcggtctgcagactttttacatccatcaatgccttgtctgatttctgtctagtgaattttgagtgctcaatggtaagtgataactg

SEQ ID NO: 603 - DNA, 2470 bp, Aristolochia fimbriata
cccaattacgaaactcggaaagaaagggacgtattttggtataagtgatagatagatgccgtcgttcggtatgttccggagcttccggttccccaaatatcttcttttaatttaattggcgaaaaggccctcgtctaattgacttataagcggggtgtttaggtctattctgcagctatatatcgaaacttggctagggttttgggtccagttcgctgacattttgccagttccctgttactgctcgaggctgcagcttggcttagcaccgcgtttcagtgatgggtaaggagaaggtacacattaacattgtggtcattggccatgtcgactctggtaagtcgacaaccactggtcaccttatctacaagcttggtggtattgacaagcgtgtgattgagaggtttgagaaggaagctgctgagatgaacaagaggtcattcaagtatgcttgggtccttgacaagctaaaggctgagcgggagcgtggaatcaccattgacattgccctctggaagtttgaaaccaccaagtattactgcactgtcattgatgcccctggccatcgtgatttcatcaagaacatgattactggtacatcacaggctgattgtgcagtcctcattattgactctacaactggtggttttgaggctggaatttccaaggatggtcaaactcgtgagcatgcattgcttgccttcacgttgggagtgaagcagatgatctgctgctgtaacaagatggatgcaacaactcccaagtattccaaggcaaggtatgatgagattgtgaaggaagtttcatcttacttgaaaaaggtcggatacaatcctgataagatcccatttgttcccatatctggttttgagggagacaacatgattgagcgttcaaccaaccttgactggtacaagggtcccacactcctcgaggctcttgaccagatcaatgagccaaagaggcctacagacaagccccttcgacttcctcttcaggatgtttacaagattggtggcattggcactgtacctgttggacgtgttgaaactggtgtcctgaagcctggaatggttgttacatttggcccctctggtttgaccactgaagtcaagtccgtggagatgcatcatgaagccctccaagaagctctacccggtgacaacgttggatttaatgtgaagaatgttgccgtgaaggatctgaagcgtgggtttgttgcctcaaattccaaggatgatccggcaaaggaggctgccaactttacatcccaggttatcatcatgaaccaccctggacaaattggaaatggttatgctcctgtccttgattgccacacatcacacattgctgtgaagtttgctgaaattttgaccaagattgaccgaaggtctgggaaggagcttgagaaggaacctaagttccttaagaacggagatgctggttttgtgaagatgattcccaccaagcccatggttgtggaaacattttctgaataccctcccctcggtcggtttgctgttagggatatgagacagacagttgctgttggtgtcattaagagtgtggagaagaaggatccttccggtgctaaggtcacgaaatctgcaaccaagaagaaatgaatagggttggttggtttgacatcagttgttatgatgtcttttagtagtatggtgtgtttttgttactgtgtcattcagtcagcctctgcggtttcgagcattaggatgcagaactgggtgcttgaccgacggtggcgaggtaagtcgtgtgtcacttaattcgcagaggaccagttaagtattttcggttttgctactccgcagtagtcattcagtttctaattttatgtactgctttggatttgacgttttacgaatgagtctttggtttaataaatattgtcttacagtggcatcttgtgtggttgtgtactagcttttctattatgcttgatatcttctcatctattttctgcttttaagactgtctcatgaatgggggtgtaccgaatatatatgaagcatcatccgatccttgagacgattaaaagcagactgcgtcttctcatattatcatgcatcttgtcgtctttcaacgtgtttcccactgactgagctttcatgatctccttgcttcatattaagatgtacgtgtacggtttgtcggttattctatcagaggtgactttggcttgttacctaatggctctgcaatttttgcaaattgggttgtcgaccatgctaaatctgttctgagcaacggatgtaagcactgttatggctccttgtgattaaagtattatatttgaggatgcgtgtgcatgtaggtgggacctatactgatttcctttcctgatggttttattaagatttccctgattacacaatcctagctgcgtcgagggatggaattaactcgtgtggtttaggaatgagatccgaggtgcgcgtgaaacatccaaatg

SEQ ID NO: 604 - DNA, 2095 bp, Cannabis sativa
caacaagatgatgcgcacgttacggcgtgtgagatacaaagccctgctacatacttagcaatacataatatccaccgttggatcagatccctaattatctaacggttgagaaagaaaccctagccacagtcgaagggcactaaagttctcctttaaattctcaaacttcgctcattcatcatcctctgctttctctcgcttctcacaacccaagtcggcgagagactctaattcttcatcttcacttcgaggtacttttcagcttttcagaatgggaaaagaaaaggttcatatcaacatcgtggttattggccatgtcgactcaggaaagtcgaccaccactggtcatttgatctataagcttggaggtattgacaagcgtgtgatcgagaggttcgagaaggaggctgctgagatgaacaaaaggtcattcaagtacgcatgggtgttggacaagcttaaggctgagcgtgagcgtggtattaccattgatattgccttgtggaagtttgagaccaccaagtactactgcactgtcatcgatgccccaggacatcgtgactttatcaagaacatgattactggtacctcccaggctgattgtgctgtcctcattattgactctaccactggaggttttgaggctggtatttccaaggatggacagactcgtgagcatgctttgcttgctttcactcttggtgtgaagcagatgatttgctgttgtaacaagatggatgccaccacccccaagtactctaaggctaggtacgatgaaatcgtcaaggaggtttcttcatacttgaagaaggttggatacaaccccgacaaaattgccttcgtccccatctctggtttcgagggtgacaacatgattgagaggtctaccaaccttgactggtacaagggaccaactcttctcgaggctcttgacaacatcaacgagcccaagaggcccacagacaagcccctccgtctaccccttcaggatgtttacaagatcggtggtattggaactgtgccagtgggacgtgttgagactggtgtcatcaagcccggtatggttatcaccttcggcccaactggtctgactactgaggtcaagtccgttgagatgcaccacgaggctcttctcgaggctcttcctggtgacaatgtcggattcaatgtcaagaatgttgctgtcaaggatctcaagagaggtttcgttgcctcaaactccaaggatgaccccgcaaaggaagctgccaacttcacatcccaagtcatcatcatgaaccaccctggtcagatcggtaacggttacgcaccagtgctggattgccacacctctcacattgctgttaagttcgccgaacttcaaaccaagatcgacaggcgttcaggaaaggagctcgagaaggagcccaagtttttgaagaacggagatgccggtattattaagatggttcccaccaagcccatggttgttgagactttctccgagtacccaccactcggtcgtttcgccgtgagggacatgcgtcagaccgtggctgttggagtcatcaaggctgtggagaagaaggacccatcaggtgccaaggtgaccaagtccgccgccaagaagaagtgaagtgttactgtttaggaaggagctttttatagttaggctagttttgtttctggtgtctttgcctttttcgatttcgttttgctttaatatgcggacaattatatgggttagcattgcaagttttactagccttgtttttcaaggttggtttagcttttgatgtcgacttttgttttcctattattgtttttttttgtttaaacttttgggttttaatatcattgagaattgagttgtctagttgattgtcgatgaacaactacatttaaattttaaagtgttatattttcttttagtttcttttattatttttaattatttaatccttaaatgttatttttgtcactttttttgaattttttgaaaactaaacttatttagatttatgatagtggtggaggattcgtacgcttatatttatgtttataatgtttagaaactctaaatgtgagttctgtataaatatgtggccgtcttttt

SEQ ID NO: 605 - DNA, 1501 bp, Gossypium hirsutum
ctgtaagagcttcatggtgccatcctcaactgacttaactcagttgtcggaccagacggccaaaggtcacaaccataccagttcttcattttcattttcttgttccttccttcgccgtctattgcttttagttgcctcgatttcaagtgaatcagaatgggtaaggaaaagactcacattaacattgtggtcatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccaccaaatactactgcactgtgattgatgcacctggacaccgtgactttatcaagaatatgattactggtacgtcacaggctgactgtgctgttttgattattgattccaccactggtggttttgaggctggtatctcaaaggatggtcagactcgtgagcacgcattgcttgcttttacccttggtgtcaagcaaatgatttgctgttgcaacaagatggatgccactacccctaaatactcgaaggctaggtatgatgaaattgtgaaggaagtctcttcctacttgaagaaggtgggatacaaccctgacaagattccatttgttcccatttctggttttgagggtgacaacatgattgagaggtctaccaacttggactggtacaagggccctactcttcttgaggctcttgaccagatcaacgagcccaagaggccttcagacaagcctctccgtctcccacttcaggatgtgtacaagattggtggtattggaactgttccagtcggccgtgttgaaaccggtgtcttgaagcctggtatggttgtgacctttggcccgtctggtctgacaactgaagttaagtcagttgagatgcaccatgaagctcttacagaagcacttcccggtgataatgttgggttcaatgttaaaaacgttgctgttaaggatctcaagcgtggttttgttgcatccaactccaaggatgaccctgctaaggaggctgccaacttcacttctcaggtcatcattatgaaccaccctggacaaattgaaaatggatatgtcccagtccttgactgccacacgtcacacattgctgttaagtttgctgagcttttgaccaagattgacaggcgatctggtaaggagcttgagaaggaacccaagttcttgaagaacggtgatgctggtatgattaagatgattcctaccaagcccatggttgtggagaccttctctgagtacccacccctggttcgttttgctgtgagggacatgcgtcagaccgtggctgttggtgttatcaagagtgtcgagaagaaggacccaaccggtgccaaggtcaccaagtctgctgctaagaagaagtgaa

SEQ ID NO: 606 - DNA, 1570 bp, Cynodon dactylon
atgggtaaggagaagagtcacatcaacattgtggtcattggacatgtcgactctgggaagtcgaccaccactggccacctgatctacaagcttggaggtatcgacaagcgtgtgatcgagaggttcgagaaggaggctgccgaaatgaacaagaggtccttcaagtacgcatgggtgcttgacaagctcaaggctgagcgtgagagaggtatcaccatcgatattgccctgtggaagtttgagaccaccaagtactactgcaccgtcattgatgcccctggacaccgtgacttcttcaagaacatgatcaccggtacctcccaggctgactgtgccgtccttatcattgactccaccactggtggttttgaggctggtatctccaaggatggtcagacccgtgagcatgctctccttgctttcactcttggagtgaagcagatgatttgctgctgcaacaagatggatgccaccacacccaagtactcgaaggcccgttatgatgagattgtgaaggaagtctcttcctacctcaagaaggtcggctacaaccctgacaagatccccttcgttcccatctctggtttcgagggagacaacatgattgagaggtccaccaaccttgactggtacaagggcccaaccctgcttgaggctcttgaccagatcaacgagcccaagaggccctcggacaagcccctgcgtctcccccttcaggatgtgtacaagattggtggtattggtactgtccctgttggtcgtgttgagactggtgtcctgaagcctggtatggttgtgacctttggtcccagcggcctgaccactgaggtcaagtctgttgagatgcaccatgaggctcttcaggaggcacttcctggtgacaatgtgggattcaacgtgaagaatgttgctgtgaaggatattaagcgtggctatgttgcctccaactccaaggatgaccctgccaaggaggctgccagcttcacctcccaggtcatcatcatgaaccaccctggacagattggcaacggctatgccccagtgctggactgccacacctcccacattgctgtcaagtttgctgagctgctgaccaagattgacagacgatctggcaaggagcttgagaaggagcccaagttcctgaagaacggtgatgctggtatggtgaagatgattcccaccaagcccatggtggtggagaccttctctcagtaccctcctcttggacgttttgctgtacgtgacatgaggcagactgttgctgttggagtcatcaagagtgttgagaagaaggacccgaccggcgccaaggtgaccaaggctgctgccaagaagaaatgatgtatctggtggttggtttcgtacctgctttttggataccttgatacttcagtactatcgcttaagttttgtcatggccattgcttttgttgtttgggtttaatttctgttggcaatgtgtccgtggtctgtcgtttaagtactctgttattttggctttggcgaaacattgatgtcgttaaacaaaaacatggatatctttataaatctaccttattttgagtgg

SEQ ID NO: 607 - DNA, 1708 bp, Eschscholzia californica
tagggttttactgaggcgttctctcttctctccaagctattcatcatgggtaaggaaaagattcatatcagtattgttgtcattggacatgtcgactctggaaagtcgaccactactggtcacttgatctacaagttgggtggtattgacaagcgtgttatcgaaagattcgagaaggaagctgctgagatgaacaagaggtcattcaagtatgcatgggttcttgacaagcttaaggctgaacgtgagcgtggtattactattgatattgccttgtggaagtttgagaccaccaaatactactgcactgttattgatgctcctggtcatcgtgatttcatcaagaacatgattactggaacctctcaggctgattgtgccgtcctcatcattgactccaccactggaggttttgaagctggtatctcaaaggatggacagacccgtgagcatgctcttcttgctttcacccttggtgtcaagcaaatgatttgctgttgtaacaagatggatgccaccactcccaagtactctaaggcaaggtacgaggaaatcgttaaggaagtgtcttcttacttgaagaaggttggatacaacccagacaaaattgcttttgttcccatctctgggttcgaaggtgacaacatgattgaaaggtcaaccaaccttgactggtacaagggaccaacccttcttgaggctcttgaccaaatcaatgagcccaaaaggccctcagacaagccactccgtctaccacttcaggatgtctacaagattggtggtattggaactgtgccagtcggacgtgttgaaactggtgtcatcaagcctggtatggttgtcacttttggaccaactggtttgaccactgaagttaagtctgtggagatgcaccatgaagcactccaagaagctcttccaggtgacaatgtcggattcaatgttaagaatgttgctgtcaaggatctcaagcgtggtttcgttgcttccaactcaaaggatgaccctgctcgtgaagctgccaacttcacctcccaagtcatcatcatgaaccacccaggtcaaatcggtaacggttatgctccagttctcgattgccacacttctcacattgctgttaagtttggtgagatccttaccaagattgacagacgttctggaaaggagctcgagaaagaacccaagttcttgaagaacggtgatgctggtatggttaagatgcttccaaccaaacccatggttgtcgagaccttcgctgaatacccacctcttggacgttttgctgttcgtgacatgcgtcaaactgttgctgttggtgttatcaagagtgtggagaagaaggatccatctggtgctaaggtgaccaagtctgccgccaagaagaagtgaatcgtgctggttcgtgatgcttcgttcagagttcgttcgtatttctactactataataaggattgggtactttttagtcgtgtcgtgaaaagtttatgttttgtctgctgtggtagcagtccattgccgtctccgtcattaagcagccgttctcagaattgggtgcttgatcggcggtggcactggctattaccaatggatttaggttaacgtcttttaattttcgaagttggattttgaggtctcaagtttaatgtgtttgaacggtaacctggtattcagtagtttttaggtattttgtgatactgaatatgcaggt

SEQ ID NO: 608 - DNA, 1877 bp, Eschscholzia californica
gcggaagttaacgagcattagaaatagagatatagctttatctacgagggtattttagtaatcacaagaaaaattctccttccaaatttcattataaaaactagaccttcgctctcaaaccctattcttctaagtttttcgcctctcatttcttcagctcgctagggttttactgaggcgttctctcttctctccaagctattcatcatgggtaaggaaaagattcatatcagtattgttgtcattggacatgtcgactctggaaagtcgaccactactggtcacttgatctacaagttgggtggtattgacaagcgtgttatcgaaagattcgagaaggaagctgctgagatgaacaagaggtcattcaagtacgcatgggttcttgacaagcttaaggctgaacgtgagcgtggtattactattgatattgccttgtggaagtttgagaccaccaaatactactgcactgttattgatgctcctggtcatcgtgatttcatcaagaacatgattactggaacttctcaggctgattgtgccgtcctcatcattgactccactactggaggttttgaagctggtatctcaaaggatggacagacccgtgagcatgctcttcttgctttcacccttggtgtcaagcagatgatttgctgttgtaacaagatggatgccaccactcccaagtactcaaaggcaaggtacgaggaaatcgttaaggaagtgtcttcttacttgaagaaggttggatacaacccagacaagattgcttttgttcccatctctgggttcgaaggtgacaacatgattgaaaggtcaaccaacctcgactggtacaagggaccaacccttcttgaggctcttgaccaaatcaatgagcccaagaggccctcagacaagccactccgtctaccacttcaggatgtctacaagattggtggtattggaactgtgccagtcggacgtgttgaaactggagtcatcaagcctggtatggttgtcacttttggaccaactggtttgaccactgaagttaagtctgtggagatgcaccatgaagcactccaagaagctcttccaggtgacaatgtcggattcaatgttaagaatgttgctgtcaaggatctcaagcgtggtttcgttgcttccaactcaaaggatgaccctgctcgtgaagctgccaacttcacctcccaggtcatcatcatgaaccacccaggtcaaatcggtaacggttatgcaccagttctcgattgccacacttctcacattgctgttaagtttggtgagatccttaccaagattgacagacgttctggaaaggagctcgagaaagaacccaagttcttgaagaacggtgatgctggtatggttaagatgcttccaaccaaacccatggttgtcgagacctttgctgaatacccacctcttggacgttttgctgttcgtgacatgcgtcaaactgttgctgttggtgttatcaagagtgtggagaagaaggatccatctggtgctaaggtgaccaagtctgctgccaagaagaagtgaatcgtgctggttcgtgatgcttcgttcagagttcgttcgtatttctactactataataaggattgggtactttttagtcgtgtcgtgaaaagtttatgttttgtctgctgtggtagccgtccattgccgtctccgtcattaagcagccgttctcagaattgggtgcttgataggcggtggcactggctattaccaatggtttaggttatgtcttttaattttcgaagttggattttgaggtctcaagtttaatgtgtttgaacagtaacctggtattcagtagtttttaggtattttgtgatactgaatatgcaggtggtattgtc

SEQ ID NO: 609 - DNA, 1678 bp, Eschscholzia californica
ctctcttctctccaagctattcatcatgggtaaggaaaagattcatatcagtattgtcgtcattggacatgtcgactctggaaagtcgaccactactggtcacttgatctacaagttgggtggtattgacaagcgtgttatcgaaagattcgaaaaggaagctgctgagatgaacaagaggtcattcaagtatgcatgggttcttgacaagcttaaggctgaacgtgagcgtggtattactattgatattgccttgtggaagtttgagaccaccaaatactactgcactgttattgatgctcctggtcatcgtgatttcatcaagaacatgattactggaacctctcaggctgattgtgccgtcctcatcattgactccaccactggaggttttgaagctggtatctcaaaggatggacagacccgtgagcatgctcttcttgctttcacccttggtgtcaagcaaatgatttgctgttgtaacaagatggatgccaccacacccaagtactctaaggcaaggtacgaggaaatcgttaaggaagtgtcttcttacttgaagaaggttggatacaacccagacaaaattgcttttgttcccatctctgggttcgaaggtgacaacatgattgaaaggtcaaccaaccttgactggtacaagggaccaacccttcttgaggctcttgaccaaatcaatgagcccaaaaggccctcagacaagccactccgtctaccacttcaggatgtctacaagattggtggtattggaactgtgccagtcggacgtgttgaaactggtgtcatcaagcctggtatggttgtcacttttggaccaactggtttgaccactgaagttaagtctgtggagatgcaccatgaagcactccaagaagctcttccaggtgacaatgtcggattcaatgttaagaatgttgctgtcaaggatctcaagcgtggtttcgttgcttccaactcaaaggatgaccctgctcgtgaagctgccaacttcacctcccaagtcatcatcatgaaccacccaggtcaaatcggtaacggttatgctccagttctcgattgccacacttctcacattgctgttaagtttggtgagatccttaccaagattgacagacgttctggaaaggagctcgagaaagaacccaagttcttgaagaacggtgatgctggtatggttaagatgcttccaaccaaacccatggttgtcgagacctttgctgaatacccacctcttggacgttttgctgttcgtgacatgcgtcaaactgttgctgttggtgttatcaagagtgtggagaagaaggatccatctggtgctaaggtgaccaagtctgctgccaagaagaagtgaatcgtgctggttcgtgatgcttcgttcagagttcgttcgtatttctactactataataaggattgggtactttttagtcgtgtcgtgaaaagtttatgttttgtctgctgtggtagcagtccattgccgtctccgtcattaagcagccgttctcagaattgggtgcttgatcggcggtggcactggctattaccaatgggtttaggttatgtcttttaattttcgaagttggattttgaggtctcaagtttaatgtgtttgaacagtaacctgctattcagtagtttttaggtgttttgtgatactgaa

SEQ ID NO: 610 - DNA, 1623 bp, Eschscholzia californica
ggcgtttctctcatttcttcttctccatcagcctagggtttaggcagccgttctctccactttagaagtaacgtagaatctactcgtcatgggtaaagagaagattcatatcagtattgtcgtcattggacatgtcgactccggaaagtcgactaccactggtcacttgatctacaagttgggaggtattgacaagcgtgttatcgaaagattcgagaaggaggctgctgagatgaacaagaggtcattcaagtatgcatgggttcttgacaagcttaaggctgaacgtgagcgtggtattaccattgatattgccttgtggaagtttgagaccaccaagtactactgcactgttattgatgccccgggacatcgtgatttcatcaagaacatgattactggtacctctcaggccgattgtgctgtcctcatcattgactccaccactggagggtttgaagctggtatctctaaggatggacagacccgtgagcacgctcttcttgctttcacccttggtgtcaagcagatgatctgttgttgtaacaagatggatgctactactcccaagtactccaaggcaaggtatgaggaaatcgttaaggaagtctcatcatacttgaagaaggttggatacaacccagacaaaatcgcctttgttcccatctctgggtttgagggtgacaacatgattgagagatccaccaacctcgactggtacaagggaccaaccctacttgaggctcttgaccaaatcaatgagccaaagagaccctcagacaagccactccgtcttccacttcaagatgtttacaagattggtggtattggaactgtgccagtgggacgtgttgagactggagtcatcaagcccggtatggttgtcacttttggtcccactggattgaccactgaggttaagtccgtggagatgcaccacgaggctctccaggaagcacttccaggtgacaatgttggattcaatgttaagaatgttgctgtcaaggatctcaagcgtggtttcgttgcctccaactccaaggatgacccagccagggaagcagccaacttcacctcccaggttatcatcatgaaccaccctggtcagatcggtaacggatatgctccagttcttgactgccacacctcccacattgctgtgaagtttggtgagatcctcaccaagatcgacaggcgatcaggaaaggagcttgagaaggaacccaagttcttgaagaatggtgatgctggtatggttaagatgcttccaaccaagcccatggttgttgagacttttgccgaatacccaccccttggtcgttttgctgttagggatatgcgacagacagttgctgtgggagtcatcaagagtgttgagaagaaggatccatcaggtgccaaggtcactaagtcagctgccaagaagaagtgaaccgtgcaggtcaaccgcacagtagatttcttcgaacttcattcctccttttatcataaagacctattactttttagttgtttcgtcaaactattatgttttgtttgttgtcgatgtagctctctgccgtcaccttctatctccagcctctatgagaactgggtgttagacaggcggtggcagttgttaca

SEQ ID NO: 611 - DNA, 1736 bp, Eschscholzia californica
gctcgctagggttttactgaggcgttctctcttctctccaagctattcatcatgggtaaagaaaagattcatatcagtattgttgtcattggacatgtcgactctggtaagtcgaccaccactggtcacttgatctacaagttgggtggtattgacaagcgtgttatcgaaagattcgagaaggaagctgctgagatgaacaagaggtcattcaagtatgcatgggttcttgacaagcttaaggctgaacgtgagcgtggtattactattgatattgccttgtggaagtttgagaccaccaaatactactgcactgttattgatgctcctggtcatcgtgatttcatcaagaacatgattactggaacctctcaggctgattgtgccgtcctcatcattgactccactactggaggttttgaagctggtatctcaaaggatggacagacccgtgagcatgctcttcttgctttcacccttggtgtcaagcagatgatttgctgttgtaacaagatggatgccaccactcccaagtactcaaaggcaaggtacgaggaaatcgttaaggaagtgtcttcttacttgaagaaggttggatacaacccagacaagattgcttttgttcccatctctgggttcgaaggtgacaacatgattgaaaggtcaaccaaccttgactggtacaagggaccaacccttcttgaggctcttgaccaaatcaatgagcccaagaggccctcagacaagccactccgtctaccacttcaggatgtttacaagattggtggtattggaactgtgccagtcggacgtgttgaaactggagtcatcaagcctggtatggttgtcacttttggaccaactggtttgaccactgaagttaagtctgtggagatgcaccatgaagcactccaagaagctcttccaggtgacaatgtcggattcaatgttaagaatgttgctgtcaaggatctcaagcgtggtttcgttgcttccaactcaaaggatgaccctgctcgtgaagctgccaatttcacctcccaagtcatcatcatgaaccacccaggtcaaatcggtaacggttatgcaccagttctcgattgccacacttctcacattgctgttaagtttggtgagatccttaccaagattgacagacgttctggaaaggagctcgagaaagaacccaagttcttgaagaacggtgatgctggtatggttaagatgcttccaaccaaacccatggttgtcgagacctttgctgaatacccacctcttggacgttttgctgttcgtgacatgcgtcaaactgttgctgttggtgttatcaagagtgtggagaagaaggatccatctggtgccaaggtgaccaagtctgctgccaagaagaagtgaatcgtgctggtccgtgatgcttcgttcagagttcgttcgtatttctactactataataaagattgggtactttttagtcgtgtcgtgaaaagtttatgttttgtctgctgtggtagcagtccattgccgtctccgtcattaagcagccgttctcagaattgggtgcttgataggcggtggcactggctattaccaatggtttaggtttatgtcttttaattttcgaagttggattttgaggtctcaagtttaatgtgtttgaacagtaacctggtattcagtagtttttaggtgttttgtgatactgaatatgcaggtggtattgtctttcaatttaaaac

SEQ ID NO: 612 - DNA, 1677 bp, Eschscholzia californica
ttctttttctcgcattggctaagggttttagacgaggcgctctagaagtatcttagcatctggtcaacatgggtaaagagaagattcatatcagtattgtcgtcattggacatgtcgactccggaaagtcgaccaccactggtcacttgatctacaagttgggaggtattgacaagcgtgttatcgaaagattcgagaaggaagctgctgagatgaacaagaggtcattcaagtacgcatgggttcttgacaagcttaaggctgaacgtgagcgtggtattaccattgatattgccttgtggaagtttgagaccaccaaatactactgcactgttattgatgccccaggacatcgtgatttcatcaagaacatgattactggtacctctcaggctgattgtgccgtcctcatcattgactccaccactggaggttttgaagctggtatctctaaggatggacagacccgtgagcacgctcttcttgctttcacccttggtgtcaagcagatgatctgttgttgtaacaagatggatgccactactcccaagtactcaaaggcaaggtacgaggaaatcgttaaggaagtctcatcttacttgaagaaggttggatacaacccagacaaaatcgcctttgttcccatctctgggtttgagggtgacaacatgattgagagatccaccaacctcgactggtacaagggaccaacccttcttgaggctcttgaccaaatcaatgagccaaagagaccctcagacaagccactccgtcttccacttcaggatgtttacaagattggtggtattggaactgtgccagtgggacgtgttgagaccggagtcatcaagcccggtatggttgtcacttttggtcccactgggttgaccactgaggttaagtccgtggagatgcaccacgaggctctccaggaagcacttccaggtgacaatgtcggattcaacgttaagaatgttgctgtcaaggatctcaagcgtggtttcgttgcctccaactccaaagatgacccagccagggaagcagccaacttcacctcccaggttatcatcatgaaccaccctgggcagatcggtaacggatacgctccagttcttgactgtcacacctcccacattgctgtgaagttcggtgagatcctcaccaagatcgacaggcgatcaggaaaggagctcgagaaggagcccaagtttttgaagaatggtgatgctggtatggttaagatgcttccaaccaagcccatggttgtggagacctttgctgagtacccacctctaggacgttttgccgtgagggacatgcgtcagactgttgctgtcggagtcatcaagagtgtcgagaagaaggacccatcaggtgccaaggtcactaagtctgctgccaagaagaagtaaattgtgaagctcaactgtggggtagatttcttcaaccttcatttttactattatcacaaagacttggtcctctttagtcttatcttgaaacggttatgtttagtttgttgtctttatggtcctctgccatctcctctttctagcctccatgagaattgggtgttagataggcggtgggagtcgttacatatgaacaatgtctgtctttaatatctggattttgttttcttttcaatttgagttttgaattgcagagttatgaact

SEQ ID NO: 613 - DNA, 1664 bp, Eschscholzia californica
ggcagccgttctctccactttagaagtaacgtagaatctactcgtcatgggtaaagagaagattcatatcagtattgtcgtcattggacatgtcgactctggaaagtcgaccaccactggtcacttgatttacaagttgggaggtattgacaagcgtgttatcgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcactgttattgatgccccaggacatcgtgatttcatcaagaacatgattactggtacctctcaggccgattgtgctgtcctcatcattgactccactactggaggttttgaagctggtatctctaaggatggacagacccgtgagcacgctcttcttgctttcacccttggtgtcaagcagatgatctgttgttgtaacaagatggatgccactactcccaagtactccaaggcaaggtatgaggaaatcgttaaggaagtctcatcatacttgaagaaggttggatacaacccagacaaaatcgcctttgttcccatctctgggtttgaaggtgacaacatgattgagagatccaccaaccttgactggtacaagggaccaacccttcttgaggcacttgaccagatcaatgagccaaagagaccctcagacaagccactccgtcttccacttcaggatgtttacaagattggtggtattggaactgtgccagtgggacgtgttgagactggagtcatcaagcccggtatggttgtcacttttggtcccactgggttgaccactgaggttaagtccgtggaaatgcaccacgaggctctccaggaagcacttccaggtgacaatgttggattcaatgttaagaatgttgctgtcaaggatctcaagcgtggttttgttgcctccaactccaaggatgacccagccagggaagctgctaacttcacctcccaggtcatcatcatgaaccatcctggtcagatcggtaacggatacgccccagtccttgactgccacacctctcacattgccgtgaagtttggtgagatcctcaccaagatcgacagacgatcaggaaaggagcttgagaaggaacccaagttcttgaagaatggtgatgctggtatggttaagatgcttccaaccaagcccatggttgtggagaccttcgctgagtacccacctctaggacgttttgccgtgagagacatgcgtcagaccgtcgctgtcggagtcatcaagagtgttgagaagaaggacccatctggtgccaaggtcaccaagtctgcagccaagaagaagtgaactcctactactagtagtagagcgactggttttgggatgtcagcagcagcagtaggagagaagagttttaagttttggttttatagttggtttgtgagtttctatttccgagttttgtcttgttttgtcttcattcagtttagcagtcagatgcagacctgggtgcttgaccgacggtggcgactggtgtgaacttgagttttttaagttagttttgaagatgttatttttgttatgttacttaatcttcgattaatgaaactgctgttatctg

SEQ ID NO: 614 - DNA, 1676 bp, Eschscholzia californica
cgctcccatttcttcatcttctgctaagagagtttcttgctggtaattcttcaatttcaacatgggtaaagagaagattcatatcagtattgtcgtcattggacatgtcgactctggaaagtcgaccaccactggtcacttgatctacaagttgggaggtattgacaagcgtgttatcgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcactgttattgatgccccaggacatcgtgatttcatcaagaacatgattactggtacctctcaggccgattgtgctgtcctcatcattgactccaccactggaggttttgaagctggtatctctaaggatggacagacccgtgagcacgctcttcttgctttcacccttggtgtcaagcagatgatctgttgttgtaacaagatggatgccactactcccaagtactccaaggcaaggtatgaggaaatcgttaaggaagtctcatcttacttgaagaaggttggatacaacccagacaaaatcgcctttgttcccatctctgggtttgaaggtgacaacatgattgagagatccaccaaccttgactggtacaagggaccaacccttcttgaggcacttgaccagatcaatgagccaaagagaccctcagacaagccactccgtcttccacttcaggatgtttacaagattggtggtattggaactgtgccagtgggacgtgttgagactggagtcatcaagcccggtatggttgtcacttttggccccactggattgaccactgaggttaagtccgtggagatgcaccacgaggctctccaggaagctcttccaggtgacaatgttgggttcaatgttaagaatgttgctgtcaaggatctcaagcgtggttttgttgcctccaactccaaggatgacccagccagggaagctgccaacttcacctcccaggtcatcatcatgaaccaccctggtcagatcggtaacggatatgctccagttcttgactgccacacctcccacattgctgtgaagttcggtgagatcctcaccaagattgacagacgatctggaaaggagcttgagaaggaacccaagttcttgaagaatggtgatgctggtatggttaagatgcttccaaccaagcccatggttgtggagaccttcgctgagtacccacctctaggacgttttgctgtgagggacatgcgtcagaccgttgctgtcggagtcatcaagagtgtcgagaagaaggacccatctggtgccaaggtcaccaagtctgctgccaagaagaagtgaactcctactactagtagtagagggactggttttgggatgtcagcagcagcagtaggagagaagagttttaagtttggtttatagttggtttgtgagttactatttgagtagttttatcttgttttgtcttcatttcagttgagcagtcagatgcagacctgggtgcttgaccgacggtggcgactggtgtgaacttgagtttttaaagttagttttgaagatgttatttttgttatgttacttaattttggattaatggaactgctgttat

SEQ ID NO: 615 - DNA, 1672 bp, Euphorbia peplus
gatattctctccgggctgctgctgataaggtgttgtagccgcctcctaaatctctgcataaggtatccaaaatgggtaaagagaaaattcacatcagtattgtggtcataggacatgtcgactccggcaagtccaccaccactggacatcttatctacaagcttggaggtattgacaagcgtgtcattgaaagatttgagaaggaagctgctgagatgaacaaaaggtcattcaagtatgcctgggtgcttgacaagcttaaggctgagcgtgaacgtggtatcaccattgatattgctttgtggaagtttgagaccaccaagtactactgcactgttattgatgctcctggacacagggatttcatcaagaacatgattactggaacttctcaggctgattgtgctgttcttatcattgattccaccactggtggttttgaggctggtatctctaaggatggccagactcgtgagcatgctctccttgctttcacccttggtgtcaagcagatgatctgctgttgtaacaaaatggatgctacaactcccaagtactccaaggccaggtatgaggaaattgtgaaggaagtgtcctcctacctcaagaaggttggatacaaccctgataaaattccattcgtgcccatctctgggttcgaaggtgacaacatgattgagagatcaaccaacctcgactggtacaagggacccactctgcttgatgctcttgaccagatcaatgagccaaagaggccatcagacaagcccctccgtttacctcttcaggacgtttacaagattggtggtattggaactgtgccagtgggtcgtgtggagactggggtcatcaagccaggtatggttgtgacctttggacccagtggactgaccactgaagttaagtctgttgagatgcatcacgaggctctgcaggaggctcttccaggtgacaatgtggggttcaatgtgaagaatgttgcagtgaaggatcttaagagaggttttgttgcatccaactcaaaggatgaccctgccaaggaagctgccaacttcacatctcaggtgatcatcatgaaccaccctggacagattggaaatggttatgcaccagtgttggattgccacacctcccatattgctgtgaagttctctgagatcctcaccaagattgatcgtcgatctggcaaggagcttgagaaggagcccaaatttttgaagaatggagatgctggtatgattaagatgattccaaccaagcctatggtggtagagacctttgctgagtacccaccattgggtcgttttgctgtgagagacatgagacaaacagttgctgttggtgtcatcaagagtgtggagaagaaggatccatctggagccaaggtcaccaagtctgctgccaagaagaagtgagatgtttctcgatgattgtttaccattggtgacaattttgagtaccaagtcttggtatttttttttatcttttattaaggtgttgaacaatagttttgctttatgtttagtgtatgctgctgctctttcattttgacattaggctatctgaatgcagcaattttcttggtataccattttgtggtggatgtttaaatttgaaaaactcgagttaattctgtttacttctgaagtttttgggcattgttctcctaact

SEQ ID NO: 616 - DNA, 1667 bp, Euphorbia peplus
tatcatcaggtatccaaaatgggtaaagagaaaattcacatcagtattgtggtcattggacatgtcgactctggcaagtccaccaccactggacatcttatctacaagcttggaggtattgacaagcgtgttattgaaagatttgagaaggaagctgctgagatgaacaaaaggtcattcaagtatgcatgggttcttgacaagcttaaggctgagcgtgagcgtggtatcaccattgatattgccctgtggaagtttgagaccaccaagtattactgcactgttattgatgctcctggacacagggatttcatcaagaacatgattactggaacttctcaggctgattgtgctgttcttatcattgattccaccactggtggttttgaggctggtatctctaaggatggtcagactcgtgagcatgctctccttgctttcacccttggtgtcaagcaaatgatctgttgttgcaacaaaatggatgcaacaactcccaagtactccaaggccaggtatgaggaaattgtcaaggaagtgtcctcctacctcaagaaggttggctacaaccctgacaaaattcccttcgtgcccatctctgggttcgaaggtgacaacatgattgaaagatcaaccaacctcgactggtacaagggacccactctgcttgatgctcttgaccagatcaatgagccaaagaggccatcagacaagcccctccgtttacctcttcaggacgtttacaagattggtggtattggaactgtgccagtgggtcgtgtggagactggggtcatcaagccaggtatggttgtgacctttggacccagtggactgaccactgaagttaagtccgttgagatgcatcacgaggctctgcaggaggctcttcctggtgacaatgtggggttcaatgtgaagaatgttgcagtgaaggatcttaagagaggttttgttgcatccaactcaaaggatgaccctgccaaggaagctgccaacttcacttctcaggtgatcatcatgaaccaccctggacagattggaaacggttatgcaccagtgttggattgccacacttcccacattgctgtgaagttctctgagatcctcaccaagattgatcgtcgatctggcaaggagcttgagaaggagcccaagtttttgaagaatggagatgctggtatgattaagatgattccaaccaagcctatggtggtagagacctttgctgagtacccaccattgggtcgttttgctgtgagagacatgagacaaactgttgctgttggtgtcatcaagagtgttgagaagaaggatccatctggtgccaaggtcaccaagtctgctgcaaagaagaaatgaatggtgcggtctgcaggttctgttattgctatgaagaacattttatatcactattttagtcttttaaaatgtttgactagttataatttgatgtttacttgtcgtccatcctccagttgtagtactcagaattgggtgctagacaggcggtggtgacattgtgtgaggatttttatggttttgtgttttgtattttccttttaaaaccttgtctgagttggttgttattttctctacttaatgtcatatttttgtgaactatttttgttgtccctatttttttcagtagcccctggacagattgg

SEQ ID NO: 617 - DNA, 1633 bp, Euphorbia peplus
ggctgctgctgataaggtgttgtagccgcctcctaaatctctgcataaggtatccaaaatgggtaaagagaaaattcacatcagtattgtggtcattggacatgtcgactctggcaagtccaccaccactggacatcttatctacaagcttggaggtattgacaagcgtgttattgaaagatttgagaaggaagctgctgagatgaacaaaaggtcattcaagtatgcatgggttcttgacaagcttaaggctgagcgtgaacgtggtatcaccattgatattgccctgtggaagtttgagaccaccaagtattactgcacagttattgatgctcctggacacagggatttcatcaagaacatgattactggaacttctcaggctgattgtgctgttcttattattgattccaccactgggggttttgaggctggtatctcaaaggatggccagactcgtgagcacgctctccttgcttttaccctcggtgtcaagcagatgatctgctgctgtaacaaaatggatgcaacaactcccaagtactctaaggccaggtatgaggaaattgtcaaggaagtttcctcctacctcaagaaggttggatacaaccctgataaaattcccttcgtgcccatctctgggtttgaaggtgacaatatgattgagagatcaaccaacctcgactggtacaagggacccactttgcttgatgctcttgaccagattaatgagccaaagaggccatcggacaagcccctccgtctacctcttcaggatgtctacaagatcggaggtattggaactgtgccagtgggtcgtgtggagactggggtcatcaagccaggtatggttgtgacctttggacccagtggactgaccactgaagttaagtccgttgagatgcatcacgaggctctgcaggaggctcttccaggtgacaatgtggggttcaatgtgaagaatgtggcagtgaaggatcttaagagaggttttgttgcatccaactcaaaggatgaccctgccaaggaagctgccaacttcacttctcaggttatcatcatgaaccaccctggccagattggtaatgggtatgcaccagtgttggattgccacacctcccacattgctgtgaagttctctgagatcctcaccaagattgatcgccgatctggcaaggagcttgagaaggagcccaagtttttgaagaatggagatgctggtatgattaagatgattccaaccaagcctatggtggtagagacctttgctgagtacccaccattgggtcgttttgctgtgagagacatgagacaaactgttgctgttggtgtcatcaagagtgtggagaagaaggatccatctggagccaaggtcaccaagtctgctgccaagaagaagtgagatgtttctcaatgattgtttaccattggtgacaattttgagtacctagttttggtatttttttatcttttattaaggtgttgatcaatagttttgctttatgtttagtgtatgctgctgctctttcattttgacattatgctatttgaatgcagcaattttcttggtatacgattttgtggtggatgtttaaatttgaaaaaactcgagttaattctgtttacttctaag

SEQ ID NO: 618 - DNA, 1901 bp, Zea mays
ctaccctagtgcgcttcccttataaaacctagctcctcaagctccagacgcagtcgaccgccgcagaccgggagtagtcgacgcgccgtcactgaatcctcagatcacggctagccgtaatcacgccactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaggtatcacaattgatattgctttgtggaagttcgagaccaccaagtactactgcactgtcattgatgcccctggacaccgtgacttcatcaagaatatgattactggcacttcccaagctgactgcgctgttcttatcattgactccactactggtggttttgaggctggtatctccaaggatggacagacccgcgagcatgctctccttgctttcacgcttggagtgaagcagatgatttgctgttgcaacaagatggatgccaccacacccaagtactccaaggcccgttatgatgagattgtgaaggaagtctcttcctacctgaagaaggttggatacaaccctgacaagatccactttgttcccatctctggtttcgaaggtgacaacatgattgagaggtccaccaaccttgactggtacaagggcccaaccctacttgaggctttggacttgatcaatgagccgaagaggccttcagacaagcccctgcgtctccccctacaggatgtgtacaagattggtggtattggaactgttcctgttgggcgtgttgagactggtatcatcaagcctggtatggttgttacctttggtcctagtggccttactactgaggtgaagtctgttgaaatgcaccatgaggctctccaggaggcccttcctggtgacaatgttggcttcaatgttaagaatgttgctgtgaaggatctgaagcgtgggtatgtggcctccaactccaaggatgaccctgccaaggaggctgctagcttcacgtcccaggtcatcatcatgaaccaccctgggcagattggcaacggctatgccccagtgctggactgccacacctcgcacattgctgtcaagtttgcggagctcattaccaagattgataggcggtctggcaaagagcttgagaaggagcccaaattcctcaagaatggtgatgctggtatggtgaagatggttcccactaagcccatggtagtggagaccttttctgaatatcctcctcttggtcgctttgctgtccgtgacatgaggcaaacggtggctgtcggagtcatcaagagtgtggagaagaaggatccaactggagccaaggtgaccaaggctgccgcaaagaagaaatgatgtgtctggctggttctgtgtttgcttgagggatacctagtggaaacgtaaaatatctcgtcttgttcacgtcattgtctgaactatgctcgcaacgtttgcctggtcgatttagaactgttattttcgttaaaaccagagtgttatttaagacttatccgaacatctggtgagccatatatggttactagttttgttactacccttgttggtgttgtgtgcttctttagcaaatgtgctgtttctaaattgctcattatttgctcgtccatacctgtctgctgcgatcaaatttctcttgcgcttaaatcttttaaacaaaaaagctgccaaatcgcatatcaaggatttagaaattatgattcttccgaaatgtttttttgata

SEQ ID NO: 619 - DNA, 1801 bp, Quercus alba
aactctgtattcctctctctcactctttcacactccgattctctctccctctctcgcggctagggttttagcgcagctctttcttcagttcattaagaatgggtaaggaaaaggttcacatcaacattgtggtcattggccatgtcgactctggaaagtcgaccacaactggtcacttgatatacaagcttggaggtatcgacaagcgtgttattgagaggttcgagaaggaagctgctgagatgaacaagaggtcattcaagtatgcctgggtgcttgacaagctcaaggctgagcgtgagcgtggtatcaccattgatattgccttgtggaagtttgaaaccaccaagtactactgcacagtcattgatgctcctggacatcgtgatttcatcaagaacatgattactggaacctcccaggctgattgtgctgtccttattatcgactccaccactggtggttttgaagctggtatttccaaggatggacagacccgtgagcatgctctccttgctttcacccttggtgtcaggcaaatgatttgctgctgcaacaagatggatgccactacccccaagtactcaaaggccaggtacgatgaaatcgtgaaggaagtctcttcctacttgaagaaggttgggtacaaccctgacaagattccttttgtccccatctccggatttgagggtgacaatatgattgagaggtccaccaaccttgactggtacaagggtccaacccttcttgaggcacttgaccagatcaatgagccaaagaggccctcagacaagcccctccgtctcccacttcaggatgtttacaagattggaggcattggaactgtccctgtgggtcgtgttgagaccggtctcatcaagcctggtatggttgtgacttttggccccactggactgaccactgaagttaagtctgttgaaatgcatcatgaggctctcctagaggctcttcctggtgacaatgttggcttcaacgttaagaatgttgctgtgaaggatctcaagcgtgggtatgttgcctccaactccaaggatgatcctgccaaggaggcagccaacttctcctcccaagttatcatcatgaaccaccctggccagattggaaatggttatgcccctgtccttgattgccacacctcccacattgctgtcaaatttgctgagctcttgaccaagattgacaggcgatctggtaaggagcttgagaaggagcccaaattcttgaagaatggtgattctggaatggttaagatgattcccaccaagcccatggttgttgaaactttctccgagtatcccccacttggtcgttttgccgtcagggacatgcgtcaaactgtggctgtcggagtcattaagagcgtggagaagaaggatccatctggagccaaggttaccaagtctgctgccaagaagaagtgaaccgtgctgcaccgggtttctgcaagtgatggctatcctaggtgttataataaggaatgggttcttgctagtaagctatcaatcgtgtgtttaaggttttgtttagttggttattgcttcaagtctccaccttcatcacgcaggtgctgttctcagaactgggtgcttgaccggcggtggcgtggcagctgtgttgagtcctaagtatttattctgtcttttttttctttttttttttttatatgttgtcctgtgagacttatatttattttcataagcagctatggagttttaggtctgttcctaagctgccgagatgattactatttacatccatataattaagtagttattgtgtg

SEQ ID NO: 620 - DNA, 1810 bp, Quercus alba
aactctgtatttctctttctctctctctcactctttcacactccgattctctctccctctctcgcggctagggttttagcgcagctctttcttcagttcattaagaatgggtaaggaaaaggttcacatcaacattgtggtcattggccatgtcgactccggaaagtcgaccacaactggtcacttgatatacaagcttggaggtatcgacaagcgtgttattgagaggttcgagaaggaagctgctgagatgaacaagaggtcattcaagtatgcctgggtgcttgacaagctcaaggctgagcgtgagcgtggtatcaccattgatattgccttgtggaagtttgaaaccaccaagtactactgcacagtcattgatgctcctggacatcgtgatttcatcaagaacatgattactggaacctcccaggctgattgtgctgtccttattatcgactccaccactggtggttttgaagctggtatttccaaggatggacagacccgtgagcatgctctccttgctttcacccttggtgtcaggcaaatgatttgctgctgcaacaagatggatgccactacccccaagtactcaaaggccaggtacgatgaaatcgtgaaggaagtctcttcctacttgaagaaggttgggtacaaccctgacaagattccttttgtccccatctctggatttgagggtgacaatatgattgagaggtccaccaaccttgactggtacaagggtccaacccttcttgaggcacttgaccagatcaatgagccaaagaggccctcagacaagcccctccgtctcccacttcaggatgtttacaagattggaggcattggaactgtccctgtgggtcgtgttgagaccggtctcatcaagcctggtatggttgtgacttttggccccactggactgaccactgaagttaagtctgttgaaatgcatcatgaggctctcctagaggctcttcctggtgacaatgttggcttcaacgttaagaatgttgctgtgaaggatctcaagcgtgggtatgttgcctccaactccaaggatgatcctgccaaggaggcagccaacttcagctcccaagttatcatcatgaaccaccctggccagattggaaatggttacgcccctgtcctcgattgccacacctcccacattgctgtcaaatttgctgagctcttgaccaagattgacaggcgatctggtaaggagcttgagaaggagcccaaattcttgaagaatggtgattctggaatggttaagatgattcccaccaagcccatggttgttgaaactttctccgagtatcccccacttggtcgttttgccgtcagggacatgcgtcaaactgtggctgtcggagtcatcaagagcgtggaaaagaaggatccatctggagccaaggttaccaagtctgctgccaagaagaagtgaatcgtgctgcaccgggtttctgcaagtgatggctatcctaggtgttataataaggaatgggttcttgctagtaagctatcaatagtgtgtttaaggttttgtttagttggttattgcttcaagtctccaccttcatcacgcaggtgctgttctcagaactgggtgcttgaccggcggtggcgaggcagctgtgtttttgagtcctaagtatttattctgctttttttttttttaaatgttgtcctgtgagacttatatttattttctataagcagctatggagttttaggtctgttcctaagctgccgggatgattactatttacatttataattaagtagttattgtgtgtttttatct

SEQ ID NO: 621 - DNA, 1968 bp, Quercus alba
cacactcgctctcatattctctctctcgcggctagggttttagcgcagctctctcttgttctctctctctcctcagtcgattcagaatgggtaaggaaaaggttcacattaacattgtggtcattggccatgtcgactctgggaagtcaaccaccactggtcacttgatctacaagcttggaggtattgacaagcgtgttattgagaggtttgagaaggaagctgctgagatgaacaagaggtcattcaaatacgcctgggtgcttgacaagctcaaggctgagcgtgagcgtggtatcaccattgatattgccttgtggaagtttgagaccaccaggtactactgcacagtcattgatgcccctggacatcgtgatttcatcaagaacatgattactggaacctcccaggctgattgtgctgtcctcattattgactccaccactggtggttttgaagctggtatttccaaggatggacagacccgtgagcatgctctccttgctttcacccttggtgtcaagcaaatgatttgctgctgcaacaagatggatgccactacccccaagtactcaaaggccaggtacgatgaaatcgtgaaggaagtctcttcctacttgaagaaggttgggtacaaccctgacaagattccttttgtccccatctctggatttgagggtgacaatatgattgagaggtccaccaaccttgactggtacaagggtccaacccttcttgatgcacttgaccagatcaatgagccaaagaggccctcagacaagcccctccgtctcccacttcaggatgtttacaagattggaggcattggaactgtccctgtgggtcgtgttgagaccggtctcatcaagcctggtatggttgtgacttttggccccactggactgaccactgaagttaagtctgttgaaatgcatcatgaggctctcctagaggctcttcctggtgacaatgttggcttcaacgttaagaatgttgctgtgaaggatctcaagcgtgggtatgttgcctccaactccaaggatgatcctgccaaggaggcagccaacttcacctcccaagttatcatcatgaaccaccctggccagattggaaatggttacgcccctgtcctcgattgccacacctcccacattgctgtcaaatttgctgagctcttgaccaagattgacaggcggtctggtaaggagcttgagaaggagcccaaattcttgaagaatggtgatgctggaatggttaagatgcttcccaccaagcccatggttgtggaaaccttttccgagtatcccccacttggtcgttttgccgtcagggacatgcgtcaaactgtggctgttggtgtcatcaagagtgtggagaagaaggatccatctggagccaaggtgaccaagtctgctgccaagaagaagtgaattgtgctgcacccagtttctgcaagtgctgggtatcgtagtccttacagtaaggactgggttcttgctattaatctatccatagaaggtctaagtgtttgttttgttggtaatagcttcaagtctctgccatcgtcatgtagcttcaattcccagaattgggtgcttgaccgacggtggcggggccatggagtatcctagtgtttttgatttgcttaaaggtgtcatgtgagacttatttattttcataagcagctatggagttttaggtctgttttcatgctgcccggatttttgctatttacatttatagttatctagtctgtgtgttttcaattgaacaatttttacttgctgcatctctactgatatgttttttaaggttcgctacttttattctttattatagatctttactggttgaattgttttcggaagaatagaccttattactggttgaattgaattgtgacaaattatattatgttcaaaaaaaaaaagttaaattaatcgcgatctagaactaaggacacgcgag

SEQ ID NO: 622 - DNA, 1822 bp, Allium cepa
acatatcgccgccactcttatcgtctctattgttaatcacataccatgggaaaagagaaatttcatatcagtcttgtggtcattggtcatgtcgactctggaaagtcaacaaccactggccatctcatctacaagcttggtggtattgacaagcgtgtgattgaaagattcgagaaggaagcagctgagatgaacaaaaggtccttcaaatacgcatgggttcttgacaagcttaaggcagagcgtgaaagaggtatcactattgatattgccttgtggaagtttgagaccaccaagtactattgcacagtcattgatgctcctggacatcgtgactttatcaagaacatgattactggaacatctcaagctgattgtgctgtgctcatcattgactcgaccaccggtggttttgaagctggtatttcaaaggatggtcagacccgtgagcatgctttgcttgctttcactcttggagtgaagcaaatgatctgttgctgtaacaagatggatgccacaacccccaaatactcaaaggcccgatatgaagaaattgtgaaggaagtctcatcttacctcaaaaaggtagggtacaaccctgaaaaggtgcctttcgtacctatctccggttttgaaggagacaacatgattgagcgatccaacaacctggactggtacaagggcccaaccctcctagaagccctagaccagatcaatgagcccaaacgtccctcagacaagcccctccgtctccccctccaggatgtctacaagattggaggaatcggcactgtcccagtgggccgtgttgagaccggggtcatcaaacctggcatgctcgtcaccttcggcccaacgggactcaccacagaggtcaagtcagttgaaatgcaccatgaggcccttcaggaagccctaccgggagacaatgtagggttcaacgtcaagaatgtggcggtcaaggatctcaagcgtgggtttgttgcctccaactcaaaggacgacccagccaaggaagccgccagcttcacctcccaggtcatcatcatgaaccacccgggtcagattggtaacgggtacgcacccgttctggactgccacacctcccacattgctgtcaagtttgccgaaatcctgaccaagattgataggaggtcaggaaaggagatcgagaaggagcctaagtttttgaagaacggtgatgcaggtatggttaagatgattccaaccaagcctatggtggtcgagactttctcagagtaccctccacttggaaggtttgctgttagggacatgaggcagactgttgctgttggggttatcaaaagtgtggagaagaaggatcctactggagctaaggtcaccaaggcagctgctaagaagaaatgagttgccgctgctgttgttctagtatgtggaaatttggtgctgcttgttgcttttttgttgggtgcttggttgcagaattgggtgcttgataggcggtggcatgcagcagttgggttacacgtcaacttttcttcgtttatctaggaagtttttattgctattttgccattttgtgctgtcatgttcgcgagtattaagactttttctcttttgttttgtttcgattctgtcttctaaaaactttgtgagctttgaatttatgatttagttatgtcactagtctttctactgtttgcttttatctaagcctaatgcttataattgtatttgtaatactgtctaattgtatttgaaatttggatctttcgtgattgtttggtgaaatttcttatcctagtggtgttgctttcaaattaacagataactgctatac

SEQ ID NO: 623 - DNA, 1824 bp, Papaver somniferum
cggagcttatctaattcggcgtttcagttaatttctaagaattcagtatgggtaaagagaaggttcacatcaacattgtcgtcattggacatgtcgactctggaaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatatcgccttgtggaagtttgagaccaccaagtactactgcacagttattgatgctcctggacatcgtgactttatcaaaaacatgattactggtacttctcaggctgattgtgctgtcctcattattgattctaccactggaggttttgaggctggtatctcaaaggatggtcagactcgtgagcacgctcttcttgctttcacccttggtgtcaagcagatgatctgttgttgtaacaagatggatgccaccacccccaagtactcaaaggctaggtatgatgaaattgtcaaggaggtctcatcttacttgaagaaggttggatacaacccagacaaaattgcctttgttcctatctctggattcgagggagacaacatgattgagaggtccaccaaccttgactggtacaagggaccaactcttctcgatgctcttgacaatatctctgagccaaagagaccctcagacaagcccctccgtcttccccttcaggatgtttacaagattggaggtattggaactgtgccagtgggacgtgttgaaactggattcatcaagcctggtatggttgttacctttggacccactgggttgaccactgaagttaagtctgtggagatgcaccacgaagcccttcaagaagctcttccaggagacaatgttgggttcaatgtcaagaatgttgcagtgaaggatctcaagcgtggtttcgtcgcctccaactccaaggacgaccctgccagggaagctgctaacttcacctcccaggtcatcatcatgaaccatcctggtcagatcggtaatggttatgctccagttcttgactgtcacacatctcacattgctgttaagtttgctgagatccaaaccaagatagataggcgatctggaaaggagcttgagaaggagcccaagttcttgaagaacggtgatgctggtattattaagatgattccaaccaagcccatggttgtagaaaccttcgctcagtacccacctcttggacgttttgctgttagggacatgaggcagacagttgctgttggtgtcatcaagggagttgagaagaaggatccaacaggagccaaggttaccaagtctgctgtcaagaagaagtaaagtactccagtaagtacagggatggtgctaagagggtctgcagaagggttttgtcttgtttacttcagtagtagtcatttttgtttcttgtttgctttggttagctatcattgcagttttatatcttttgttgcctttgttttgttgagcatccagatgcaaacctgggtgcttgataggcggtggcaacatgagtttgggctgttcagttaattgaaaacttgttatggattttggtttgtaagttgctgttaacaactttttatttgcgtatctctttcccagtttaatgaaaatagtgtctgcagaaatgttttctcatcatatcttttgtcagtggctctgctctgaatctctttcagtttagcatttggtggagatgagtagtatcttttgaatcttcagtcattgaaagctttgaggaaaaaaaaaa

SEQ ID NO: 624 - DNA, 1863 bp, Prunus persica
cattacaacagttggatcaaatctaccaagatccaacggcgcataaagaaaccctaaccaaacagatgtagcaattgctcctctttaaatccccaagcctctcattctcctcatcctctccttcatctcactcttcagactcaagtcggcggcgagagagatcccccatatattcttcactttgagtttcttgagatatcttgctgaaattccatcatgggtaaagagaagtttcacatcaacattgtggtcattggccatgtcgactccgggaaatcaaccaccaccggtcacttgatctacaagcttggtggtattgacaagcgtgttattgagaggtttgagaaggaggctgctgagatgaacaagaggtcattcaagtatgcctgggtgttggacaagctcaaggctgagcgggaacgtggtattactattgatattgccttgtggaagtttgagaccaccaagtactactgcacagttattgatgcacctggacatcgtgacttcatcaagaacatgattactggaacctcccaggctgattgtgctgtcctcattattgattccaccactggtggttttgaagctggtatttccaaggatggtcagacccgtgagcatgctttgcttgcgtttactcttggtgtcaagcagatgatttgctgctgtaacaagatggatgccaccactcccaagtactcaaaggcaaggtacgatgaaattgtgaaggaagtctcatcctatcttaagaaggttgggtacaacccagataaaattgcctttgtccccatttctggattcgagggtgataacatgattgagaggtccaccaaccttgactggtacaagggtcccacccttcttgaggcccttgacttgatcaatgagcccaagaggccctcagacaagcccctccgactcccacttcaggatgtgtacaagattggtggcattggtactgtacctgttggacgtgttgagactggtgttgtgaagcctggtatggttgttacttttggtcccactggactgacaactgaagttaagtctgttgagatgcaccatgaagctctccaggaggctcttccaggtgacaatgttggattcaacgtcaagaatgttgctgtcaaggatctcaagcgtggttttgttgcttccaactccaaagatgatcctgcaaaggaggctgccaactttacctctcaggtcatcatcatgaaccaccctggccagattggaaatggatatgctccagttctcgactgccacacctcccacattgctgtcaagttttctgagatcttgacaaagattgataggcgatctggtaaggagattgagaaggagcccaagttcttgaagaatggagatgctggtatggtgaagatgattccaaccaagcccatggttgttgagactttctctgagtacccaccacttggtcgtttcgccgtgagggacatgcgacagacagttgctgttggtgtcatcaagagtgttgagaagaaggatccaaccggtgccaaggtcaccaaggctgcagcaaagaagaagtgagatgtgttttaccgggcccctgagctaggctagttttgtccaatgctgtttcttttcaatttgtttggtgttattatggaagttttgtggacagttttgaatgtttacatcgtagtgctctaccaaccccttgtaagggttgtggaggagctgagcagttggatcatcctccggttgctctgctagctgtgttgtaggctcctcgtgttttcgttttatacattgagatgagttgtgtagttggacaacttcgtattaatgtttgcaacttctgtttttgtgttttaacttggatttttctcc

SEQ ID NO: 625 - DNA, 1822 bp, Rosa hybrid cultivar
ctcgctctcacctcaagtcggctagagagaactcctctagtttattcatcctcagtttttgctaacaattcatcatgggtaaggaaaagttccatatcaacattgtggtcattggccacgtcgactctggcaagtcgaccaccacaggtcacttgatctacaagcttggtggtattgacaagcgtgtgatcgagaggttcgagaaggaggctgctgagatgaacaaaaggtcattcaagtatgcctgggtgttggacaagctcaaggctgagcgtgagcgtggtatcaccattgatattgccttgtggaagtttgagaccaccaagtactactgcactgtcatcgatgctcccggacatcgtgatttcatcaagaacatgattactggtacctcccaggctgattgtgccgtcctcatcatcgactccaccactggtggttttgaagctggtatctccaaggatggtcagacccgtgagcacgctctgcttgctttcactcttggtgtcaagcagatgatttgctgctgtaacaagatggatgccaccactcccaagtactcaaaggcaaggtacgatgaaatcgtgaaggaagtctcttcctacctgaagaaggttgggtacaacccagacaaaattgcctttgttcccatctctggattcgagggtgacaacatgattgagaggtccaccaacctcgactggtacaagggccctaccctccttgaggcacttgaccaaatcaatgagcccaagaggccctcagacaagcccctccgtctcccacttcaggatgtgtacaagattggtggcattggaactgtgcctgtgggacgtgttgagactggtgtcatcaagcctggtatggttgtgacttttggccccactggactgactactgaagttaagtctgtggagatgcaccacgaagctctcctggaggctcttcctggtgacaatgttgggttcaatgtgaagaatgttgctgtcaaggatctcaagcgtggttttgttgcatccaactccaaggatgaccctgccaaggaagctgctaacttcacctcacaggtcatcatcatgaaccaccctggccagattggaaatggatatgctccagtgctcgactgccacacctcccacattgctgttaagtttggtgagattttgaccaagattgacaggcgatctggtaaggagattgagaaggagcccaagttcttgaagaatggtgatgctggtatggttaagatgcttcccaccaagcccatggttgttgagaccttctctgagtacccacctcttggtcgttttgctgtgagggacatgcgtcagacagttgctgttggagtcatcaagagtgttgagaagaaggatccatctggtgccaaggtgaccaagtctgctgctaagaagaagtgagatgtgccaatgaagtcagtcctacccttagctaggctagttttgtttaatgcactttccatttcaatatttttgtgttattctggaagttttgtggacacatatgaaaccttgcatcgcagtcctccagccttggttggaggagttgagcatctagatgtatttctgggtgcttggcgatctgtgttgctttctttgttttaaatttcagtgtttttcggttatacattgaggtgagttgtgtagttgcttgatgaacagcttcttaatgttgtaacttttatatctatgactatcaatttaagttctcgtgttcaaaaaaaaaaaaaaaaaaaacaaaaaaaaaaacaaaaaaaaaactaaaaaacgtaaacgaacgtaacgtttactttaccttcgtacgg

SEQ ID NO: 626 - DNA, 1665 bp, Silene vulgaris
gttgcctctctttcgcatatttctcatcctctccttttattaattcttctttcagtttttgcaagaattataaatcatgggtaaggaaaagattcacatcagtattgttgtcattggacatgtcgattctggcaaatccaccaccacgggtcatttgatctacaagcttggtggtattgacaagcgtgttatcgagaggttcgagaaggaagctgctgagatgaacaagaggtctttcaagtatgcttgggtgcttgacaagctcaaggctgagcgtgagcgtggtattaccattgatattgccctgtggaagtttgagaccaccaagtactactgcactgtcattgatgcccctggtcatcgtgactttatcaagaacatgattactggtacttctcaagctgattgtgccgtcctcattattgactccaccactggaggttttgaggctggtatctctaaggacggtcagacccgtgagcatgctcttctcgctttcacccttggtgttaagcagatgatctgttgtcttaacaagatggatgccaccactcccaagtactcgaagtccaggtatgaggaaatcgtgaaagaagtcagttcatacctgaagaaggttgggtacaacccagacaaggttccatttgttcccatctctggttttgagggtgacaatatgattgagaggtccaccaaccttgactggtacaagggtcctacccttcttgaggctcttgaccaggtttctgagcccaagaggccctcagacaagcccctacgtcttccactccaggatgtttacaagattggaggtattggaacggtgcctgtcggacgtgttgagactggtgtcatcaggcctggtatgcttgttacctttggtccaactgggttgaccactgaggtaaagtctgttgagatgcaccacgagtccatgcctgaggccctcccaggtgacaatgttggattcaatgttaagaatgttgcagtcaaggatctcaagcgtggttttgtcgcctctgactcaaagaatgaccctgctaaggaggcagccaacttcacatcacaggtcatcatcatgaaccaccctggccagatcggaaacggttatgccccagtcctcgattgtcacacctctcacattgctgtcaagtttgctgagcttgtcaccaaaattgacagacgatctggaaaggagcttgagaaggagcctaaattcttgaagaatggtgatgctggtatggttaagatgattcccaccaagcccatggtggtggaaaccttctcagagtaccctcctcttggtcgtttcgctgtaagggacatgaggcagactgtggcggttggtgtcatcaagaacgttgagaagaaggatcccaccggtgccaaggtcaccaaggctgccttgaagaagaaatgattttgtgaggctgttgcacaatattacatggtttgtatcagtaggaccgttttatgctacttttgttatcttgttgtttttgaacaattgttttcaccatcatctggcaactattctcagaattgggtgcttgatcgacggtggtatgattagtggctgatgtgttcatttggttctactgttctagtactggattttcgaggttgtttgattctgtcgaattatgagattttaaactttttctt

SEQ ID NO: 627 - DNA, 1641 bp, Silene vulgaris
tagctaaacacatttcctgattgcggctagggttttacctcttctctcagcttaacagaattcactatgggtaaggaaaagattcacatcagtattgtcgttattggacatgtcgactccggcaagtctactactactggtcacttgatctacaagcttggtggtattgacaagcgtgttatcgagaggttcgagaaggaagctgctgagatgaacaagaggtctttcaagtatgcttgggtgcttgacaagctcaaggccgagcgtgagcgtggtattaccattgatattgccttgtggaagtttgagaccaccaaatactactgcacagtcattgatgcccctggtcaccgtgactttatcaagaacatgattactggtacttctcaagctgattgtgccgtcctcattattgactccaccactggaggttttgaagctggtatttctaaggacggtcagacccgtgagcatgctcttctcgctttcacccttggtgtcaagcagatgatctgttgccttaacaagatggatgccaccactcccaagtactcgaagtccaggtatgaggaaattgtgaaagaagtcagttcatacctcaagaaggttgggtacaacccagacaaggttccatttgttcccatctctggttttgagggtgacaatatgattgagaggtccaccaaccttgactggtacaagggtcctacccttcttgaggcgcttgaccaggtttctgagcccaagaggccctcagacaagcccctacgtcttccactccaggatgtttacaagattggaggtattggaacggtgcctgtcggacgtgttgagactggtgtcatcaggcctggtatgcttgttacctttggtccaactgggttgacaactgaggtaaagtctgttgagatgcaccacgagtccatgcctgaggccctcccaggtgacaatgttggattcaatgttaagaatgttgcagtcaaggatctcaagcgtggttttgtcgcctctgactcaaagaatgaccctgctaaggaggcagccaacttcacatcacaggtcatcatcatgaaccaccctggccagatcggaaacggttatgccccagtcctcgattgtcacacctctcacattgctgtcaagtttgctgagcttgtcaccaaaattgacagacgatctggaaaggagcttgagaaggagcctaaattcttgaagaatggtgatgctggtatggttaagatgattcctaccaagcccatggtggtggagactttctcagagtacccacctcttggtcgtttcgctgtgagagacatgaggcagactgttgctgttggtgtcatcaagaacgttgagaagaaggaccccaccggtgccaaggtcactaaggctgcccttaagaagaagtgagctgatcgagatttgatccaagcaaatgaaagtttcttatatgatattggtttcaatgagactactatgttttgtgaatttaatgtgtttgttttaggcttctttaatataggtagaggcatctgatgactgttttgcggtgttaaaatctcgagctgtttttcatttaccagctgctcgtgaattgttgtctgttgttggctgttctaagtctctaaacaattacatcct

SEQ ID NO: 628 - DNA, 1638 bp, Silene vulgaris
tctcaatctgttttgttaacaagtaatcatgggtaaagaaaagattcacatcagtatcgtcgtcattggacatgtcgactctggcaagtccaccactactggtcacttgatctataagcttggtggtattgacaagcgtgttatcgagaggttcgagaaggaagctgctgagatgaacaagagatctttcaagtatgcctgggtgcttgacaagctcaaggctgagcgtgaacgtggtatcactattgatattgccttgtggaagtttgagaccaccaaatactactgcacagtcatcgatgcccctggtcaccgtgactttatcaagaacatgattactggaacctcccaggctgattgtgccgtcctcattatcgactccaccactggaggttttgaggctggtatctccaaggatggtcagacccgtgagcatgctcttctcgctttcacccttggtgttaagcagatgatctgttgtcttaacaagatggatgccaccactcccaagtactcaaagtccaggtatgaggaaattgtgaaagaagtcagctcatacctcaagaaggttgggtacaaccctgacaaggttccatttgttcccatttctggttttgagggtgacaatatgattgagaggtccaccaaccttgactggtacaagggtcctacccttcttgaggctcttgaccaggtttctgaacccaagaggccctcagacaagcccctacgtcttccacttcaggatgtttacaagattggaggtattggaacggtgcctgtcggacgtgttgagactggtgtcatcaggcctggtatgcttgttacctttggcccaactgggttgaccactgaggtaaagtctgttgagatgcaccacgagtccatgcctgaggccctcccaggtgacaatgttggattcaatgttaagaatgttgcagtcaaggatctcaagcgtggttttgtcgcctctgactcaaagaatgaccctgctaaggaggcagccaacttcacatcacaggtcatcatcatgaaccaccctggccagatcggcaatggttatgccccagtcctcgattgtcacacctctcacattgctgtcaagtttgctgagcttgtcaccaaaattgacagacgatctggaaaggagcttgagaaggagcctaaattcttgaagaatggtgatgctggtatggttaagatgattcctaccaagcccatggtggtggagactttctcagagtacccccctcttggtcgtttcgctgtcagggacatgaggcagactgttgctgttggtgtcattaagaatgttgagaagaaggatcctaccggtgccaaggtcaccaaggctgccctgaagaagaagtgaactgttgctgtgatgagctcatcgtgtgaggaatgtggtcgtggtctttatgataaacaattggtgtcttttatttctagtgtttttgtgttgtgtttaggtcaatgttacatgggttgtagtctagcgttggcagtgcattgcaattccccgaattgggtgcttgatcgacggtggtgaggttttgatatagcccgtgtttttgtgttttctgttctgtctgaaacttgtgctattctctaatacaattgagtcgaaatttggtt

SEQ ID NO: 629 - DNA, 1674 bp, Silene vulgaris
aatacttctcccatcactcttctccttccttttcctcctttttcttccagttttgtgagcatttatcatgggtaaggaaaagattcacatcagtattgttgtcattggacatgtcgactctggcaagtccaccactactggtcacttgatctacaagcttggtggtattgacaagcgtgttatcgagaggttcgagaaggaagctgctgagatgaacaagaggtctttcaagtatgcttgggtgcttgacaagctcaaggccgagcgtgagcgtggtatcaccattgatattgccttgtggaagtttgagaccaccaaatattactgcacagtcatcgatgctcctggtcaccgtgactttatcaagaacatgattactggaacctcccaggctgattgtgccgtcctcattattgactccaccactggaggttttgaggctggtatctccaaggatggtcagacccgtgagcatgctcttctcgctttcacccttggtgtcaagcagatgatctgttgccttaacaagatggatgccaccactcccaagtactcgaagtccaggtatgaggaaattgtgaaagaagtcagttcatacctgaagaaggttgggtacaacccagacaaggttccatttgttcccatctctggttttgagggtgacaatatgattgagaggtccaccaaccttgactggtacaagggtcctacccttcttgaggctcttgaccaggtttctgagcccaagaggccctcagacaagcccctacgtcttccactccaggatgtttacaagattggaggtattggaacggtgcctgtcggacgtgttgagactggtgtcatcaggcctggtatgcttgttacctttggtccaactgggttgaccactgaggtaaagtctgttgagatgcaccacgagtccatgcctgaggccctcccaggtgacaatgttggattcaatgttaagaatgttgcagtcaaggatctcaagcgtggttttgtcgcctctgactcaaagaatgaccctgctaaggaggcagccaacttcacatcacaggtcatcatcatgaaccaccctggccagatcggaaacggttatgccccagtcctcgactgccacacctctcacattgctgtcaagtttgctgagcttgtcaccaaaattgacagacgatcaggaaaggagttggagaaggagcccaagttcttgaagaatggtgatgctggtatggttaagatgattcccacaaagcccatggttgtggagaccttctcagagtacccacctcttggtcgtttcgctgtgagggacatgaggcagactgtggccgttggtgtcatcaagaatgttgagaagaaggatcccacaggtgccaaggtcaccaaggctgctttgaagaagaaatgagtttgggaggctgttgcaccgtattacttgcttgttcagtagggatttattttgctattttcattttctagtttttaaacaattggcttcaccgtatctggcatctattctcagaattgggtgctagagtgacgctggtatacctgttgatgtttcattttgggttgccctggtaacttttgagtttatcggattctgtcgaattctctttttttttgaggtttaagagatgattctacgtattactcaaaaatgcgtatatg

SEQ ID NO: 630 - DNA, 1766 bp, Silene vulgaris
agattggctgcctccgatccctcttcacatccttttctcattattttctttcagttttttgtgagaatatatcatgggtaaggaaaagattcacatcagtattgtcgtcattggacatgtcgactctggcaagtccaccactactggtcacttgatctacaagcttggtggtattgacaagcgtgttatcgagaggttcgagaaggaagctgctgagatgaacaagaggtctttcaagtatgcttgggtgcttgacaagctcaaggccgagcgtgagcgtggtattaccattgatattgccttgtggaagtttgagaccaccaaatactactgcacagtcatcgatgctcctggtcaccgtgactttatcaagaacatgattactggaacctcccaggctgattgtgctgtcctcattattgactccaccactggaggttttgaggctggtatctctaaggacggtcagacccgtgagcatgctcttcttgctttcacccttggtgtcaagcagatgatctgttgtcttaacaagatggatgccaccactcccaagtactcgaagtccaggtatgaggaaattgtgaaagaagtcagttcatacctgaagaaggttgggtacaacccagacaaggttccatttgttcccatctctggttttgagggtgacaatatgattgagaggtccaccaaccttgactggtacaagggtcctacacttcttgaggctcttgaccaggtttctgagcccaagaggccctcagacaagcctctacgacttccacttcaggatgtttacaagattggaggtattggaacggtgcctgtcggacgtgttgagactggtgtcatcaggcctggtatgcttgttacctttggtccaactgggttgaccactgaggtaaagtctgttgagatgcaccacgagtccatgcctgaggccctcccaggtgacaatgttggattcaatgttaagaatgttgcagtcaaggatctcaagcgtggttttgtcgcctctgactcaaagaatgaccctgctaaggaggcagccaacttcacatcacaggtcatcatcatgaaccaccctggccagatcggcaacggttatgccccagtcctcgactgccacacctctcacattgctgtcaagtttgctgagcttgtcaccaaaattgacagacgatctggaaaggagcttgagaaggagcctaaattcttgaagaatggtgatgctggtatggttaagatgattcctaccaagcccatggtggtggagaccttctcagagtacccacctcttggtcgttttgctgtcagggacatgaggcagactgttgctgttggtgtcattaagagcgttgagaagaaggatcccactggtgccaaggtcaccaaggctgccctgaagaagaagtaaactgttccagattaaagcttagcaagtgaggaatgttgggaagttgatgatatacaattggtgtctgttatgtgtggagtctttatgtttctaggtcattgttacatgggttttagacttttagtccagcgttgacattgcattacagttctcgaaattgtgtgcttgattggcggtggtgaggttttgatatagcctgccttttcatgtcgtctgttctctttctagtataatcgagtctacttgagtattctgtcatgaaatccctcttttggttgatacaaattctcttggtgattttgtactttgattcttgtttaaattgctctttatgaactctggagactat

SEQ ID NO: 631 - DNA, 1877 bp, Silene vulgaris
tcgcatatttctcatcctctccttttattaattcttctttcagtttttgcaagaattataaatcatgggtaaggaaaagattcacatcagtatcgttgtcattggacatgtcgattctggcaaatccaccaccacgggtcatttgatctacaagcttggtggtattgacaagcgtgttatcgagaggttcgagaaggaagctgctgagatgaacaagaggtctttcaagtatgcttgggtgcttgacaagctaaaggctgagcgtgagcgtggtattaccattgatattgccttgtggaagtttgagaccaccaagtactactgcactgtcattgatgcccctggtcatcgtgactttatcaagaacatgattactggtacttctcaagctgattgtgccgtcctcattattgactccaccactggaggttttgaggctggtatctctaaggacggtcagacccgtgagcatgctcttctcgctttcacccttggtgttaagcagatgatctgttgtcttaacaagatggatgccaccactcccaagtactcgaagtccaggtatgaggaaattgtgaaagaagtcagttcatacctgaagaaggttgggtacaacccagacaaggttccatttgttcccatctctggttttgagggtgacaatatgattgagaggtccaccaaccttgactggtacaagggtcctacccttcttgaggctcttgaccaggtttctgagcccaagaggccctcagacaagcccctacgtcttccacttcaggatgtttacaagattggaggtattggaacggtgcctgtcggacgtgttgagactggtgtcatcaggcctggtatgcttgttacctttggtccaactgggttgaccactgaggtaaagtctgttgagatgcaccacgagtccatgcctgaggccctcccaggtgacaatgttggattcaatgttaagaatgttgcagtcaaggatctcaagcgtggttttgtcgcctctgactcaaagaatgaccctgctaaggaggcagccaacttcacatcacaggtcatcatcatgaaccaccctggccagatcggaaacggttatgccccagtcctcgactgccacacctctcacattgctgtcaagtttgctgagcttgtcaccaaaattgacagacgatctggaaaggagcttgagaaggagcctaaattcttgaagaatggtgatgctggtatggttaagatgattcctaccaagcccatggtggtggagactttctcagagtacccacctctcggtcgtttcgctgtgagagacatgaggcagactgttgctgttggtgtcatcaagaacgttgagaagaaggaccccaccggtgccaaggtcactaaggctgcccttaagaagaagtgagctgattgagatttgatccaagcaaatgaaagtttctgatatgatattggtttcaatgagactactatgtttagtgaatttaatgtgtttgttttaggcttctttaatataggtagaggcatctgatgactgttttgcggtgttaaaatctctagctgtttttcatttaccagctgctcgtgaattgttctgttgttggctgttctaagtctctaaacaattacatcctggtttaattgttgtctccatcatatcttacaagtctcggagctctttacctttgggttcgggtataaaaatggagcgaggatagagatggagcggagtgaaagaagggcaagggagaaaaggaatgtggaccaagtgtctttcgttctagttcttcccactctttgatttccaattccttcctcccccactcaatttttgctcaaccaattgttctcctttttgtaaacgactgtaaaac

SEQ ID NO: 632 - DNA, 1729 bp, Silene vulgaris
ttgtgagcatttatcatgggtaaggaaaagattcacatcagtattgttgtcattggacatgtcgactctggcaagtccaccactactggtcacttgatctacaagcttggtggtattgacaagcgtgttatcgagaggttcgagaaggaagctgctgagatgaacaagaggtctttcaagtatgcttgggtgcttgacaagctcaaggccgagcgtgagcgtggtattaccattgatattgccttgtggaagtttgagaccaccaaatattactgcacagtcatcgatgctcctggtcaccgtgactttatcaagaacatgattactggaacctcccaggctgattgtgccgtcctcattattgactccaccactggaggttttgaggctggtatctccaaggatggtcagacccgtgagcatgctcttctcgctttcacccttggtgtcaagcagatgatctgttgccttaacaagatggatgccaccactcccaagtactcgaagtccaggtatgaggaaattgtgaaagaagtcagttcatacctgaagaaggttgggtacaacccagacaaggttccatttgttcccatctctggttttgagggtgacaatatgattgagaggtccaccaaccttgactggtacaagggtcctacccttcttgaggcgcttgaccaggtttctgagcccaagaggccctcagacaagcccctacgtcttccactccaggatgtttacaagattggaggtattggaacggtgcctgtcggacgtgttgagactggtgtcatcaggcctggtatgcttgttacctttggtccaactgggttgacaactgaggtaaagtctgttgagatgcaccacgagtccatgcctgaggccctcccaggtgacaatgttggattcaatgttaagaatgttgcagtcaaggatctcaagcgtggttttgtcgcctctgactcaaagaatgaccctgctaaggaggcagccaacttcacatcacaggtcatcatcatgaaccaccctggccagatcggaaacggttatgccccagtcctcgattgtcacacctctcacattgctgtcaagtttgctgagcttgtcaccaaaattgacagacgatctggaaaggagcttgagaaggagcctaaattcttgaagaatggtgatgctggtatggttaagatgattcctaccaagcccatggtggtggagaccttctcagagtacccacctcttggtcgttttgctgtcagggacatgaggcagactgttgctgttggtgtcattaagagcgttgagaagaaggatcccactggtgccaaggtcaccaaggctgccctgaagaagaagtaaactgttccagattaaagcttagcaagtgaggaatgttgtgaagttgatgatatacaattggtgtctgttatgtgtggagtctttatgtttctaggtcattgttacatgggttttagacttttagtccagcgttgacattgcattacagttctcgaaattgtgtgcttgattggcggtggtgaggttttgatatagcctgccttttcatgtcgtctgttctctttctagtataatcgagtctacttgagtattctgtcatgaaatccctcttttggttgatacaaattctcttggtgattttgtactttgattcttgtttaaattgctctttatgaactctggagactattagggatttgaaacactttga

SEQ ID NO: 633 - DNA, 1783 bp, Nicotiana tabacum
agagagagagaactagtctctcattcatttttgcttctccttctgctgtgcggcaacagatctatattggcttttaagtcttttttcaaatcaacatgggtaaagagaaatttcacatcaacattgtggtcattggccacgtcgactctggtaagtccactaccactggtcacttgatctacaagcttggtggtattgacaagcgtgtcattgagaggtttgagaaagaagctgctgagatgaacaagaggtcattcaagtatgcctgggtgcttgacaagctcaaggctgagcgtgagcgtggtatcaccattgatattgccttgtggaagtttgagaccaccaagtactactgcactgtgattgatgctcctggacacagggacttcatcaagaatatgattactggtacctcccaagctgactgtgctgtcctgattattgactccaccactggtggttttgaagctggtatctctaaggatggacagacccgtgaacatgcattgcttgctttcacccttggtgtcaagcaaatgatttgctgctgtaacaagatggatgctaccacccccaagtactccaaggctaggtatgatgaaatcgtgaaggaggtttcttcctacctcaagaaggtaggatacaaccctgataaaatcccctttgtccccatctctggtttcgagggtgataacatgatcgaaagatcaaccaaccttgactggtacaagggcccaactcttcttgaggctcttgaccagatcaatgagcccaagaggccctcagacaagcccctcaggctcccacttcaggatgtgtacaagattggtggtattggtactgtccctgttggtcgtgtggaaaccggtgtcctcaagcctggtatggttgtgacttttggtcccactggtctgaccactgaagttaaatctgttgagatgcaccacgaagctcttcaggaggcacttcctggtgacaatgttggattcaacgtcaagaacgttgcagttaaggatctcaagcgtgggtttgttgcttcaaactccaaggatgacccagctaagggtgctgccagctttacctcccaagtcatcatcatgaaccatccaggacagattggaaatggatatgctccagtgcttgactgccacacctcccacattgctgtcaagtttgcagaaattttgaccaagatcgacaggcgttctggtaaggagattgagaaggagcccaagttcttgaagaatggtgatgctggtatggttaagatgattcccaccaagcccatggttgttgagaccttctctgagtacccaccattgggacgttttgctgtgagggacatgcgtcaaactgttgctgttggtgttatcaagaacgttgacaagaaggacccaactggtgccaaggtcaccaaggctgctcagaagaagaaatgaacgttgcagttcaattctggtggtactcgcgatatctactacaataaagtgtgttatggagacattgttttctctgcttgtgatgtttttgttcggtctttaatgtggttcttaggttctagatttctgccttgtatgactggtatccgctcccagagttgggtgcttgacaggcggtggcgagaaaaactttgttgagtctgtctgcattttcttttgaggtgccttggttttccaaggtggctcagaagttttgtttgttatgttgcttaagatacttaattcggaacttatttatttgtgttaaaaatgtgttcttatttctattgtctggtagttttata

SEQ ID NO: 634 - DNA, 2475 bp, Trigonella foenum-graecum
catatcaacattgtcgtcattggacatgtcgactctggaaaatcaacaacaactggtcacttgatctacaagctaggaggtattgacaagcgtgtgattgagaggttcgagaaggaagctgctgaaatgaacaaacgttcattcaagtatgcatgggttcttgacaaacttaaggctgagcgtgaaagaggaattaccatcgatattgctttgtggaaatttgagaccaccaagtactactgcacagtcattgatgctcccggtcatcgtgatttcatcaagaacatgattactggaacctcccaggctgattgtgctgtccttatcattgactcaaccactggtggttttgaagctggtatctcaaaggatggacagacccgtgagcacgctcttcttgctttcacccttggagtgaagcagatgatctgttgttgtaacaagatggatgctaccacccccaagtactcaaaggctaggtacgatgaaatcatcaaggaagtttcttcctacttgaagaaggttggttacaacccagacaaaattcccttcgtacccatctccggttttgaaggtgacaacatgattgaaaggtccaccaaccttgactggtacaagggaccaactctccttgaggcacttgaccagatcaacgagcccaagagaccctcagacaagcccctcaggcttccattgcaagacgtttacaagattggtggtattggaactgtgccagtcggacgtgttgagaccggtgttgtgaagcccggtatggtggttacttttggaccaactggtttgacaactgaagttaagtctgttgagatgcaccacgaggctctcactgaagctcttcctggagacaatgtcggattcaatgttaagaatgttgcagtgaaggatctcaagcgtggtttcgttgcatccaactccaaggatgaccctgccaaggaagctgccaacttcacttcccaagtcatcatcatgaaccaccctggacagattggaaacggatatgcgccagtgctcgattgccacacctctcacattgctgtgaagtttgctgaacttgtcaccaagatcgacaggcgatctggtaaggagattgagaaggagcccaagtttttgaagaatggagatgctggtatcattaagatgattcccaccaaacccatggttgttgagactttctctgaatatcctccattgggacgtttcgctgtcagggacatgcgtcaaactgttgctgttggtgtcatcaagggtgtggagaagaaggatcctaccggagccaaagtcaccaaagctgctgccaagaagaagtgatctcacaccatggttattgcataagttgttcctttttactagtttattatctcttcagagtactttgttattccagttttatttttccagttttagaaacttacagaactgggttcttgatcggcgatggtactgtttttggttttatttgttaagagtctggagaacttgattttcgaaaggcagctaaaaggttttacatcttaattttgctgctgaaggatgttgtaatttcatttgatttacaaacagttttgtgatgtcaaacctttttgtttatctctctgcttctgttcaaaatatctttcctttattgcaaaaaaaaagaaaaaaaacaaaacatgtcggccgacggccggggatatctcaatacacatattactataacaacatttataagatgaagacctccattgcccttttaaccttactagctatattgttccacatgatgatggttggtcatgcctttgattgtgaagaagctaaggcatcaatacttccttgtattggatatctcattggtgatgatgatcatccttcaactgcttgttgtaatggtgtcaatgatttgaaatcttcggtgcccaccaaagacgatcgacacaaggcatgtgaatgtcttaaaaaagcctcgattcacttccctaaaataagggatgatttgaatgctttacttcctaaacgatgcggtgttcacataaactttactataagcaagaacatcaaatgtgctcaaattccttaagctatatgaggaatgagcaatggagaaaataaaaatttataatgggatggacacttggttgcttttctcaggaagaaataatagtccgttttatgtaatgatattgtcaattaaaaaaacaatatattatttttatattatgtggatctttctctcttgtgttgtggatcttcatatcataataaaagttaaattaatcaaggcataaaatgtggtttgctaatatcagtcaaaagataaatggataaacaactaatttagtaatctttgtaaaaaaaactaaatttagtagtcttgttttacatgaattcaagctaagctttcagggataccgtctcgtggtaagtatgaaattgcgtgtaataatctaaaaatattatagtgaaggaaggatttctccc

SEQ ID NO: 635 - DNA, 1610 bp, Cicer arietinum
ctctctctgcggctgaggattccgaacgagtcttagatttcatttcttctttgctaagatatcatgggtaaagaaaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctcccaagctgattgtgctgtccttatcattgactccaccactggtggttttgaggctggtatctctaaggatggacagacccgtgagcacgctcttcttgctttcactcttggagtgaaacagatgatctgttgttgtaacaagatggatgccactacccccaagtactccaaggccaggtacgatgaaatcgtgaaggaagtttcttcatacttgaagaaggttggttacaaccctgacaaaatccccttcgtgccaatctctggatttgagggagacaacatgattgagaggtccaccaaccttgactggtacaagggaccaactctccttgaggctcttgaccagatcaacgagcccaagagaccctcagacaagcccctcaggcttccattgcaagatgtttacaagatcggtggtattggaactgtgccagtcggacgtgttgagactggagtcatcaagcctggtgtgatcgttacctttggccctacggtctgacaactgaagttaagtctgttgagatgcaccacgaggctctcaccgaagctctccctggagacaatgttggattcaatgttaagatgttgcagtgaaggatctcaagcgtggtttcgttgcatccaactccaaggatgaccctgctaaggaagctgccaacttcacttcccaagtcatcatcatgaaccatccaggacagatcggaaacggttatgccccagtcctcgactgtcacacctcccacattgctgttaagttcgctgagcttctcaccaagatcgacaggcgatctggtaaggaacttgagaaggagcctagtttttgaagaatggtgatgctggtcttgttaagatgattccaaccaagcctatggttgtggaaactttctccgagtatccaccacttggcgtttcgccgtgaggggacatgcgtcaaaactgttgctgtcggtgtcatcaagagtgttgagaagaaggatccaactggagccaagatcaccaaagctgcagtgaagaagaagtgatggttgatgcagaagtggatgttgctttatagtagcttattatcttttaagagtcttagtttatttttgccttttaattttgccgtttttatgcagccaaacttgcaaaactgggttcttgatcggcgatggtcgacctttatttgtggttgtttgatttgatggtactgttttgaattaaattatgagtcttgagaacttattt

SEQ ID NO: 636 - DNA, 1888 bp, Cicer arietinum
agagacgccgaccacacctagtatattcttcagtctctctctgcggctgaggattccgaacgagtcttagatttcatttcttctttgctaagatatcatgggtaaagaaaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgccccggacatcgtgatttcattaagaacatgattactggtacctcccaagctgattgtgctgtccttatcattgactccaccactggtggttttgaggctggtatctctaaggatggacagacccgtgagcacgcccttcttgctttcactcttggagtgaaacagatgatctgttgttgtaacaagatggatgccactacacccaagtactcaaaggccaggtacgatgaaatcgtgaaggaagtttcttcatacttgaagaaggttggttacaaccctgacaaaatccccttcgttccaatctctggatttgagggagacaacatgattgagaggtccaccaaccttgactggtacaagggaccaactctccttgaggctcttgaccagatcaacgagcccaagagaccctcagacaagcccctcaggcttccattgcaagatgtttacaagatcggtggtattggaactgtgccagtcggacgtgttgagactggagtcatcaagcctggtgtgatcgttacctttggccctaccggtctgacaactgaagttaagtctgttgagatgcaccacgaggctctcaccgaagctctccctggagacaatgttggattcaatgttaagaatgttgcagtgaaggatctcaagcgtggtttcgttgcatccaactccaaggatgaccctgctaaggaactgccacttcacttcccaagtcatcatcatgaaccatccaggacagattggaaacggttatgccccagtcctcgactgtcacacctcccacattgctgttaagttcgctgagcttctcaccaagattgacagacgatctggtaaggaactcgagaaggagcctaagtttttgtaagaatggtgatgctggtcttgttaagatgattccaacaaagcctatggttgtggaaactttctccgagtatccaccacttggtcgttttgctgtgagggacatgcgtcaaactgttgctgtcggtgtcattaagagtgttgagaagaaggatccaactggagccaagatcaccaaggctgcagtcaagaagaagtgagtttgcacatcatcatcaccatggttgctgctgaagttgttcctttatagtagtttatctttccggagtcttagtttaattttgcagtttattttgcaagtctttgccggtttcattcagccaaacttacaaaactgggttcttgatcggcggtggtcatatttattttgtggttgtttttgatggtgctgtttttgcttatttgatcttttgagaacttcattttgtaaaagcagctaggtttcatggtttaattttgctgctgaaggatgttcaattgcatttaatttataagacattttttgtcaatccttcatcctgattttgttttatggttttatttttaatatccagtttatgaatgtgtaatgctttgattgagcttgtcatttagtaatatttgattgttcaaggcttcaatcaagtattcagacgttgatactacgtgt

SEQ ID NO: 637 - DNA, 1410 bp, Cicer arietinum
ctaagatatcatgggtaaagagaagtttcatatcaacattgtcgtcattggacatgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctcccaagctgattgtgctgtccttatcattgactccaccactggtggttttgaggctggtatctctaaggatggacagacccgtgagcacgctcttcttgctttcactcttggagtgaaacagatgatctgttgttgtaacaagatggatgccaccacacccaagtactcaaaggccaggtacgatgaaatcgtgaaggaagtttcttcatacttgaagaggttggtacaaccctgacaaaatccccttcgttccaatctctggttttgagggagacaacatgattgagaggtccaccaaccttgactggtacaagggaccaactctccttgaggctcttgaccagatcaacgagcccaagagaccctcagacaagcccctcagacttccattgcaagatgtttacaagatcggtggtattggaactgtgccagtcggacgtgttgagactggagtcatcaagcctggtgtgatcgtcacctttggccctactggtctgacaactgaagttaagtctgttgagatgcaccacgaggctctcaccgaagctctccccggagacaatgttggattcaatgttaagaatgttgcagtgaaggatctcaaacgtggtttcgttgcatccaactccaaggatgaccctgctaaggaagctgccaacttcacttcccaagtcatcatcatgaaccatccaggacagatcggaaacggttatgccccagtcctcgactgtcacacctcccacattgctgttaagttcgctgagcttctcaccaagatcgacaggcgatctggtaaggaacttgagaaggagcctaagtttttgaagaatggtgatgctggtcttgttaagatgattccaaccaagcctatggttgtggaaactttctccgagtatccaccacttggtcgtttcgtccgtgagggacatgcgtcaaactgttgctgtcggtgtcatcaagagtgttgagaagaaggatccaactggagccaagatcaccaaagctgcagtgaagaagaagtgatggttgatgcagaagtggatgttgctttatagtagcttattatcttttaagagtctt

SEQ ID NO: 638 - DNA, 1730 bp, Amorphophallus konjac
actctagagaggcggctagctctcctgctgctgccacaggacctgatctcttctttggctgttgcacgttaagacataatgggtaaggagaaggtacacatcaacattgtggtcattggccatgtcgactctggaaagtcgaccacaactggacatctgatctacaagcttggtggcattgataagcgtgtaattgagagatttgagaaggaagctgctgagatgaacaagaggtcattcaagtatgcttgggtgcttgacaagctgaaggctgagcgtgagcgtggtattacgattgatattgctctctggaaattcgagaccacaaaatactactgcaccgtgatcgatgcgccggggcacagagatttcatcaagaacatgatcacaggaacttctcaagcagactgtgcagttctcattatcgattccactactggtggttttgaagctggcatttccaaggacggtcagactcgcgagcatgcgctgcttgctttcacacttggagtgaagcagatgatttgttgttgcaacaagatggatgccaccactcccaagtattcaaaggcaaggtatgatgaaatcgtgaaggaggtgtcatcttacctcaagaagtggggtacaaccctgataagatcccattcgtcccgatctccggatttgagggcgacaacatgattgagaggtccaccaacctcgactggtacaaggggcccactctactcgaagccttggacttgatccaggagccaaagcgccctacggacaagccccttcgccttccccttcaggatgtctacaagattggaggcatcgggactgtgcccgtgggccgtgttgaaactggagtcctcaagcctggtatggtcgtcacctttggcccgactggcctgaccactgaagtcaagtctgttgagatgcatcatgaagccctcccggaggccctccccggtgacaacgtgggcttcaacgtcaagaacgttgctgtgaaggatctgaagcgtggtttcgtggcatccaactccaaggatgaccccgctaaggaggccgcgaacttcacctcccaggtcatcatcatgaaccacccgggccagatcggcaatggctacgccccggtccttgactgccacacctcacacattgccgtcaagtttgcggagatcctgacaaagatcgataggcgttctggtaaggagctggagaaggagcccaagttcctgaagaatggcgatgctgggtttgtgaagatgatccccaccaagcccatggtggtggagactttctccgagtaccccccacttggtaggtttgccgtgagggacatgaggcagacggttgcggtcggtgtcatcaaggccgtggagaagaaggatccaagcggcgccaaggtgaccaaggctgcccagaagaagaagtgaaccgaaaccgtattgctgctctctgcacctacggtggtggtggtggttgttgagcctacttccattttatgtcgtcgtcgtcgtcgcagtgtcaagtgtgctagttttgcttattgtgtgttgtccgtggatttcctgtccagcatttggatgcagaactgggttctagactggcggtggcaggggtaaaaagagagggctttgattgcttgcccctgcggcgttcagcccttacgctttggccaccacctcttctctttcattcgagtcatttttctgttgtgtcttttatgttgatgcggtctgcag

SEQ ID NO: 639 - DNA, 1739 bp, Amsonia hubrichtii
gttctgtccttgcatctctttcggacttggagcgcagcctctcgtttgctctacttcccaagttttctatctgttcagcatgggtaaggaaaaggttcacattaacatcgtggtcattggtcatgtcgactctggcaagtcgaccaccactggtcacttaatatacaagcttggtggtattgataagcgtgtgattgaaaggttcgagaaggaggctgctgagatgaacaagaggtcattcaagtatgcatgggtgctcgacaagctcaaggctgagcgtgagcgtggaatcaccattgatattgccttgtggaagtttgaaacaaccaagtactactgcactgtcattgatgcccctggacatcgtgactttatcaagaacatgattactggtacctcacaggctgactgtgccatcctcatcattgactccaccactggtggttttgaagctggtatctccaaggatggtcagacccgtgagcatgccttgcttgcttttacgcttggtgtgaagcaaatgatttgctgctgtaacaagatggatgccaccacccccaagtactccaaggctaggtacgatgaaattgtgaaggaagtctcatcatacctcaagaaggtcggatacaaccctgacaaaatccccttcgtccccatctctggttttgagggagacaacatgattgagagatccaccaacctcgactggtacaagggcccaaccctccttgaggctcttgaccagatctctgagcccaagagaccctcagacaagccactccgtctcccacttcaggatgtttacaagattggtggtattggaactgtccctgtgggtcgtgtagaaactggtgtcctcaagcccggtatggttgtgaccttcggtccaactggtctgacaactgaagttaagtcagttgagatgcaccacgaatcccttctggaggctcatcccggtgacaacgttgggttcaatgtgaagaatgttgctgttaaggatctgaaacgtggttttgttgcatccaactccaaggatgacccagccaaggagctgctagcttcacctcacaggtcatcatcatgaaccaccctggccagattggaaatggatatgccccagtactggactgccacacctctcacattgccgtgaagtttgctgagatcttgaccaagattgacagacgatctggtaaggagctggaaaaggagcccaagttcttgaagaacggtgatgctggtatggttaagatgattcccaccaagcccatggttgtggagaccttctctgagtacccacctcttggtcgttttgctgtaagggacatgcgtcaaactgttgctgttggtgtgatcaagagtgttgacaagaaggacccaactggtgccaaggtcaccaaggctgctgctaagaagggtgccaagtgaagaagttggttcatgaggagttttcatattgttgaactatcttttgttatttgctttagtgataatcgattttgttttggacatgttagcagttttgaatgtctctggtggttctgttcacagctctctagccttacttttgaggatagtggagaaatggagcaagctctgcttgttcgatggcagtggaatcaggccatctcgagtcatctttaatcgttttcgaaattttataggatgagttgtagtccttggtcggtaaacagtgttttgtgccatttaaggatttaagtatattccaattgatggtt

SEQ ID NO: 640 - DNA, 1718 bp, Gossypium hirsutum
cgcgctgcggtcacctagtggatccaaagaatcggccgagtctccttctgtttctggtcaagccaatctcaaaagactccccttttagctcacagctcctctcttgagtactataatgggtaaggagaaggttcacatcaacattgtggtcattggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgagcgtgaacgtggtattaccatcgatattgccctctggaagtttgagactaccaaatactactgtactgtcattgatgcccctggacatcgtgacttcatcaagaacatgattactggtacctcacaggctgactgcgctgttctcattatcgactcgaccactggtggtttcgaagctggtatctcaaaggatggtcagacacgtgagcatgctttgcttgcgtttacccttggtgtcaagcagatgatttgctgctgcaacaagatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccgctccggctcccacttcaggatgtctacaagattggcggcattggaactgtgcctgttggtcgtgttgagactggtgtccttaagcctggtatggtagtgacctttggcccctctggtctgaccactgaagttaagtctgttgagatgcaccatgaagccctctctgaggctctccctggtgacaatgttggattcaatgtcaagaacgttgctgttaaggatctcaagcgtggtttcgttgcttcaaactctaaggatgatcctgcaaaggaggctgccagcttcacctctcaggtcatcatcatgaaccaccctgggcagattgggaaacggatatgccccagtccttgactgccatacctcccacattgctgtgaaattttccgaattgctgaccaagatcgacaggcgatctggaaaggagcttgagaaggagcccaagttcttgaagaatggtgatgcagggatgataaagatggttcccaccaagcctatggttgtggagactttctctgagtacccaccacttggacggtttgctgtcagggacatgcgtcagactgtggctgttggtgtcatcaagagcgttgagaagaaggacccaacgggtgctaaggtcaccaaatctgctgccaagaagaaatgagattgcatttgatagtatcagagccttttgattttggttatctttgtagtttggtacttgcagttttttagaccaattttgatgtgtgttcatttggttgagactgtcatctgcatacggattgtgtgtttgctttttccgtgtcaattttagttgaattccttcaaagaatgctaatttgatatttccttgttttcttattgttatgatggtcctaagccttcggttttcagctaatttcgtggtcaaatcaggttt

SEQ ID NO: 641 - DNA, 1396 bp, Flaveria ramosissima
tgagagatcgtctgcatattcttcgttaaggatgggtaaggaaaagacgcatatcagtattgttgtcattggacatgtcgactccggcaagtctaccactaccggacatcttatctacaagcttggtggtatcgacaagcgtgtgattgaaaggttcgagaaggaagctgctgagatgaacaagaggtccttcaaatacgcttgggtgctcgacaagctcaaggcagagcgtgaaagaggtattaccattgatattgccttgtggaagttcgagaccaccaagtactactgcactgtcattgatgctcccggacatcgtgatttcatcaagaacatgattactggtacctcccaagctgactgtgctgtcctcatcattgactcgaccactggtggttttgaggctggtatttccaaggatggtcagacccgtgagcacgcgcttcttgctttcactcttggtgtcaagcaaatgatttgctgctgtaacaagatggatgccaccaccccgaaatactccaaggcaaggtatgatgaaattgtgaaggaagtttcttcatacttgaagaaggtcggatacaaccccgacaaaatcccatttgtgccaatctctggtttcgaaggagacaacatgattgagaggtccaccaacctcgactggtacaagggtcccacccttcttgaagctcttgaccagatcaacgagcccaagagaccctcagacaagccacttcgtctcccacttcaggacgtgtacaagatcggtggtattggaactgtgccagtgggacgtgttgagactggtgtgatcaagcctggtatggttgtcacttcggaccatctgggttgaccactgaagttaagtctgttgagatgcaccatgaagccctaaccgaggctctccccggtgacaatgttgggttcaacgtcaagaacgttgctgtcaaggatctcaagcgtggttacgttgcctcaaactccaaggatgatcctgccaagggtgcagccagcttcacctctcaggtcatcatcatgaaccaccctggtcagatcggtaacggttatgccccagttcttgattgccacacctcccacattgccgtcaagttctctgagcttttgaccaagattgacagacgatctggtaaggagctcgagaaggagcctaagttcttgaagaacggtgatgctggtatggttaagatgcttcccaccaagcccatggttgtcgagacctttgctgaatacccaccacttggaaggttcgccgtgagagacatgcgtcagacagttgccgtcggtgttatcaagagcgtcgagaagaaggacccaaccggagccaaggtgaccaaggctgcagtgaagaagggagccaagtgaggtgaggtggtttgtg

SEQ ID NO: 642 - DNA, 1666 bp, Flaveria ramosissima
ctccatcgctctgcacaaatcggcgagcatcacaattcacaggcagattcttcaccaagtttttttgatctctcagaatgggtaaggaaaagactcacatcagcattgtggtcattggacatgtcgactctggcaagtcaacaaccactggtcatttgatttataagcttggaggaattgacaagcgtgttattgagaggtttgagaaagaagctgctgaaatgaacaagaggtcattcaagtatgcgtgggttcttgacaaactgaaagctgaacgagaacgtggaatcactattgatattgctttgtggaaattcgagactaccaagtattattgcactgttattgatgcacctggacacagagatttcatcaagaatatgattactggtacatctcaggctgattgcgctgtcttgattattgactctaccactggtggtttcgaagctggtatctctaaagatggtcagacccgagagcatgctctgcttgcttttacccttggtgtgaagcaaatgatctgctgttgtaacaagatggatgccaccacccctaaatactccaagtcaagatacgaagaaattgttaaggaagtttcttcatacctgaagaaggttggttacaacccagacaaaatcccatttgtacccatctccggtttcgagggtgacaacatgattgagaggtctacaaaccttgactggtacaagggtccaacacttcttgaagctcttgaccagatcaacgagaccaaaaagaccctctgacaaaccacttcgtcctaccccttcaagacgtgtacaagattggaggtattggaactgtgcccgtcggtcgtgtcgaaaccggtgtaatcaaacccggtatggttgtctacttttggtccatcttgggttgaccactgaagtcaagtcagtcgaaatgcaccacgaggccctaaccgaagctctccctggtgacaacgtcgggttcaacgtcaagaacgttgcagtcaaggatcttaaacgtggttacgttgcttccaactccaaggatgaccccgccaagggtgcagccagtttcacctcgcaggtcatcatcatgaaccaccctggtcagatcggaaacggatatgccccagtcctggattgccacacttctcacattgcagtcaagttctccgagcttttgaccaagattgaccgtcggtccggtaaagaactcgagaaagagcccaagtttttgaagaacggtgatgctggtatggttaagatgcttccaaccaagcccatggttgttgaaactttcgcagagtacccaccacttggcaggtttgcagttcgtgacatgaggcagacggttgctgttggtgtgatcaagagtgtcgataagaaggacccgactggagccaaggtgaccaaggctgcagccaagaagggagccaagtgatggtgcgggtgtgtgtcgtttggtgtcgatggacctgttttaattgtgtttttggactattttaattatgcttatttttggtatttggtcttgtggcttgcattattgtactctagcctcagttgtgaggatgggtggaggtattgagcaacttgttgcttgatgacaatggtgcaagttttacatgaaccagattttggtcatattgtgctgctacttttttcaaattttaatt

SEQ ID NO: 643 - DNA, 1504 bp, Setaria italica
ttaagcttcaccggcagccatgggtaaggagaagtcccacatcaacattgtggtcattggccacgtcgactctggcaagtcaaccaccaccggccacctgatctacaagcttggaggtatcgacaagcgtgtgatcgagaggttcgagaaggaggccgctgagatgaacaagcggtccttcaagtacgcgtgggtgcttgacaagctcaaggctgagcgtgagagaggtatcaccattgatatcgccctgtggaagtttgagaccaccaagtactactgcaccgtcattgacgcccctggacatcgtgacttcatcaagaacatgatcactggtacctcccaggctgactgtgctgtccttatcattgactccaccactggtggttttgaggctggtatctcaaaggatggccagacccgtgagcatgctctccttgctttcactctcggagtgaagcagatgatctgctgctgcaacaaggtatgatccactcccaagtactccaaggcccgttatgatgagattgtgaaggaagtctcctcctacctgaagaaggtgggttacaaccctgacaagattgccttcgtccccatctccggttttgagggtgacaacatgattgagaggtccaccaaccttgactggtacaagggcccaaccctgcttgaggctcttgaccagatcaacgagcccaagaggccttcggacaagcccctgcgtcttccccttcaggatgtgtacaagattggtggtattggaaccgtccctgttggccgtgttgagaccggtgtcatcaagcctggtatgcttgtcacctttggtccaactggcctgactactgaggtgaagtctgttgagatgcaccatgaggctctccaggaggcccttcctggtgacaacgttggcttcaacgtgaagaacgttgctgttaaggatctcaagcgtggttttgtggcctccaactccaaggatgaccctgccaaggaggctgccagcttcacctcccaggtcatcatcatgaaccaccctggccagatcggcaatggttacgccccagtcctggactgccacacctcccacatcgctgtcaagtttgctgagctcattaccaagatcgacagacggtccggtaaggagcttgagaaggagcccaagttcctgaagaacggcgatgctggtatggtgaagatgattcccaccaagcccatggtggtggagaccttctctgagtaccctcctctgggtcgctttgctgtccgtgacatgaggcagacggttgctgtgggagtcatcaagagcgtggagaagaaggacccgaccggcgccaaggttaccaaggctgctgccaagaagaaatgatgggcctggtggttaatcctgcatctgcttttgcgatacctaggtgccttgcctctatcacacaagttttgtccgccaccacttctgttatcctgtaaactgttgaggtctgctggcggtgtgccatgtgtctgttgtttaggt

SEQ ID NO: 644 - DNA, 1351 bp, Setaria italica
gcccatcatttcttcttggcagcagccttggtaaccttggcgccggtcgggtccttcttctccacgctcttgatgactcccacagcaaccgtctgcctcatgtcacggacagcaaagcgacccagaggagggtactcagagaaggtctccaccaccatgggcttggtgggaatcatcttcaccataccagcatcgccgttcttcaggaacttgggctccttctcaagctccttaccggaccgtctgtcgatcttggtaatgagctcagcaaacttgacagcgatgtgggaggtgtggcagtccaggactggggcgtaaccattgccgatctggccagggtggttcatgatgatgacctgggaggtgaagctggcagcttccttggcagggtcatccttggagttggaggccacaaaaccacgcttgagatccttaacagcaacgttcttcacgttgaagccaacgttgtcaccaggaagggcctcctggagagcctcatggtgcatctcaacagacttcacctcagtagtcaggccagttggaccaaaggtgacaagcataccaggcttgatgacaccggtctcaacacggccaacagggacggttccaataccaccaatcttgtacacatcctgaaggggaagacgcaggggcttgtccgaaggcctcttgggctcgttgatctggtcaagagcctcaagcagggttgggcccttgtaccagtcaaggttggtggacctctcaatcatgttgtcaccctcaaaaccggagatggggacgaaggcaatcttgtcagggttgtaacccaccttcttcaggtaggaggagacttccttcacaatctcatcataacgggccttggagtacttgggagtggaacataccttattgcagcagcagatcatctgcttcactccaagagtgaaagcaaggagagcatgctcacgggtctggccatccttggagataccagcctcaaaaccaccagtggtggagtcaatgataaggacagcacagtctgcctgggaggtaccggtaatcatgttcttgatgaagtcacggtgtccaggggcgtcaatgacggtgcagtagtacttggtggtctcgaacttccacagggcaatatcaatggtgatacccctctcacgctcagccttgagcttgtcaagcacccacgcatacttgaaggacctcttgttcatctcagcggcctccttctcgaacctctcgatcacacgcttgtcgatacctccaagcttgtagatcaggtggccggtggtggtcgacttgccagagtcgacgtggccaatgaccacgatgttgatgtgggacttctccttacccatggctg

SEQ ID NO: 645 - DNA, 1416 bp, Plantago ovata
aggacttaaccatgggtaaggagaagtttcacatcaacattgttgtcattggtcatgtcgactctggaaagtcgaccacaactggtcatttgatctacaagctaggtggcattgacaagcgtgtcattgaaagattcgagaaggaggctgctgagatgaacaaaaggtcgttcaagtatgcctgggtgctcgacaagcttaaggctgagcgtgaacgtggtattactattgatattgccttgtggaagtttgagaccaccaagtattactgcactgtcatcgatgcccctggacatcgtgactttatcaagaacatgattacgggtacatctcaggctgattgtgctgttctaattattgattccaccactggtggttttgaagctggtatttccaaggatgggcagacccgtgagcatgcattgcttgcttttacacttggtgtgaagcaaatgatctgttgctgtaacaagatggacgctaccacgccaaaaatactccaagcccagatatgatgaaatcgtgaaggaagtttcctcttacctcaagaaggttgggtacaaccctgacaaaatcccatttgtccccatctctggatttgagggtgacaacatgattgagagatccaccaatcttgactggtataagggtcccacccttcttgaagctttggaccagatctccgagcccaagaggccttcagacaagcccctccgtctacctcttcaggatgtctataagattggtggaatcggtactgtacccgttggtcgtgttgaaactggtgtcatcaagcccggtatggtcgtcacctttggcccttctggcttgaccactgaagtaaagtctgttgaaatgcatcacgaatccatgccggaggctctcccaggtgacaatgttggctttaacgtgaagaacgttgcagttaaggatctcaagcgtggttatgttgcttcaaactccaaggatgatcctgctaaggaagctgccaacttcacctcccaggtcattatcatgaatcaccctggacaaattggacaaggatatgctcctgtgcttgactgccacacatcccacattgctgtcaagtttgctgagttggtgaccaagattgacagacgttctggtaaagaacttgagaaggaacctaagttcttgaaaaacggtgatgctggtttcgtgaagatgattccaagcaagcctatggtggttgagactttctccgagtaccctcctcttggccgttttgctgttcgtgacatgaggcagactgttgctgttggtgtgatcaaaagcgtggagaagaaggatccctctggagccaaggtgactaaagctgcagccaagaagggtgccaagtgaccagtgcaggttctcgcttgctctacctttaatgccagggaacagtttttctat

SEQ ID NO: 646 - DNA, 1704 bp, Papaver somniferum
gaaagctctgtgccgcggagcttatctaatcgccgtttcagttaattctaagaattcaatatgggtaaggagaaagttcatatcaacattgttgtcattggacatgtcgactctgggaaatcgaccaccaccggtcacttgatctacaagcttggaggtattgacaagcgtgttattgaaagattcgagaaggaggctgctgagatgaacaagaggtcattcaagtacgcatgggttctgacaagcttaaggctgaacgtgagcgtggtattaccattgatattgccttgtggaagtttgagaccaccaagtactactgcacagttattgatgctcctggacatcgtgacttatcaaaaacatgattactggtacttctcaggctgattgtgccgtcctcattatcgattccaccactggaggttttgaggctggtatctcaaaggatggtcagactcgtgagcatgctcttcttgctttcacccttggtgtcaagcagatgatctgttgttgtaacaagatggatgccaccacccccaagtactcaaaggctaggtatgatgaaattgtcaaggaggtctcatcttacttgaagaaggttggatacaacccagaaaaaattgcctttgttcctatctctggatttgagggagacaacatgattgaaaggtccaccaaccttgactggtacaagggaccaactctccttgaggctcttgacaacatctctgagccaaagagaccctcagacaagccccttcgtcttccccttcaggatgtttacaagattggaggtattggaactgtgccagtgggacgtgttgaaactggagtcatcaagcctggtatggttgttacttttggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactcaaaggatgaccctgccagggaagctgccaacttcacctcccaggtcatcatcatgaaccatcctggtcagattggtaatggttatgctccagttcttgactgtcacacatctcacattgctgtcaagtttgctgagatccaaaccaagatcgataggcgatctggaaaggagcttgagaaggagcccaagttcttgaagaacggtgatgctggtattattaagatgattccaacaagcccatggttgtagagacctttgctcagtacccacctcttggacgttttgctgttagggacatgaggcagacagttgctgttggtgtcatcaagggggttgagaagaaggacccaaccggagccaaggttaccaagtctgctgtcaagaagaagtaaagtactccagtgagtacagggatggtgctaagagggtctgcagaatggttttgtcttgtttacttcagtagtagtcatttttgtttctggtttgctttggttagctatcattgcagttttatatcttttgttgcctttgttttgttgagcatccggatgcaaacctgggtgcttgataggcggtggcaacatgagtttgggctgttcagttaattgaaaacttgttatggattttggtttgtaagttgctgttaacaactttttatttgcatctctctttcccagttaaatgaaaacagtgtt

SEQ ID NO: 647 - DNA, 1748 bp, Papaver somniferum
gcaaacctgggtgcttgataggcggtggcaacaaaagatataaaactgcaatgatagctaaccaaagcaaacaagaaacaaaaatgactactacttttccgaagaagctctgtgctgcggagcttttctaatcgccgtttctgttattttctaagaattcaatatgggtaaagagaaggttcacatcaatattgttgtcattggacatgtcgactctggtaaatcgaccaccactggtcacttgatctacaagcttggaggtattgacaagcgtgttattgaaagattcgagaaggaggctgctgagatgaacaagaggtcattcaagtacgcttgggttcttgacaagcttaaggctgaacgtgagcgtggtattaccattgatattgccttgtggaagtttgagaccaccaagtactactgcacagttattgatgctcctggacatcgtgactttatcaaaaacatgatcactggtacttctcaggctgattgtgccgtcctcattatcgattctaccactggaggttttgaggctggtatctcaaaggatggtcagactcgtgagcacgctcttcttgctttcacccttggtgtcaagcagatgatctgttgttgtaacaagatggatgccaccacccccaagtactcaaaggccaggtacgatgaaattgtgaaggaggtctcatcttacttgaagaaggttggatacaacccagaaaaattgcctttgttcctatctctggattcgagggagataacatgattgaaaggtccaccaaccttgactggtacaagggaccaactctccttgaggctcttgacaacatctctgagccaaagagaccatcagacaagccccttcgtcttccccttcaggatgtttacaagattggaggtattggaactgtgccagtgggacgtgttgaaactggagtcatcaagcctggtatggttgttacctttgggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactccaaggatgaccccgccagggaagctgccaacttcacctctcaggtcatcatcatgaaccatcctggtcagattggtaacggttatgctccagtcctcgactgtcacacatctcacattgctgttaagttcgctgagatcctcaccaagattgataggcgatctggaaaggagcttgagaaggagcccaagttcttgaagaatggtgatgctggtattatcaagatgcttccaaccaagcccatggttgtggagaccttctctcagtaccctcctcttggacgttttgctgttagggacatgaggcagacagttgctgttggtgtcatcaaggaagttgagaagaaggacccaacaggagccaaggttaccaagtctgctgtcaagaagaagtaaagtactccagtaagtacagggatggtgctaagaggttctgcagaagggttttgtcttgtttacttcagtagtcatttttgtttttggtttgctttggttagctatcatcatcgcagtgttatatcttttgttgcctttgttttgttgagcatccagatgcaaacctgggttcttgataggcggtggcaacatgagtatgggctgttcagttgaaaacttgttatggattttggtttgtaag

SEQ ID NO: 648 - DNA, 1632 bp, Silene vulgaris
atctcgtctcaatctgttttgttaacaagtaatcatgggtaaagaaaagattcacatcagtatcgtcgtcattggacatgtcgactctggcaagtccaccactactggtcacttgatctataagcttggtggtattgacaagcgtgttatcgagaggttcgagaaggaagctgctgagatgaacaagagatctttcaagtatgcctgggtgcttgacaagctcaaggctgagcgtgaacgtggtatcactattgatattgccttgtggaagtttgagaccaccaaatactactgcacagtcatcgatgcccctggtcaccgtgactttatcaagaacatgattactggaacctcccaggctgattgtgccgtcctcattatcgactccaccactggaggttttgaggctggtatctccaaggatggtcagacccgtgagcatgctcttctcgctttcacccttggtgttaagcagatgatctgttgtcttaacaagatggatgccaccactcccaagtactcaaagtccaggtatgaggaaattgtgaaagaagtcagctcatacctcaagaaggttgggtactaaccctgacaaggttccatttgttcccatttctggttttgacgggtgacaatatgattgagaggtccaccaaccttgactggtacaagggtcctacccttcttgaggctcttgaccaggtttctgagcccaagaggccctcagacaagcccctacgtcttccacttcaggatgtttacaagattggaggtattggaacggtgcctgtcggacgtgttgagactggtgtcatcaggcctggtatgcttgttacctttggtccaactgggttgaccactgaggtaaagtctgttgagatgcaccacgagtccatgcctgaggccctcccaggtgacaatgttggattcaatgttaagaatgttgcagtcaaggatctcaagcgtggttttgtcgcctctgactcaaagaatgaccctgctaaggaggcagccaacttcacatcacaggtcatcatcatgaaccaccctggccagatcggaaacggttatgccccagtcctcgactgccacacctctcacattgctgtcaagtttgctgagcttgtcaccaaaattgacagacgatcaggaaaggagttggagaaggagcccaagttcttgaagaatggtgatgctggtatggttaagatgattcccacaaagcccatggttgtggagaccttctcagagtacccacctcttggtcgtttcgctgtgagggacatgaggcagactgtggccgttggtgtcatcaagaatgttgagaagaaggatcccacaggtgccaaggtcaccaaggctgctttgaagaagaaatgagtttgggaggctgttgcaccgtattacttgcttgttcagtagggatttattttgctattttcattttctagtttttaaacaattggcttcaccgtatctggcatctattctcagaattgggtgctagagtgacgctggtatacctgttgatgtttcattttgggttgccctggtaacttttgagtttatcggattctgtcgaattctcttttttttttgaggtttaagagatgattctacgtattaaaaaaa

SEQ ID NO: 649 - DNA, 1840 bp, Phaseolus vulgaris
ttcctcacttctcttcactctatcattctcctttcttctcttgcggctagggttttagcgcagcttcttctagatactcaaacgcagttatgggtaaggaaaaggttcacatcagtattgtggtcattggtcatgtcgactctgggaagtccaccaccactggccatctgatctacaagcttggaggcattgacaagcgtgtgattgagaggttcgaaaaggaagctgctgagatgaacaagaggtcattcaagtatgcctgggtgcttgacaagctcaaggctgaacgtgaaagaggaattacaattgatattgccttgtggaagtttgaaaccactaagtactactgcacagtcattgatgctcccggacacagggatttcattaagaatatgattaccggaacatctcaagctgactgtgctgttctcatcattgattctaccactggtggttttgaagctggtatttctaaggatggacagactcgtgaacatgctcttctgtctttcactcttggtgtgaagcagatgatttgttgctgtaacaagatggatgctactacacccaagtactccaaggctaggtatgatgaaattgtgaaggaagtctcttcctacttgaagaaggtgggatacaaccctgacaaaattcctttcgtaccaatttctggttttgagggagacaacatgattgagaggtccacaaacctcgactggtacaagggacctaccttgcttgatgcacttgaccagatctctgagcccaagaggccatctgacaagcctctcaggcttcctcttcaggatgtttacaagattggaggaattggaactgtgcctgtgggacgtgttgagactggtgtcatcaagcctggtatggtggtgacttttgcaccatctggactgacaactgaagttaagtctgtggagatgcatcatgaagctctcacagaggctctccccggtgacaacgtggggttcaatgtgaagaatgttgctgttaaggatctcaagcgtggttatgttgcttcaaactccaaggatgatcctgccaaggaggctgctaacttcacctcccaggttatcatcatgaaccaccctggtcagattggaaatggctatgcccctgttctggattgccacacctcccacattgctgtcaagtttgctgaacttatgaccaagattgacaggcgatctggcaaagagctcgagaaggagcctaagttcttgaagaatggtgatgctggatttgttaagatgattccaaccaaacccatggtggtggagactttctctgagtatccccctcttggtcgttttgctgtgagggacatgcgtcaaactgttgctgtgggagtcatcaagagcgtggagaagaaggatcccactggagccaaggttaccaaggccgcacagaagaagaagtgaatcgtgctgggcggttcaacaggggatggttataataaatgctggtttcttgcttgtactcttgtgtcatcgctaggtagattgtttttcgtacttagtttgaagtttccgccatcatctccgaacttttgttcccagaattgggttcttgatcgacggtggcggctcttttactattattatgtctttttatgtctttttgtgtttttgtgagaacccctgattacatttttgtaagcgcagcaagttttacggctttgctgcgtggtttgtttgcattttaaatatcggacttttatatttgtgttttaaatcgtgtttcctaattattttcagcattttaaatgttatctgtcatttctgtcgttttaaatattatctgccttgcattattatttatcgtctgc

SEQ ID NO: 650 - DNA, 1802 bp, Nicotiana benthamiana
gcttcgcttcgttcgttctgcgcagccagggttttagcgaagctctctcgcctttttctttcttttcttcttctaaagtttctaaggaatcatgggtaaagagaaggttcacatcaacattgtggtcattggccatgttgactctggaaagtcgaccaccactggccacttgatctacaagcttggtggtattgacaagcgtgttattgagaggttcgagaaggaggctgctgagatgaacaagaggtcattcaagtatgcttgggtgcttgacaagcttaaggctgagcgtgagcgtggtatcaccattgatattgccttgtggaagtttgagaccaccaagtactactgcactgtgattgatgcccccggacacagggactttatcaagaacatgatcactggtacttcccaggctgattgtgctgttcttattattgactccaccactggtggttttgaagctggtatttccaaggatggtcagacccgtgagcacgcattgcttgctttcactcttggtgtcaagcaaatgatttgctgctgcaacaagatggatgctaccaccccaaagtactccaaggctaggtatgatgaaatcgtgaaggaagtttcttcctacctcaagaaggtcggttacaaccctgacaagatcccctttgtccccatctctggtttcgagggagacaatatgattgagaggtctaccaaccttgactggtacaagggccctaccctccttgatgctcttgaccagattaatgagcccaagaggccctcagacaaacccctccgtcttccacttcaggatgtttacaagattggcggtattggtactgtccctgtcggtcgtgtggagactggtgtgctcaagcctggtatggttgtgacctttggccctactggtctgacaactgaagtcaagtctgttgagatgcaccacgaagctcttcaggaggcactccctggtgacaatgttgggtttaacgttaagaatgttgctgttaaggatctcaagcgtggttttgttgcctcaaactccaaggatgacccagccaagggagcatccagcttcacctcccaggtcatcatcatgaaccatcctggccagatcggaaatggatatgcaccagtgcttgattgccacacttcccacattgctgtcaaatttgctgagatcttgaccaagattgacaggcgttctggtaaggaacttgagaaagagcctaagttcttgaagaatggtgatgctggtatggttaagatgattccgaccaagcctatggttgttgagaccttctctgagtacccaccattgggtcgttttgctgtgagggacatgcgacaaactgttgctgttggtgtcatcaagaatgttgacaagaaggacccaactggtgccaaggtcaccaaggctgcccagaagaaaaagtgaacagtgcagtgtagtgctggtgtttccgatgctatcttttatcgccaagtgtgttatgtagactatattttatttagttggactttagttttgtctttgattttgtgttctggttctctgccttgtatgtcaggtagccattctcagaactgggtgcttgacaggcggtggcaagcatgatgagtctgaattcattgtgttgaggaggtgccgtggttttccatggcggctcaggatttttgctatttatgttgcctaaaagtactaaatttgagttttaaatctttctactctctcccttctgtgattaaagattaaataaatgtcttatacaatgcgttagttgaagatatgttatttgttaaaa

SEQ ID NO: 651 - DNA, 1798 bp, Nicotiana benthamiana
attttccattgactttctcctgctgcgccgcaagggacttatcggagcttaatttctctttctcaaagtctcttaagtcactcaatatgggtaaagagaaggttcatatcaacattgtggtcattggccacgtcgactctggaaagtcgactaccactggtcacttgatctacaagcttggtggtattgacaagcgtgttattgagaggttcgagaaggaagctgctgagatgaacaagaggtcattcaagtatgcctgggtgcttgataagcttaaggctgaacgtgagcgtggtatcaccattgatattgccttgtggaagtttgagaccaccaaatactactgcactgtgattgatgcccccggacacagggactttatcaagaacatgatcaccggtacttcccaggctgattgtgctgttcttattattgactccaccactggtggttttgaagctggtatttccaaggatggtcagacccgtgagcacgcattgcttgctttcactcttggtgtcaagcaaatgatttgctgctgcaacaagatggatgctaccacccccaagtattccaaggctaggtatgatgaaattgtgaaggaagtttcttcctacctcaagaaggtgggttacaaccctgacaaaataccctttgtccccatctctggtttcgagggagacaatatgattgagaggtctaccaaccttgactggtacaagggcccaaccctccttgaggctcttgaccagattaatgagcccaagaggcccacagacaaaccccttcgtcttccacttcaggatgtttacaagattggtggcattggaaccgtccctgttggtcgtgtggagactggtgtgctcaagcctggtatggttgtgacctttggccctactggtctgacaactgaagtaaagtctgttgagatgcaccacgaagctctccaggaggcactccctggtgacaatgttgggttcaacgttaagaatgttgctgttaaggatctcaagcgtggttttgttgcctcaaactccaaggatgacccagccaagggagcgtccagcttcacctcccaggtcatcatcatgaaccatcctggccagatcggaaatggatatgcacctgttctcgactgccacacttcccacattgctgtcaagtttgctgagatcttgaccaagattgacaggcgttctggtaaggaacttgagaaagagcctaagttcttgaagaatggtgatgctggtatggttaagatgattccgaccaagcctatggttgttgagaccttctctgagtacccaccattgggtcgttttgctgtgagggacatgcgacaaactgttgctgttggtgtcatcaagaatgtcgacaagaaggacccaacaggtgccaaggtcaccaaggctgcccagaagaaaaagtgaacactgcactgtaatgctggtgtttccagtgctatctattatcttctaagtgtgttatgtagaccctgttttatttagttctgctatctttttgtctttgattttaggttctagttctctgccatgtatgtcaggtatctattctcagaactgggtacttgacaggcggtggccagcaggacttcgagtctgccttcattttgtcgaggaggtgccttggttttccatggcagctcaggatttttgctatttatgttgcctaaagtacttaatttgaccttttaaaacttttctactctttgccttctgcgactgattttagcttctgaaggaatatagtgatactttattctagatatggatgttaa

SEQ ID NO: 652 - DNA, 2075 bp, Prunus mume
tcaaaagtggcgacaccatgtctaaggattagggcatcagcagcgccgcagtggcaagtgagcactacaaccgttagatcaaatctaccaagatccaacggtgcataaagaaaccctaaccaaacagatgtagcaattgctcctctttaaatccccaagcctctcattctcttcatcctctcctccctcactcttcagactcaagtcggcggcgagagagatccccccatatattcttcactttgagtttcttgagatatcttgctgaaattccatcatgggtaaagagaagtttcacatcaacattgtggtcattggccatgtcgactccgggaaatcaaccaccaccggtcacttgatctacaagcttggtggtattgacaagcgtgttattgagaggtttgagaaggaggctgctgagatgaacaagaggtcattcaagtatgcctgggtgttggacaagctcaaggctgagcgggaacgtggtattactattgatattgccttgtggaagtttgagaccaccaagtactactgcacagttattgatgctcctggacatcgtgactttatcaagaacatgattactggaacctcccaggctgattgtgctgtcctcattattgattccaccactggtggttttgaagctggtatttccaaggatggtcagacccgtgagcatgctttgcttgcttttactcttggtgtcaagcagatgatttgctgctgtaacaagatggatgccaccactcccaagtactcaaaggcaaggtacgatgaaattgtgaaggaagtctcatcctatcttaagaaggttgggtacaacccagataaaattgcctttgtccccatttctggatttgagggtgataacatgattgagaggtccactaaccttgactggtacaagggtcccacccttcttgaggcccttgacttgatcaatgagcccaagaggccctcagacaagcccctccgactcccacttcaggatgtgtacaagattggtggcattggtactgtacctgttggacgtgttgagactggtgttgtgaagcctggtatggttgttacttttggtcccactggactgacaactgaagttaagtctgttgagatgcaccatgaagctctccaggaggcttttccaggtgacaatgttggattcaacgtcaagaatgttgctgtcaaggatctcaaacgtggttttgttgcttcaaactccaaagatgatcctgcaaaggaggctgccaactttacctctcaggtcatcatcatgaaccaccctggccagattggaaatggatatgctccagttcttgactgccacacctcccacattgctgtcaagttttctgagatcttgacaaagattgataggcgatctggtaaggagattgagaaggagcccaagttcttgaagaatggagatgctggtatggtgaagatgattccaaccaagcccatggttgttgagacgttctctgagtacccgccacttggtcgttttgccgtgagggacatgcgacagacagttgctgttggtgtcatcaagagtgttgagaagaaggatccaaccggtgccaaggtcaccaaggctgcagcaaagaagaagtgagatgtgttttaccgtgcccttgagctaggctagttttgtccaatgctgtttcttttcaattgtttggtgttattatggaagttttgtggacagttttgaatgtttacatcgtagtactctaccaaccccttgtaagggttgtggaggagctgagcagttggatcatcctccggttgctctgctagctgtgttgtaggctcctcgtgttttcgttttatacattgagatgagttgtgtagttgaacaacttcgtattaatgtttgcagcttctgtttttgtgttttaacttcgatttttcctcagatttttgatattgtgagattagttatgctctattgtttactcatctaaacatcgagtattatattgcttagcaggtttctttgtttgaattaaagaagtcgccttgcataccctctgttcaaacttctgttttgatctgtggcaaaaggc

SEQ ID NO: 653 - DNA, 2041 bp, Aristolochia fimbriata
aacccgtcggatggaaaaccatccaacggcccaaagaaaccctaatctcatctctttgggtattagtagtcgcacacgcatttttggcaaaccctctttctctcttccgcggctcgtctcattcccaggcgacgcagcgagagtgctcatcacccgttttcgtctctgaaagtatttgttgttctctctcgtattagacgtcgccatgggtaaggagaagtttcacatcaacatcgtggttatcggccacgtcgattccggtaaatcgacgacgaccggtcacctgatatacaagctcggtggaatcgataagcgtgtgattgagagattcgagaaggaggctgctgagatgaacaagaggtcgttcaagtatgcttgggtccttgacaagctcaaggctgagcgtgagcgtggaattaccatcgatattgccctctggaaattcgagaccaccaagtactactgtaccgtcatcgatgcccctggtcatcgtgatttcattaagaacatgattaccggtacctctcaggctgattgcgctgttttgattattgattcgactactggtggtttcgaggctggtatctcaaaggatggtcagactcgtgagcacgcgttgcttgcttttactcttggtgtcaagcagatgatctgttgttgtaacaagatggatgcaactaccccaaaatattctaaggcaaggtacgatgaaatcgttaaggaagtgtcttcctacctgaagaaggtcggctacaaccctgacaagatcccatttgtacctatatctgggttcgaaggtgataacatgattgagcggtccaccaaccttgattggtacaagggccctactcttcttgaggcacttgacttgatcaatgaaccaaagaggccatcagacaagcctctgcgtcttccacttcaggatgtctataaaattggaggtattggcactgtaccagtgggacgagtggaaactggtgtcctcaagcctggtatggtagtgacctttgcgcctagtggactgactactgaagtaaagtccgtggagatgcatcacgaggctcttcaggaggcattgcctggtgacaatgttggtttcaatgtgaagaatgttgctgtcaaggatctaaagcgtggtttcgttgcctctaattccaaggatgatccagcgaaggaggcagctaacttcacatcacaggtcattataatgaatcaccctggtcagattggcaacggatatgcaccagtcctcgattgccacacatctcatattgctgtcaaattttctgagctgttaaccaagattgacagacgatccggcaaggaaattgagaaggagcctaagtttttgaagaatggtgatgcgggtatggtgaagatgattccgactaagcccatggttgttgagacattctctgagtatccacctctgggacgttttgctgttagagacatgcgccagactgttgctgtgggtgttatcaagagtgtcgagaagaaggatcccactggcgctaaggtcaccaaatctgctgcgaagaagaagtgaagcgtgcggtattttagagagagtactgtcgtagggttagggaacttgttcttatctagaaattcgagttttgaagattgtgcgttttgctggatttttggattatcttgtgtgtgttggttcgttttggcctctagtgtttggatgcagacatgggtgcttgacaggcggtggcaaaggcaggccaatattttgttttccctttgaaaagtccatttttcttattattaggtgtgatggttgttataaattttgtttttatggttaaattgaagtaaagactttgatttttctaaatggctgcagtttctccttttgctgtgaaactgatgttggttgcccttgtgcgaatgagcgagatgttagctttttcaatattcaaaaggcatattacattgaaaaaatgttagtattgttgtcttttccttcgaggctgttgggaaacttcaccaaagggattttagcaagtttaaggattttgcatcttgtgcc

SEQ ID NO: 654 - DNA, 1782 bp, Chelidonium majus
ggttttagcgagaggcgctctcaggaatttctctgctctacaagtgtcttaaacatgggtaaggagaaggttcacatcaatattgtcgttattggacatgtcgactctgggaagtcgaccaccactggtcacttgatttacaagcttggaggtattgacaagcgtgtgattgagagattcgagaaggaagctgctgagatgaacaagaggtcattcaagtacgcctgggtgcttgacaagctgaaggctgagcgtgagcgtggtatcaccattgacattgctctatggaagtttgagaccaccaagtactactgcaccgtcattgatgcccctggacatcgtgactttatcaagaacatgattacgggtacttctcaggctgactgtgctgtccttattatcgattccaccactggtggttttgaagctggtatctctaaggatggacagacccgtgagcatgctcttcttgctttcacccttggtgtgaagcagatgatctgttgttgtaacaagatggatgccaccacccccaagtactccaaggctaggtacgatgaaattgttaaggaagtctcatcctacctgaagaaggttgggtacaacccagacaaaattgcctttgtccccatctctggtttcgaaggagacaacatgattgagaggtctaccaaccttgactggtacaagggtccaaccctccttgaggcccttgaccagatcaatgagcccaagagacccacagacaagcccctccgtcttccacttcaggatgtttacaagattggtggtattggaactgtgccagtgggacgtgttgaaactggtttgatcaagcctggtatggttgtcacttttggccctactggtttgaccactgaagttaagtctgtggagatgcatcatgaggctctcctagaagctcttccaggtgacaatgttgggttcaacgtcaagaatgttgctgtgaaggatctcaagcgtgggtttgttgcctccaactccaaggatgaccctgccagggaagctgccaacttcacctcccaggtcatcatcatgaaccaccctggtcagatcggtaacggttatgccccagtgctcgactgccacacttcccacattgctgtcaagttcggtgagatcctcaccaagattgacaggcgatctggaaaggagcttgagaaggagcccaagttcttgaagaacggagatgctggtattattaagatgattcccaccaagcctatggttgtggagaccttctctgagtaccctcctcttggacgttttgctgtcagagacatgaggcagactgttgctgttggagttatcaagagtgttgagaagaaggatccatctggagccaaggtcaccaagtctgctgctaagaagaagtgaaccgagcagtgtcatcgcctagttcatgcatctaaatttcatcacaattactatcataaagactggttacttgttagttctattatcaactctttaggttttgtttgttgtggttatagttctttgctatcatcttcattaggcagccgttctcagaactgggtgcttgacaggcggtggcgctatttaccatcagtgtctgcgttttaatttctttcatttggttgtattagtttgagtgagtgtctaaacagtattttgcgttcctgcttcagtaggttttatgacttgttctgctgattagcaggtcggttgctttcttataatatggtttactggtttttagtataatttcattgttctcaatttaatctttgattgccc

SEQ ID NO: 655 - DNA, 1433 bp, Gossypium hirsutum
gctctccttctgtttctggtcaagccaatctcaaaagactccccttttagctcacagctcctctcttgagtactataatgggtaaggagaaggttcacatcaacattgtggtcattggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgagcgtgaacgtggtattaccatcgatattgccctctggaagtttgagactaccaaatactactgtactgtcattgatgcccctggacatcgtgacttcatcaagaacatgattactggtacctcacaggctgactgcgctgttctcattatcgactcgaccactggtggtttcgaagctggtatctcaaaggatggtcagacacgtgagcatgctttgcttgcgtttacccttggtgtcaagcagatgatttgctgctgcaacaagatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccgctccggctcccacttcaggatgtctacaagattggcggcattggaactgtgcctgttggtcgtgttgagactggtgttcttaagcctggtatggtagtgacctttggcccctctggcctgaccactgaagttaagtctgttgagatgcaccatgaagccctctctgaggctctccctggtgacaatgttggattcaatgtcaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaaattttccgaattgctgaccaagatcgacaggcgatctggaaaggagcttgagaaggagcccaagttcttgaagaatggtgatgcagggatgataaagatggttcccaccaagcctatggttgtggagactttctctgagtacccaccacttggacggtttgctgtcagggacatgcgtcagactgtggctgttggtgtcatcaagagcgttgagaagaaggacccaacgggtgctaaggtcaccaaatctgctgccaagaagaaatgagattgcatttga

SEQ ID NO: 656 - DNA, 1770 bp, Gossypium hirsutum
gtggctggctacttaagttaaagcaacctgctgctctcgccctctctttctctcactcaacgctctccttctgtttctggtcaagccaatctcaaaagactccccttttagctcacagctcctctcttgagtactataatgggtaaggagaaggttcacatcaacattgtggtcattggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgagcgtgaacgtggtattaccatcgatattgccctctggaagtttgagactaccaaatactactgtactgtcattgatgcccctggacatcgtgacttcatcaagaacatgattactggtacctcacaggctgactgcgctgttctcattatcgactcgaccactggtggtttcgaagctggtatctcaaaggatggtcagacacgtgagcatgctttgcttgcgtttacccttggtgtcaagcagatgatttgctgctgcaacaagatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccgctccggctcccacttcaggatgtctacaagattggcggcattggaactgtgcctgttggtcgtgttgagactggtgttcttaagcctggtatggtagtgacctttggcccctctggcctgaccactgaagttaagtctgttgagatgcaccatgaagccctctctgaggctctccctggtgacaatgttggattcaacgtcaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaagttttctgaattgctgaccaagatcgacaggcgatctggaaaggagcttgagaaggagcccaagttcttgaagaatggtgatgcagggatgataaagatggttcccaccaagcctatggttgtggagactttctctgagtacccaccccttggacggtttgctgtcagggacatgcgtcagactgtggctgttggtgtcatcaagagcgttgagaagaaggatccaaccggtgctaaggtcaccaaatctgctgccaagaagaaatgagattgcatttgatagtatcaaagccttttgattttggttttctatgtagtctggtacttaacagttttttagaccaattttgatatgtgttcatttggttgagactggcatctgcccacggattgtgtgtttgctttttccgtgtcaattgtagttgaattccttcaaagaatgctagtttgatatttccttgttttcttaatgttatgatggtcctaagccttcgattttcaactaatttcctggccaattcaggtttttaatgataaattagtgaaatactatttt

SEQ ID NO: 657 - DNA, 1758 bp, Gossypium hirsutum
actcaacgctctcttcttctgcttctggtcaagccaatctcaaaagactccccttttagctcacagctcctctcttgagtactataatgggtaaggagaaggttcacatcaacattgtggtcatcggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgaacgtgaacgtggtattaccatcgatattgccctctggaagtttgagactaccaaatactactgcactgtcattgatgcccctggacaccgtgacttcatcaagaacatgattactggtacctcacaggctgactgtgctgttctcattatcgactcgaccactggtggttttgaagctggtatctcaaaggatggtcagacacgtgagcatgctttgcttgcgtttacccttggtgtcaagcagatgatttgctgctgcaacaagatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccgctccggctcccacttcaggatgtctacaagattggcggcattggaactgtgcctgttggtcgtgttgagactggtgttcttaagcctggtatggtagtgacctttggcccctctggcctgaccactgaagttaagtctgttgagatgcaccatgaagccctctctgaggctctccctggtgacaatgttggattcaatgtcaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaaattttccgaattgctgaccaagatcgacaggcgatctggaaaggagcttgagaaggagcccaagttcttgaagaatggtgatgcagggatgataaagatggttcccaccaagcctatggttgtggagactttctctgagtacccaccacttggacggtttgctgtcagggacatgcgtcagactgtggctgttggtgtcatcaagagcgttgagaagaaggacccaacgggtgctaaggtcaccaaatctgctgccaagaagaaatgagattgcatttgatagtatcagagccttttgattttggttatctttgtagtttggtacttgcagttttttagaccaattttgatgtgtgttcatttggttgagactgtcatctgcatacggattgtgtgtttgctttttccgtgtcaattttagttgaattccttcaaagaatgctaatttgatatttccttgttttcttattgttatgatggtcctaagccttcggttttcagctaatttcgtggtcaaatcaggttttagcctaattgtcttgttatttttctgaatttccatctttcagtgataagttagtgaaatatgctatttt

SEQ ID NO: 658 - DNA, 2883 bp, Gossypium hirsutum
aagcacaacatcaaagaagctttcaattctccagatatgataaaaagagcacacataaactgaaaagaagaataaaattatcccatacccgatgagttcctaataatcaactgttctttgaagccatgacttttctggcagccatacccttcctagcagccctggcattatcatattcaaacttcaacacatctgatatatgagaagtatccttgacataaaaaaaacctcccaagggcactctcttcaatcaaaggaaaataacagaaaagcttagagtcaccagccaaaacgaaaccccaccaagaaaagtcccaaagcagctccagcgaaaaacagggccacagtatggtaaccgaaataaaccctggaatacatagtcaaaacagccgaagaccaaggcaaaaacaaagcagcccacttggttgtgactttccaaatcccaccaatccccttacaagtcaaaagggtaaaataaaccgtacaaaagaacatgtattgacagtgacttgaaggccaaccatgagaatcacacatttctaatagcgcacaggtttcaggcctggcttgttgaacggatttcttgatcagttcattaatgaagtgagatattaaaagccctaatccaaagaacattccttgaagctctctacggaagtagaaatgagaaacaaagccaccaagggaaatgaaaacagggactaacgaaacccaggctaagaaatggccgagttgatcacgtctttgatacctgacatgggctaaagtcacggcttttaatggatgatcagctctcatggtgaaaattcaagtcaatcggagaaactaaaaataaggtcagtttcaggtgggatgtagtttgggaggattgggttttaactggtgtttcagttcagtgtttgttcctcgagaaactgccggtaatgaaaaagtgtgagtgagccgttgatagacgcatacaccgacgaagaaacaatacacgtgggaataaaggaacacacacgttgaaagatcccatcttgtttttttctcaaaaggttaggggtattattggttttccaacatgaagagaacgtcaaattaacgtctagtctgagatgtctgtcgtgagccgttggattaactgcaatccgacggatgagaaagaaaccctagttgagccaaagctgagagtgtcgctggctacttaagttaaagcagcctgttgctctcgccttctcttgctctcactcaacgctctctcatcctgcttctggtcaagccaatctcaaaagactccccttttagctcacagctctctcgagttctgtaatgggtaaggagaaggttcacatcaacattgtggtcatcggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgaacgtgaacgtggtattaccatcgatattgccctctggaagtttgaaactaccaaatactactgcactgtcattgatgcccctggacaccgtgacttcatcaagaacatgattactggtacctcacaggctgactgtgctgttctcattatcgactcgaccactggtggtttcgaagctggtatctcaaaggatggtcagacacgtgagcatgctttgcttgcgtttacccttggtgtcaagcagatgatttgctgctgcaacaagatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccacttcggctcccacttcaggatgtctacaagattggtggcattggaactgtccctgttggtcgtgttgagactggtgtccttaagcctggaatggttgtgacctttggcccctctggtctgaccactgaagttaagtctgttgagatgcaccatgaagccctctctgaggctctccccggtgacaatgttggattcaacgtcaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaagttttctgaattgctgaccaagatcgacaggcgatctggaaaggagcttgagaaggagcccaagttcttgaagaatggtgatgcagggatgataaagatggttcccaccaagcctatggttgtggagactttctctgagtacccaccccttggacggtttgctgtcagggacatgcgtcagactgtggctgttggtgtcatcaagagcgttgagaagaaggatccaaccggtgctaaggtcaccaaatctgctgccaagaagaaatgagattgcatttgatagtatcaaagccttttgattttggttttctatgtagtctggtacttaacagttttttagaccaattttgatatgtgttcatttggttgagactggcatctgcccacggattgtgtgtttgctttttccgtgtcaattgtagttgaattccttcaaagaatgctagtttgatatttccttgttttcttaatgttatgatggtcctaagccttcgat

SEQ ID NO: 659 - DNA, 1590 bp, Gossypium hirsutum
acggtctttggcaaggtcggtagtgttcagctgctcggatcggaaggaagaccgccaaacaagaatctcaagtgacggaaaaatggccatgcatactattcgaataagctcacttccagggatgagaagcaacgctctccttctgtttctggtcaagccaatctcaaaagactccccttttagctcacagctcctctcttgagtactataatgggtaaggagaaggttcacatcaacattgtggtcattggccatgtcgactccgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgaacgtgaacgtggtattactatcgatattgccctctggaagtttgagactaccaaatactactgcactgtcattgatgcccctggacaccgtgacttcatcaagaacatgattactggtacctcacaggctgactgcgctgttctcattattgactcaaccactggtggtttcgaagctggtatctcaaaggatggtcagacacgtgagcatgctttgcttgcgtttacccttggtgtcaagcagatgatttgctgctgcaacaagatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccactccggctcccacttcaggatgtctacaagattggtggcattggaactgtccctgttggtcgtgttgagactggtgtccttaagcctggtatggtagtgacctttggcccctctggtctgaccactgaagttaagtctgttgagatgcaccatgaagctctctctgaggctctccctggtgacaatgttggattcaacgttaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaaattttccgaattgctgaccaagatcgacaggcgatctggaaaggagcttgagaaggagcccaagttcttgaagaatggtgatgcagggatgataaagatggttcccaccaagcctatggttgtggagactttctctgagtacccaccccttggtcggtttgctgtcagggacatgcgtcagactgtggctgttggtgtcatcaagagcgttgagaagaaggatccaaccggtgctaaggtcaccaaatctgctgccaagaagaaatgagattgcatttgagatgccaggatagtttctaagttt

SEQ ID NO: 660 - DNA, 1628 bp, Gossypium hirsutum
attccgggatctcaacgctctccttctgtttctggtcaagccaatctcaaaagactccccttttaggtcacagctctctcgagttctataatgggtaaggagaaggttcacatcaacattgtggtcatcggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgagcgtgaacgtggtattaccatcgatattgccctctggaagtttgagactaccaaatactactgtactgtcattgatgcccctggacatcgtgacttcatcaagaacatgattactggtacctcacaggctgactgcgctgttctcattatcgactcgaccactggtggtttcgaagctggtatctcaaaggatggtcagacacgtgagcatgctttgcttgcgtttacccttggtgtcaagcagatgatttgctgctgcaacaagatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccactccggctcccacttcaggatgtctacaagattggtggcattggaactgtccctgttggtcgtgttgagactggtgtccttaagcctggtatggtagtgacctttggcccctctggtctgaccactgaagttaagtctgttgagatgcaccatgaagccctctctgaggctctccctggtgacaatgttggattcaatgtcaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaaattttccgaattgctaaccaagatcgacaggcgatctggaaaggagcttgagaaggagcccaagttcttgaagaatggtgatgcagggatgataaagatggttcccaccaagccgatggttgtggagactttctctgagtacccaccccttggacggtttgctgtcagggacatgcgtcagactgtggctgttggtgtcatcaagagcgttgagaagaaggatccaaccggtgctaaggtcaccaaatctgctgccaagaagaaatgagattgcatttgagaagccaggatagtttctgagttttggtcttatttttgtctggtagtaattgtatggaaatattttgaccattttttatatgctttatcgtgtattgttttggttccgaaattgatcaagaattgttgaattttcttgtttaacttttcctggataattttagattaaggtaccgtgttttt

SEQ ID NO: 661 - DNA, 1705 bp, Gossypium hirsutum
gctatcactcaacgctctcctcctgtttctggtcaagccaatctcaaaggactccccttttagctcacagctctctcgagttctataatgggtaaggagaaggttcacatcaacattgtggtcatcggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgagcgtgaacgtggtattaccatcgatattgccctctggaagtttgagactaccaaatactactgtactgtcattgatgcccctggacatcgtgacttcatcaagaacatgattactggtacctcacaggctgactgcgctgttctcattatcgactcgaccactggtggtttcgaagctggtatctcaaaggatggtcagacacgtgagcatgctttgcttgcgtttacccttggtgtcaagcagatgatttgctgctgcaacaagatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccgctccggctcccacttcaggatgtctacaagattggcggcattggaactgtgcctgttggtcgtgttgagactggtgtccttaagcctggtatggtagtgacctttggcccctctggtctgaccactgaagttaagtctgttgagatgcaccatgaagccctctctgaggctctccctggtgacaatgttggattcaatgtcaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaaattttccgaattgctgaccaagatcgacaggcgatctggaaaggagcttgagaaggagcccaagttcttgaagaatggtgatgcagggatgataaagatggttcccaccaagcctatggttgtggagactttctctgagtacccaccacttggacggtttgctgtcagggacatgcgtcagactgtggctgttggtgtcatcaagagcgttgagaagaaggacccaacgggtgctaaggtcaccaaatctgctgccaagaagaaatgagattgcatttgatagtatcagagccttttgattttggttatctttgtagtttggtacttgcagttttttagaccaattttgatgtgtgttcatttggttgagactgtcatctgcatacggattgtgtgtttgctttttccgtgtcaattttagttgaattccttcaaagaatgctaatttgatatttccttgttttcttattgttatgatggtcctaagccttcgattttcagctaatttcgtggtcaaatcaggttttagcctaaaaaaagaa

SEQ ID NO: 662 - DNA, 1656 bp, Solanum melongena
cttcatcacttttgctgtgattccctcttctctctgctgtgccgcaatcgcctcagctctcttctctctaagtttcttagtctatcaagatgggtaaagagaagactcacatcagcattgtggtcattggccatgtcgactctggaaagtcgactactactggtcacttgatctataagcttggtggtattgacaagcgtgttattgagaggttcgagaaggaagctgctgagatgaacaagaggtcattcaagtatgcctgggtgcttgacaagcttaaggctgaacgtgagcgtggtattaccattgacattgctttgtggaagtttgagaccactaagtactactgcactgtgattgatgcccccggacacagggactttatcaagaacatgatcactggtacctcccaggctgactgtgctgtcttgattattgactccaccactggtggtttcgaagctggtatctctaaagatggtcagacccgtgaacatgcattgcttgctttcacccttggtgtcaagcaaatgatttgctgctgcaacaagatggatgctaccacccccaagtactccaaggctaggtatgatgaaattgtgaaggaagtttcttcctacctcaagaaggtcggttacaaccctgacaagatccccttcgtccccatctctggttttgaaggagataatatgattgagaggtctaccaaccttgactggtacaagggcccaactctccttgaagctcttgaccagattaatgagcccaagaggccatcagacaagcccctccgtcttccacttcaggatgtttacaagattggtggtattggaactgtccctgttggtcgtgtagagactggtattatcaagcctggtatggttgtgacctttggcccttctggtttgacaactgaagtcaagtctgtagagatgcaccacgaagctctccaggaggcactccctggtgacaatgttgggttcaacgttaagaatgttgctgttaaggatcttaagcgtggttatgttgcgtcaaactccaaggatgacccagccaagggagcagccagcttcactgcccaggtcatcatcatgaaccatcctggccagattggaaatggatatgcaccagtgctcgactgccacacttcccacattgctgtcaagtttgctgagatcttgaccaagattgacaggcgttcgggtaaggaattggagaaggagcctaagttcttgaagaatggtgatgctggtatggttaagatgattcccaccaagcccatggttgttgagacctttgctgagtacccaccattgggtcgttttgctgtgagagacatgaggcaaaccgttgctgttggtgttgtcaagaacgttgagaagaaagacccaactggtgccaaggtcaccaaagctgctcaaaagaagaagtgaggaggtgcatttgatgaacatggatgaagtaattgtgtttatttgcacaagttttttccaattttgttttggacaacattttatcagttttgggtatggctgaacttatttaacttattttgaaattagagaatattttgtgcctcatattttatttcatttctcaacatgtgagttgtagctgtttactcccttctttaattcgatgtaagtctcttaaatc

SEQ ID NO: 663 - DNA, 1843 bp, Solanum melongena
acttctggtttgcgttacttattttccacacgcggccagggttttagcaaagctctctctctagttttccgtcatctaaagtttatcaggcatcatgggtaaagagaagactcacataagcatcgttgtcattggccatgtcgactctggaaagtcgaccactactggtcacttgatctacaaacttggtggtattgacaagcgtgtcattgagaggtttgagaaggaagcagctgagatgaacaagaggtccttcaaatatgcgtgggtgcttgacaagctcaaggctgagcgtgaacgtggtattaccattgatattgccttgtggaagtttgagaccacaaagtactactgcactgttattgatgcccctggacacagggattttatcaagaacatgattactggtacctctcaggctgattgtgctgtcctcatcattgactccacaactggtggatttgaagctggtatctccaaggatggacagacccgtgagcacgcattgcttgctttcacccttggtgtcaaacaaatgatttgttgctgtaacaagatggatgctaccacccccaagtactccaaggctaggtacgatgaaatcgtgaaggaagtttcttcctacctcaaaaaggtaggatacaaccctgacaaaatcccctttgtccccatctctggtttcgaaggtgacaacatgattgagcgatcaaccaaccttgactggtacaagggcccaaccctacttgaggctcttgaccagattaatgagcccaagaggccctcagacaagcccctccgtctcccacttcaggatgtctacaagattggtggtattggtactgtgcctgtcggacgtgttgaaactggtatcattaaacctggtatggttgtgacttttggtccaactggtctgaccactgaagttaaatctgttgagatgcaccatgaggctcttcaggaggctcttcctggtgacaatgttgggttcaacgtcaagaatgttgcagttaaggatcttaagagaggttatgttgcttctaactccaaagatgacccagcaaagggagctgccagcttcactgcccaagtcatcatcatgaaccatcctggacagattggaaatggatatgcgccagtgctcgactgccacacttctcatattgctgtcaagtttgctgagatcttgaccaagattgacagacgttctggtaaggaacttgagaaggagcccaagtttttgaagaatggtgatgctggtatggttaagatgattcccaccaagcccatggttgttgagaccttctctgagtacccaccattgggacgttttgctgtgagggacatgcgtcaaactgttgctgttggtgtcgtcaagaacgttgaaaagaaagaccctactggtgccaaagttaccaaggctgctcaaaagaagaagtgatgtgtttttgatgagattctgcattgttgaactagttttgtttaattgcattagctattttcagttttgttttggacattttactggtcatagatatggctccagaagcttttgtcatgtttctctagcctctttcgaggatagtggagttgttgagcaatttggattgatccaagttgcttgatgggcactgacaatagcacctctggatgcctttctcatgtctggttatttatagcaaatttcaagatgagctgccgagacggtttaaatatgttacgcttttgggacgtcttttctcttgcattctcttccatatttaatttattattatgttattgattagttctccttccctataattttgccattgctttgtctagtagaatttaaccaatctgtttc

SEQ ID NO: 664 - DNA, 1734 bp, Eschscholzia californica
ggctcatttcttcagctcgctagggttttactgaggcgttctctcttctctccaagctattcatcatgggtaaggaaaagattcatatcagtattgttgtcattggacatgtcgactctggaaagtcgaccacaactggtcacttgatctacaagttgggaggtattgacaagcgtgttatcgaaagattcgagaaggaagctgctgagatgaacaagaggtcattcaagtatgcatgggttcttgacaagcttaaggctgaacgtgagcgtggtattactattgatattgccttgtggaagtttgagaccaccaaatactactgcactgttattgatgctcctggtcatcgtgatttcatcaagaacatgattactggaacctctcaggctgattgtgctgtcctcatcattgactccactactggaggttttgaagctggtatctcaaaggatggacagacccgtgagcatgctcttctagctttcacccttggtgtcaagcagatgatttgctgttgtaacaagatggatgccaccactcccaagtactcaaaggcaaggtacgaggaaattgttaaggaagtgtcttcttacttgaagaaggttggatacaacccagacaagattgcttttgttcccatctctgggttcgaaggtgacaacatgattgaaaggtcaaccaaccttgactggtacaagggaccaacccttcttgaggctcttgaccaaatcaatgagcccaaaaggccctcagacaagccactccgtctaccacttcaggatgtctacaagattggtggtattggaactgtgccagtcggacgtgttgaaactggtgtcatcaagcctggtatggttgtcacttttggaccaactggttggaccactgaagttaagtctgtggagatgcaccatgaagcactccaagaagctcttccaggtgacaatgtcggattcaatgttaagaatgttgctgtcaaggatctcaagcgtggtttcgttgcttccaactcaaaggatgaccctgctcgtgaagctgccaacttcacctcccaagtcatcatcatgaaccacccaggtcaaatcggtaacggttatgctccagttctcgattgccacacttctcacattgctgttaagtttggtgagatccttaccaagattgacagacgttctggaaaggagctcgagaaagaacccaagttcttgaagaacggtgatgctggtatggttaagatgcttccaaccaaacccatggttgtcgagaccttcgctgaatacccacctcttggacgttttgctgttcgtgatatgcgtcagactgttgctgttggtgttatcaagagtgtggagaagaaggatccatctggtgctaaggtgaccaagtctgctgccaagaagaagtgaatcgtgctggttcgtgatgcttcgttcagagttcgttcgtatttctactactataataaggattgggtactttttagtcgtgtcgtgaaaagtttatgttttgtctgctgtggtagcagtccattgccgtctccgtcattaagcagccgttctcagaattgggtgcttgatcggcggtggcactggctattaccaatgggtttaggttatgtcttttaattttcgaagttggattttgaggtctcaagtttaatgtgtttgaacagtaacctggtattcagtagtttttaggtattttgtgatactgaatatgcaggtggtattg

SEQ ID NO: 665 - DNA, 1585 bp, Eschscholzia californica
gacgttttcatcaccaaagttatttgattttctgaggaactcaacatgggaaaagagaagattcatatcagtattgtcgtcattggacatgtcgactctggaaagtctaccaccactggtcacttgatctacaagttgggaggtatcgacaagcgtgtgatcgaaagattcgagaaggaggctgctgagatgaacaagaggtctttcaagtacgcatgggttcttgacaagcttaaggctgaacgtgagcgtggtattaccattgatattgccttgtggaagtttgagaccaccaagtactactgcactgttattgatgccccaggacatcgtgatttcatcaagaacatgattactggtacctctcaggctgattgtgccgtcctcatcattgactccaccactggaggttttgaagctggtatctctaaggatggacagacccgtgagcacgctcttcttgctttcacccttggtgtcaagcagatgatctgttgttgtaacaagatggatgctaccacccccaagtactcaaaggcaaggtacgaggaaatcgttaaggaagtctcatcttacttgaagaaggttggatacaacccagacaaaatcgcctttgttcccatttctgggtttgagggtgacaacatgattgagagatccaccaacctcgactggtacaagggaccaacccttctagatgcccttgaccaaatcaatgagccaaagagaccctcagacaagccactccgtcttccacttcaggatgtttacaagattggtggtattggaactgtgccagtgggacgtgttgagactggagtcatcaagcccggtatggttgtcacttttggccccactgggttgaccactgaggttaagtctgtggagatgcaccacgaggctctccaggaagcacttccaggtgacaatgtcggattcaatgttaagaatgttgctgtcaaggatctgaagcgtggtttcgttgcctccaactccaaggacgacccagccagggaagctgctaacttcacctcccaggttatcatcatgaaccatcctggtcagatcggtaacggatacgctccagttcttgattgtcacacctcccacattgctgtgaagttcggtgagatcctcaccaagattgacagacgatctggaaaggagctcgagaaggagcccaagtttttgaagaatggtgatgccggtatggttaagatgcttccaaccaagcccatggttgtggagacctttgccgaatacccaccccttggtcgtttcgctgttagggatatgcgacagacagttgctgtgggagtcatcaagagtgtggagaagaaggatccatcaggtgccaaggtcaccaagtcagctgccaagaagaaatgagcaatgggaattggtttggcaggagaagcaacagggtcagagaggtagtagagagaatttggttgggtaatggttttatgatttgaatcagtctatgttttgtggtgtttaagtttctcgagaaccaatttgtttggatattgaacttgttttaattttgaaattaatagaactgagggtacctctgttttgctag

SEQ ID NO: 666 - DNA, 1505 bp, Eschscholzia californica
acgttttcatcaccaaagttatttgattttctgaagaactcaacatgggaaaagagaagattcatatcagtattgtcgtcattggacatgtcgactctggaaagtcgaccaccactggtcacttgatctacaagttgggaggtattgacaagcgtgttatcgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcactgttattgatgccccaggacatcgtgatttcattaagaacatgattactggtacctctcaagccgattgtgctgtcctcatcattgactccaccactggaggttttgaagctggtatctctaaggatggacagacccgtgagcacgctcttcttgctttcacccttggtgtcaagcagatgatctgttgttgtaacaagatggatgctaccacccccaagtactcaaaggcaaggtacgaggaaatcgttaaggaagtctcatcttacttgaagaaggttggatacaacccagacaaaatcgcctttgttcctatttctgggtttgagggtgacaacatgattgagagatccaccaacctcgactggtacaagggaccaacccttctagatgcccttgaccaaatcaatgagccaaagagaccctcagacaagccactccgtcttccacttcaggatgtttacaagattggtggtattggaactgtgccagttggacgtgttgagactggagtcatcaagcccggtatggttgtcacttttggccccactgggttgaccactgaggttaagtctgtggagatgcaccacgaggctctccaggaagcacttccaggtgacaatgtcggattcaatgttaagaatgttgctgtcaaggatctgaagcgtggtttcgttgcctccaactccaaggacgacccagccagggaagctgctaacttcacctcccaggttatcatcatgaaccaccctggtcagatcggtaacggatacgctccagttcttgactgccacacctcccacattgctgttaagttcggtgagatcctcaccaagattgacagacgatctggaaaggagctcgagaaggagcccaagtttttgaagaatggtgatgccggtatggttaagatgcttccaaccaagcccatggttgtggagacctttgctgaatacccaccccttggtcgttttgctgttagggatatgcgacagacagttgctgtgggagtcatcaagagtgtggagaagaaggatccatcaggtgccaaggtcaccaagtcagctgccaagaagaaatgagcaatgggaattggtttggcaggagaagcaacagggtcagagaggtagtagagagaaattttgttgggtaatggttttatgatttgaatcagtctatgtttgtggtgttttagtttc

SEQ ID NO: 667 - DNA, 1681 bp, Eschscholzia californica
ctccatcagcctagggtttaggcagccgttctctccacttccgaagtatcttagcatctactcgtcatgggtaaagagaaaattcatatcagtattgtcgtcattggacatgtcgactctggaaagtcgaccaccactggtcacttgatttacaagttgggaggtattgacaagcgtgttatcgaaagatttgagaaggaggctgctgagatgaacaagaggtcattcaagtatgcatgggctcttgacaagcttaaggctgaacgtgagcggggtattaccattgatattgccttgtggaagtttgagaccaccaagtactactgcactgttattgatgccccaggacatcgtgatttcatcaagaacatgattactggtacctctcaggccgattgtgctgtcctcatcattgactccaccactggaggatttgaagctggtatctctaaggatggacagacccgtgagcacgctcttcttgctttcacccttggtgtcaagcagatgatctgttgttgtaacaagatggatgccactactcccaagtactccaaggcaaggtatgaggaaatcgttaaggaagtctcatcatacttgaagaaggttggatacaacccagacaaaatcgcctttgttcccatctctgggtttgaaggtgacaacatgattgagagatccaccaaccttgactggtacaagggaccaacccttcttgaggcacttgaccagatcaatgagccaaagagaccctcagacaagccactccgtcttccacttcaggatgtttacaagattggtggtattggaactgtgccagtgggacgtgttgagactggagtgatcaagcccggtatggttgtcacttttggtcccactgggttgaccactgaggttaagtccgtggagatgcaccacgaggctctccaggaagctcttccaggtgacaatgttgggttcaatgttaagaatgttgctgtcaaggatctcaagcgtggtttcgttgcctccaactccaaggatgacccagccagggaagctgccaacttcacctcccaggtcatcatcatgaaccaccctggtcagatcggtaacggatatgctccagttcttgactgccacacctcccacattgctgtgaagttcggtgagatcctcaccaagattgacagacgatctggaaaggagcttgagaaggaacccaagttcttgaagaatggtgatgctggtatggttaagatgcttccaaccaagcccatggttgtggagaccttcgctgagtacccacctctaggacgttttgccgtgagggacatgcgtcagaccgttgctgtcggagtcatcaagagtgttgagaagaaggacccatctggtgccaaggtaaccaagtctgcagccaagaagaagtgaactcctactactagtagtagagggactggttttgggatgtcagcagcagcagtaggagagaagagttctaagttttggttttatagttggtttgtgagtttctatttccgagttttatcttgttttgtcttcattcagttgagcagtcagatgcagacctgggtgcttgaccgacggtggcgactggtgtgaacttgagttttttaagttagttttgaagatgttatttttgttatgttacttaattttcgattaatgaaactgctgttat

SEQ ID NO: 668 - DNA, 1485 bp, Eschscholzia californica
tttcatcaccaaagttatttgattttctgaggaactcaacatgggtaaagagaagattcatatcagtattgtcgtcattggacatgtcgactctggaaagtctaccaccactggtcacttgatctacaagttgggaggtattgacaagcgtgttatcgaaagattcgagaaggaggctgctgagatgaacaagaggtcattcaagtatgcatgggttcttgacaagcttaaggctgaacgtgagcgtggtattaccattgatattgccttgtggaagtttgagaccaccaagtactactgcactgttattgatgccccaggacatcgtgatttcatcaagaacatgattactggtacctctcaggccgattgtgctgtcctcatcattgactccaccactggaggttttgaagctggtatctctaaggatggacagacccgtgagcacgctcttcttgctttcacccttggtgtcaagcagatgatctgttgttgtaacaagatggatgctaccacccccaagtactcaaaggcaaggtacgaggaaatcgttaaggaagtctcatcttacttgaagaaggttggatacaacccagacaaaatcgcctttgttcccatttctgggtttgagggtgacaacatgattgagagatccaccaacctcgactggtacaagggaccaacccttctagatgcccttgaccaaatcaatgagccaaagagaccctcagacaagccactccgtcttccacttcaggatgtttacaagattggtggtattggaactgtgccagtgggacgtgttgagactggagtcatcaagcccggtatggttgtcacttttggccccactgggttgaccactgaggttaagtctgtggagatgcaccacgaggctctccaggaagcacttccaggtgacaatgtcggattcaatgttaagaatgttgctgtcaaggatctcaagcgtggtttcgttgcctccaactccaaggacgacccagccagggaagctgctaacttcacctcccaggtcatcatcatgaaccaccctggtcagatcggtaacggatatgctccagttcttgattgccacacctcccacattgctgtgaagttcggtgagatcctcaccaagattgacagacgatctggaaaggagctcgagaaggagccgaagtttttgaagaatggtgatgccggtatggttaagatgcttccaaccaagcccatggttgtggagacctttgccgaatacccaccccttggtcgtttcgctgttagggatatgcgacagacagttgctgtgggagtcatcaagagtgtggagaagaaggatccatcaggtgccaaggtcaccaagtcagctgccaagaagaaatgagcaatgggaattggtttggcaggagaagcaacagggtcagagaggtagtagagagaaattttgttgggtaatggttttatgatttgaatcagtctatgttt

SEQ ID NO: 669 - DNA, 1804 bp, Eschscholzia californica
cgctagggttttactgaggcgttctctcttctctccaagctattcatcatgggtaaggaaaagattcatatcagtattgttgtcattggacatgtcgactctggaaagtcgaccactactggtcacttgatctacaagttgggaggtattgacaagcgtgttatcgaaagattcgagaaggaagctgctgagatgaacaagaggtcattcaagtatgcatgggttcttgacaagcttaaggctgaacgtgagcgtggtattactattgatattgccttgtggaagtttgagaccaccaaatactactgcactgttattgatgctcctggtcatcgtgatttcatcaagaacatgattactggaacctctcaggctgattgtgctgtcctcatcattgactccactactggaggttttgaagctggtatctcaaaggatggacagacccgtgagcacgctcttcttgctttcacccttggtgtcaagcaaatgatttgttgttgtaacaagatggatgccaccactcccaagtactcaaaggcaaggtacgaggaaatcgtgaaggaagtgtcttcatacttgaagaaggttggatacaacccagacaagattgcttttgttcccatctctgggttcgaaggtgacaacatgattgaaaggtcaaccaacctcaactggtacaagggaccaactcttcttgaggctcttgaccaaatcaatgagcccaagaggccctcagacaagccactccgtctaccacttcaggatgtctacaagattggtggtattggaactgtgccagtcggacgtgttgaaactggtgtcatcaagcctggtatggttgtcacttttggaccaactggtttgaccactgaagttaagtctgtggagatgcaccatgaagctctccaagaagctcttccaggtgacaatgtaggattcaatgttaagaatgttgctgtcaaggatctcaagcgtggtttcgttgcttccaactcaaaagatgaccctgctcgtgaagctgccaacttcacctcccaagtcatcatcatgaaccacccaggtcaaatcggtaacggttatgcaccagttctcgattgccacacttcccacattgctgttaagttcggtgagatccttaccaagattgacagacgttctggaaaggagctcgagaaagaacctaagttcttgaagaacggtgatgctggtatggttaagatgcttccaaccaaacccatggttgtcgagacctttgctgaatacccacctcttggacgttttgctgttcgtgacatgcgtcaaactgttgctgttggtgttatcaagagtgtggagaagaaggatccatctggtgccaaggtcaccaagtctgctgccaagaagaagtgaatcgtgctggtccgtgatgcttcgttcagagttcgttcgtatttctactactataataaagattgggttctttttagtcgtgtcgtgaaaagtttgtgttttgtctgctgtggtagcagtccattgccgtctccgtcattaagcagccgttctcagaattgggtgcttgatcggcggtggcactggctattaccaatgggtttaggttatgtcttttaattttcgaagttggattttgaggtctcaagtttaatgtgtttgaacagtaacctggtattcagtagtttttaggtattttgtgatactgaatatgcaggtagtattgtctttcaatttaaaacttgtttttagtatcttgtctctcttactctctcctttgctcctttatcctgctaatttcgtttctgaaaaa

SEQ ID NO: 670 - DNA, 1809 bp, Gossypium raimondii
agatgtcggtcgtgacccgttggattaaatgcaatccgacggatgagaaagaaaccctagttgagccaaagctgagagtgtggctggctacttaagttaaaccatcccgctgctatcgccctctcttgttctcgctcaacgctctcttcttctgcttctggtcaagccaatctcaaaagactccccttttagctcacagctcctctcttgagtactataatgggtaaggagaaggttcacatcaacattgtggtcatcggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgaacgtgaacgtggtattaccatcgatattgccctctggaagtttgagactaccaaatactactgcactgtcattgatgcccctggacaccgtgacttcatcaagaacatgattactggtacctcacaggctgactgtgctgttctcattatcgactcgaccactggtggtttcgaagctggtatctcaaaggatggtcagacacgtgagcatgctttgcttgcgtttacccttggtgtcaagcagatgatttgctgctgcaacaagatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccactccggctcccacttcaggatgtctacaagattggtggcattggaactgtgcctgttggtcgtgttgagactggtgtccttaagcctggtatggtagtgacctttggcccctctggtctgaccactgaagttaagtctgttgagatgcaccatgaagccctctctgaggctctccctggtgacaatgttggattcaatgtcaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaaattttccgaattgctgaccaagatcgacaggcgatctggaaaggagcttgagaaggagcccaagttcttgaagaatggtgatgcagggatgataaagatggttcccaccaagcctatggttgtggagactttctctgagtacccaccccttggacggtttgctgtcagggacatgcgtcagactgtggctgttggtgtcatcaagagcgttgagaagaaggatccaaccggtgctaaggtcaccaaatctgctgccaagaagaaatgagattgcatttgagatgccaggatagtttctaagttttggtcttatttttgtctggtagtaattgtatggaaatattttgaccattttttatatgctttatcgtgtattgttttggttccgaaatttatcaagaattgttcaattgtcttgtttaacttttcctggttaattttagattaaggtaccgtgttttgaatatatatatttgccggttttttgatgtccttgagtataaaattgttttgc

SEQ ID NO: 671 - DNA, 1871 bp, Gossypium raimondii
cgacggataagaaagaaaccctagttgagccaaagctgagagtgtggctggctacttaagttaaagcagcctgctgctctcgccctctctttctctcactcaacgctctccttctgtttctggtcaagccaatctcaaaagactccccttttagctcacagctcctctcttgagtactataatgggtaaggagaaggttcacatcaacattgtggtcattggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgagcgtgaacgtggtattaccatcgatattgccctctggaagtttgagactaccaaatactactgtactgtcattgatgcccctggacatcgtgacttcatcaagaacatgattactggtacctcacaggctgactgcgctgttctcattatcgactcgaccactggtggtttcgaagctggtatctcaaaggatggtcagacacgtgagcatgctttgcttgcgtttacccttggtgtcaagcagatgatttgctgctgcaacaagatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccgctccggctcccacttcaggatgtctacaagattggcggcattggaactgtgcctgttggtcgtgttgagactggtgtccttaagcctggtatggtagtgacctttggcccctctggtctgaccactgaagttaagtctgttgagatgcaccatgaagccctctctgaggctctccctggtgacaatgttggattcaatgtcaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaaattttccgaattgctgaccaagatcgacaggcgatctggaaaggagcttgagaaggagcccaagttcttgaagaatggtgatgcagggatgataaagatggttcccaccaagcctatggttgtggagactttctctgagtacccaccccttggacggtttgctgtcagggacatgcgtcagactgtggctgttggtgtcatcaagagcgttgagaagaaggatccaaccggtgctaaggtcaccaaatctgctgccaagaagaaatgagattgcatttgatagtatcaaagccttttgattttggttttctatgtagtctggtacttacagttttttagaccaattttgatatgtgttcatttggttgagactggcatctgcctacggattgtgtgtttgctttttccgtgtcaattgtagttgaattccttcaaagaatgctagtttgatatttccttgttttcttaatgttatgatggtcctaagccttcgattttcagctaatttcgtggtcaaatcaggttttagcctaattgtcttgttatttttctgaatttccatctttcagcgataagttagtgaaatatgctattttggtaattataaaatcatc

SEQ ID NO: 672 - DNA, 2098 bp, Gossypium raimondii
gtgaaaattaaacctcgacgcccctattaagaaaccgaaggacgtatctgtcaaaacaaatctgaaaaaggacattttaggaataaaaagaaagaagctaaaacctgactataaaaatgaacgagagagcagcttacttgtaaaaccctatcacctctcttactattattatctctcttctgctttgccgccacgatttcagcttcagatcgcttctattccaaagcttgaagctaatactgcagaatgggcaaggaaaagactcacattaacattgtcgtaattggccatgtcgactctggaaagtcaaccaccactggccacttgatctacaagcttggaggtattgacaagcgtgtcattgaaaggtttgagaaggaagctgccgagatgaacaagaggtcattcaagtatgcttgggtgcttgacaagttgaaggctgagcgtgaacgtggtattaccattgatattgccttgtggaagtttgagaccaccaaatattactgcactgtcatcgatgcccctggacatcgtgactttatcaagaacatgattactggtacctcccaggccgattgtgctgtacttatcattgactctaccactggaggttttgaggcaggtatttccaaggatggacagacccgtgagcatgctctgcttgctttcactctcggtgtcaagcaaatgatttgctgctgcaacaagatggatgccacaacccccaaatattcaaaggctaggtatgatgaaattgtgaaggaagtgtcttcctacttgaagaaggttggttacaaccctgagaagattccttttgtccccatctccggttttgagggtgacaacatgattgaaaggtccaccaaccttgattggtacaagggtccaactcttctcgaggctcttgaccagatcaatgagcccaagagaccctctgacaagccactccgtcttccacttcaggatgtgtacaagattggaggtattggaactgtccctgtgggtcgtgttgaaactggtatcctcaagcctggtatggttgtaacctttggtccctctggattgaccactgaagttaagtctgttgagatgcaccatgagtctcttcctgaggctcttccaggtgacaatgttggcttcaatgtcaagaatgttgctgtgaaggatctgaagcgaggatatgttgcttcgaactcaaaggatgatcccgccaaggaggcagctaatttcacttcccaagtcatcatcatgaaccacccagggcagattggaaatggatatgcacctgtccttgactgccacacctcccacattgcggtcaagtttgcagagttggtgaccaagattgacaggcgatctggtaaggagcttgagaaggaacccaagttcttgaagaatggtgatgcaggatttgttaagatgattcccaccaaacccatggttgtggaaacattctctgagtatcccccactgggtcgttttgctgtgagggacatgaggcagactgttgctgtcggcgttatcaagagcgtggagaagaaagatccatctggagccaaggtgacgaagtctgctgccaagaagggtgggaagtgaaccgtgcgggtttcagttgatccaaccaaactattttatggttactacaataaaacattgcttctcattagtaggtcagccatcattggacgattagttgtgtgttttgatggtaatagttttaagtcatcaccatcttgtcgaggatgttgttcacagaactgggttcttgatagacggtggtgaggcttttgtgtttttcagagtctgccgtctgtgagagtaattataaactttgaatggtgtcttgtgttcccattatttatggcaatcagctcaggagttttaggtctggtcctgggcttttctgcttgaatgtgttctatcaaacatttatatacagtcaaaactagtttgtttttctgttatactcttgctgtgctatgttatttatttactttcttaccgtcctaattatttaactattatcataggtctaaattcgtaacatgcttgatatgactagaacattgtgtgaatggaaagaagattatgtttgtat

SEQ ID NO: 673 - DNA, 2138 bp, Vitis vinifera
gcgaaaaatgaggctgatatggtagccgttggatggaaagctaaagatccaacggctcaaagagaaaccctaagcgcactggggaaccctagccactttaaagcaagagtgacctcccgcaagctcagcctctctcaattggcattctctctccctctgcttgaaggcgagagagattttctcttcttctatcagcttctagatttcagtttttctgctaaaaattcataatgggtaaggagaaggttcacatcaacattgtcgtcattggccatgtcgactctggcaagtcgaccaccactggtcacttgatctacaagcttggaggtattgacaagcgtgttatcgagaggtttgaaaaggaggcagctgaaatgaacaagcggtccttcaagtatgcctgggtgttggacaaactgaaggctgagcgtgaacgtggtatcaccattgatattgccttgtggaagtttgagaccaccaggtactactgcactgttattgatgctcctggtcatcgggacttcatcaagaacatgattactggtacctcacaggcagactgtgctgttctcattattgattccaccactggtggttttgaagccggtatctccaaggatggacaaacccgtgagcatgcactgcttgctttcacccttggtgtgaagcagatgatttgctgctgtaacaagatggatgccacaacaccaaagtactccaaggcaaggtacgatgaaatcgtgaaggaagtttcttcctacctgaagaaggttggatacaaccctgataagattccatttgtccccatctctggctttgagggcgacaatatgatagagaggtctaccaaccttgactggtacaagggcccaactcttcttgaggccctggacatgatcaatgagcccaagaggcccacagacaagccactgcgactccctcttcaggacgtgtacaagattggtgggattggaactgtcccagtgggacgtgtggagactggtgtcctgaagcccggtatggtggtgacctttggcccctctggactgacaactgaagtcaagtctgttgagatgcaccatgagtctctcccagaggctttgcctggtgacaatgttggcttcaacgtgaagaacgttgctgtgaaggatctcaagcgtgggtttgttgcctcaaactccaaggatgaccctgctaaggaggcagccaacttcacctcccaggtcatcatcatgaaccacccgggtcagatcggaaatggctatgcccctgttctggactgccacacctcccacattgctgttaagtttgctgagatactgaccaagattgacaggcgatctggcaaggagcttgagaaagagcccaagttcttgaagaatggtgatgcagggtttgttaagatgattcccaccaagcccatggtggtggagactttctccgagtatcccccacttggtcgttttgctgttcgtgacatgcgtcaaactgttgctgttggagtcatcaagagcgtggagaagaaggatccatctggagccaaggtcaccaagtctgcagcaaagaagaagtgaaatgtgcctttgaggatatttatcctagatagactagttatgtctttaattggtgttatttgttttcgattttgttttgttgattttggcagttttgggtacagctctggagattttcatttcagttctctaatttcacttgcaaggacgcagacctgggtgcttgatagaaggtggaagctatagctgccgtttattgttttggtcactttacagtactcagatgagttgcttcatttggttgataaacaatttcaatttctgtttattgtcaggatcttggatttcggtacattgctttttagcatcattttgtgtttggtatgaatttatcctccgttttatcagtatttatttataactgctttcaggtaatatttggatcaaattttggctgcccattttgatattggaaatgttgctcttgtttgactgtatcgtctgtctatataccatctagcaaaataaccatataagtattcaaatgttttatgtagctttgtttcagacttatggcatattaggaagatggtttaattgaaattcagcactgattcaacttca

SEQ ID NO: 674 - DNA, 2053 bp, Vitis vinifera
ctttaaatagacccaaagcctatcctgcacctctcgtctctcccacataccctcttctgtttgctgtgttctctcgctgcggctagggttttagcacgatatctccttctaacgcatctttttaggaatccacaatgggtaaagagaaggttcacatcaacattgtcgtcattggccatgtcgactctggcaagtcgactaccactggtcacttgatctacaagcttggaggtattgacaagcgtgttattgagaggtttgaaaaggaagcggctgagatgaacaagaggtcattcaagtatgcttgggtgttggacaagctgaaggctgagcgtgaacgtggtatcaccattgatattgccttgtggaagtttgaaaccaccaggtactactgcactgttattgatgctcctggccatcgggacttcatcaagaacatgattactggtacctcacaggcagattgtgctgtcctcattattgactccaccactggtggttttgaagctggtatctccaaggatggacaaacccgtgagcatgcactacttgctttcacccttggtgtgaagcagatgatttgctgctgtaacaagatggatgccacaacacccaagtactccaaggcaaggtacgatgaaatcgtgaaggaagtttcttcctacctgaagaaggttggatacaaccctgataagattccatttgtccccatctctggctttgagggtgacaatatgatagagaggtctaccaaccttgactggtacaagggcccaactcttcttgaggccctggacatgatcaatgagcccaagaggcccacagacaagccactgcgactccctcttcaggacgtgtacaagattggtgggattggaactgtcccagtgggacgtgtggagactggtgtcctgaagcccggtatggtggtgacctttggcccctctggactgacaactgaagtcaagtctgttgagatgcaccatgagtctctcccagaggctttgcctggtgacaatgttggcttcaatgtgaagaacgttgctgtgaaggatctcaagcgtgggtttgttgcctccaactccaaggatgaccctgctaaggaggcagccaacttcacctcccaggtcatcatcatgaaccacccgggtcagatcggaaatggctatgcccctgttctggactgccacacctcccacattgctgttaagtttgctgagatactgaccaagattgacaggcgatctggcaaggagcttgagaaggagcccaagttcttgaagaatggtgatgcagggtttgttaagatgattccaaccaagcccatggtggtggagactttctccgagtatcccccacttggtcgatttgctgttcgtgacatgcgtcagactgttgctgttggagtcatcaagagcgtggagaagaaggatccatctggagccaaggtcaccaagtctgcagccaagaagaagtgaagcgtgcgcaatgggagctcaacagaggaagcctcctatcatcaaaataaaatgatttgtcgtgaaaacattttatctattactactgtcatagatcgtccgctttattttgtgcgtcatagttttctgccttcttccttgggtagcctgtcccagaactgggtgcttgataggcggtggcagataactggttgagtcctttgcttttcctttgtcattgtcatgttgtgtcgtgtcctcttttgatcgaggtgctttcggtttttcccttaagcggctcaagagttttgttgtgtcttttactccggatattttggtttttaatcaactgttcttagtttatttattggtttctgcctcgtggaagatttaaatcctagcctttaattttctcgttaggacatttaagtgattcgggtttggatccggtttcgaaatgaggcttttaatttggttgtctcgtgccaacaacccaaccccaagtcatactgtcaatgaccatcaacataaatacataacacgtctccaacttccaaccgttacggtatggtgcctatgtccgtttaatttctaat

SEQ ID NO: 675 - DNA, 1712 bp, Momordica charantia
ccgggggcttgctcctgcgtgaattttaggctgcttctttcttctgaattttctcttcaagttcttgcggttccatttggttaatatcaaatgggtaaagaaaaggttcacatcaacatcgtggttattggccatgtcgactctggaaagtcgaccaccaccggtcaccttatctacaagcttggaggaattgacaagcgtgtgatcgagagattcgagaaggaagctgctgagatgaacaagaggtcattcaagtacgcttgggtgctcgacaaacttaaggcagagcgtgaacgtggtattaccattgacattgctctctggaagtttgagaccaccaagtactactgcaccgtcattgatgcccccggtcatcgtgactttatcaagaacatgatcacgggaacttcacaggctgactgtgctgttctcattatcgactccacaactggtggtttcgaagctggtatttccaaggatggacagacccgtgaacacgctctccttgctttcactcttggtgtcaagcaaatgatctgctgctgcaacaagatggatgctaccactcctaaatactcaaaggcaaggtacgatgaaatcgtcaaggaagtctcttcctacttgaagaaggtcggatacaacccagagaagatcgccttcgttcccatctctggttttgagggtgacaacatgattgagaggtccaccaacctcgactggtacaagggaccaacccttcttgaagctcttgacttgatcaccgagcccaagaggccctcggacaagcccctccgtcttccactccaggacgtttacaagattgggggtattggtaccgtccctgtcggtcgtgttgaaaccggtgtcctgaagcctggtatggtcgtcaccttcggcccaactggactcaccactgaagttaagtctgttgaaatgcaccacgagtctctccctgaggcccttcccggtgacaatgttggtttcaacgtgaagaacgttgctgtcaaggatattaagcgagggtttgtcgcctccaactctaaggatgacccagccaaggaggctgccaacttcacatcccaggttatcatcatgaaccaccctggccagattggtaacggttatgcccctgtcctggattgccacacctcccacattgccgtgaagttcgccgagatcctcaccaagatcgatcgtcgttctggtaaggagctcgagaaggagcccaagttcttgaagaacggtgatgccggtatggttaagatgattcccaccaagcctatggtggtcgagaccttctctcaatacccaccattgggtcgttttgcggtacgggacatgcgtcaaaccgttgcggtgggtgtgatcaagagtgtggagaagaaggacccaaccggagccaaggtgaccaagtccgccgccaagaagaaataagagagccagccaacaaccagccaaaccctgcgttttgagtcattgagagaaggttttaaagaagacttttggtttttgctagttgtgagttggctttttactttgtatagagcggctctactcggtagaaggtttttaattatttagtcttattatgcgtctggttttgtgctattttcatcttcttatggtctgttgtcgttatttttgagtcatttgagacattaaaattgttggataattgaggtttaaatgttttatttttcagttaattgcga

SEQ ID NO: 676 - DNA, 1660 bp, Tropaeolum majus
cctgctttcttcttctctgcggctagggtttttctaattaactcatcatgggtaaagaaaaggttcacatcaacattgtcgtcattggacatgtcgactctgggaaatcaaccaccactggtcacttgatctacaagcttggtggtattgacaagcgtgttatcgagagatttgagaaggaagcagctgagatgaacaaaagatcattcaagtacgcatgggtgcttgacaagcttaaggccgagcgtgagaggggtattaccatcgatattgctctttggaagtttgagacaaccaagtactattgcaccgtcattgatgctcctggacatcgtgactttatcaagaacatgattactggtacctcacaggctgactgtgcggttctcatcattgactccactactggtggttttgaagctggtatttccaaggatggtcagacccgtgaacatgctcttcttgcattcacccttggtgtcaagcagatgatctgttgttgcaacaagatggatgccacaactcccaagtattccaaagctcgttatgaggagatcgtgaaggaagtctcttcctacctgaagaaagttgggtacaatcctgacaaaattgcctttgtccctatttctggattcgaaggtgataacatgattgagaggtcaaccaaccttgattggtacaagggccctacccttcttgaggctcttgaccttatcaatgagcccaagaggccctcagacaagcccctacgtctcccacttcaggatgtttacaagattggaggtattggaacggtgcctgtgggtcgtgttgaaactggtgtcattaagcctggtatggttatcacctttggacctactgggttgaccactgaggtcaagtctgttgagatgcatcacgaagctctccaagaagctcttcccggagacaatgttgggttcaatgttaagaatgttgctgttaaggatctcaagcgtggtttcgttgcatcgaactcaaaggatgaccctgctaaggaggctgctaactttacctcgcaagttatcatcatgaaccatcctggtcagatcggaaatggatatgctccagttttggattgccacacatcccacattgctgttaagtttggtgagattcttaccaagattgacagacgatcaggtaaggagctggagaaggaacccaagttcttgaagaatggtgatgcaggtatggttaagatgcttcccacaaagcccatggttgttgaaaccttctcgcaataccctccccttggacgttttgccgtcagggacatgcgtcaaactgttgcagttggtgttatcaagagtgttgagaagaaggatccatctggtgccaaggttaccaagtctgctgccaagaagaagtgaatcgtggagattgttcgcaaggtcaataaaaactgggttcttacccggattctgctttctagatgtctttgtgtctattttgatggttacagtttcaaatcatttctgtcatcccgtgattgctcttcacagaactgggttcttgataggcggtggcgggatttagtgtctgtttttgtttgaattgtctctttctttgtttttattttgtactgtgacaactttttaattttgaactcttggtttgcgtttattagtttttctgtttt

SEQ ID NO: 677 - DNA, 1407 bp, Carica papaya
tcttcttctccatctagcggcgatttctctgcttctctgttttcttaagtaccgctatgggtaaggaaaaggttcatatcagcattgttgttattggccatgtcgactctggaaagtcgaccaccactgggcacttgatttacaagcttggaggtattgacaagcgtgttattgagaggttcgagaaggaagctgctgagatgaacaagaggtcattcaagtatgcttgggtgctggacaagctcaaggccgagcgtgagcgtggtatcaccatcgatattgccttgtggaagtttgagaccaccaagtactactgcactgttattgatgcccctggacatcgtgactttatcaagaacatgattactggtacctcccaggccgattgtgctgtccttatcattgactctaccactggaggttttgaagctggtatctctaaggatggtcagacccgtgagcatgccctccttgctttcacccttggtgtcaagcaaatgatttgctgctgcaacaagatggatgccaccacccccaagtactcaaaggcaaggtacgatgaaattgtgaaggaagtgtcatcctacttgaagaaggttggttacaaccccgacaagattccatttgttcccatctctggatttgagggtgacaacatgattgaaagatccaccaaccttgactggtacaagggcccaactcttctggacgctcttgacttgatcaatgagcccaagaggccgtcagacaagccccttcgtctcccacttcaggacgtgtacaagattggtggtattggaactgttccagtgggacgtgttgaaactggtgtcctgaagcctggtatggttgttacttttgggcccactggattgacaactgaagttaagtcggttgagatgcaccacgaggctctccaagaggctcttcctggcgacaatgttgggttcaatgttaagaacgttgccgtgaaggatctcaagcgtgggtttgttgcctcaaactccaaggatgatcctgcgaaggaagcagccaacttcacatcgcaggttatcatcatgaaccaccctgggcagattggaaatggctatgccccagtgctcgactgccacacatctcacattgctgtgaaatttgcggagatcctcaccaagattgatagacgatcaggaaaggagcttgagaaggagcccaaattcttgaagaatggtgatgctggatttgttaagatgattccaaccaagcccatggttgtggaaactttctcccagtatcctcctcttggtcgttttgctgtgagggacatgcgccagactgttgctgttggtgtcatcaagaatgtggagaagaaggatccttctggtgctaaggtgaccaaatctgctgccaagaagaagtgaaccgtgc

SEQ ID NO: 678 - DNA, 1675 bp, Pisum sativum
ctgaattcggcacgaggcggccgcagttgctcagtctctctctgcggctgaggattcgaacgagtgacatacttcaatttcgtttctgctaagttaagacatcatgggtaaggaaaaggttcacattaacattgttgtcattggacatgtcgactctggaaaatcaaccacgactggtcacgtgatctacaagcttggaggtattgacaagcgtgtgatcgagaggtttgagaaggaagctgatgaaatgaacaagcgttcattcaagtatgcctgggtgcttgacaagcttaaggccgagcgtgaaagaggaattaccattgatattgccttgtggaaatttgaaaccaccaagtactactgcactgtcattgatgctcctggacatcgtgactttatcaagaacatgattactggaacctcccaggctgattgtgctgtccttattattgattccaccactggtggttttgaagccggtatctctaaggatgggcagacccgtgaacatgcactacttgcctttactcttggagtgaagcagatgatttgttgttgtaacaagatggatgctaccacccctaagtactccaagggcaggtatgaggaaatcgtgaaggaagtttcttcctacttgaagaaggttggttacaacccagacaaaattcccttcgttcccatctctggttttgagggagacaacatgattgagaggtccaccaaccttgactggtacaagggaccaactctacttgatgctcttgacaacatcaatgagccaaagagaccctcagacaagcccctcaggcttccattgcaagatgtttacaagattggtggtattggaactgtgccagtgggacgtgttgaaactggtgttgtgaagcccggtatgcttgtaacttttgctcctactggtttgacaactgaggttaagtccgttgagatgcaccacgaggctctcaccgaggctcttccaggagacaatgtcggattcaatgttaagaatgttgcagtcaaggatctcaagcgtggttttgttgcatccaactccaaggatgaccctgccaaggaagctgccaacttcacatcccaggtcatcatcatgaaccaccctggacagattggaaatggttatgcaccagttcttgattgccacacctctcacattgctgtgaagtttgctgagcttatcaccaagattgacaggcgatctggtaaggagattgagaaggagcccaagtttttgaagaatggtgatgccggtatggttaagatgattccaaccaagcccatggtggtggaaacttttgctgagtatcctcctcttggtcgttttgctgtgagggacatgagacaaactgttgctgtcggagtcatcaagagtgtggagaagaaggacccaactggagccaaggtcaccaaagcagcagccaagaagaagtgatttcactccatggttgcttctgcacaagttgttcctttatagtagtttatctttccagtttaattttgaagtttttgcctgtttcattaaactaaacttacaaaactgggttcttgatcggcggtggtcaattttccattttgtgattttcctgttactgtttttatggtgttaatttatgtttgagtagtacattttgttgccgagggatgtttaaattgcattaat

SEQ ID NO: 679 - DNA, 1957 bp, Capsicum annuum
tcagcatagtagtggttcattctctataagcggccagggttttagctaaagtttctctctcacttttcgtactctaaaagtttctcaggcatcatgggtaaagagaaaattcacattagcattgttgtcattggtcatgtcgactctggaaagtcgaccactactggtcatttgatctacaagcttggtggtattgacaagcgtgtcatcgaaagattcgagaaagaagcagctgagatgaacaagaggtccttcaagtatgcttgggtgcttgacaagctgaaggcagagcgtgaacgtggtattaccattgatattgccttgtggaagttcgagaccacaaagtactactgcactgtcattgatgcccctggacacagggattttatcaagaacatgattactggtacctcccaggctgactgtgctgtcctcattattgactccaccactggtggttttgaagctggtatctccaaggatggacagacccgtgagcacgcattgcttgctttcaccctcggtgtcaagcaaatgatttgctgctgtaacaagatggatgctaccacccccaaatactccaaggccaggtatgatgaaattgtgaaggaagtttcttcctacctcaagaaggttgggtacaaccctgacaaaatcccctttgtccccatctctggtttcgaaggagacaacatgattgagcgatcaactaatctcgactggtacaagggcccaaccctacttgaggctcttgaccagattaatgagcccaagaggccctcagacaagccactccgtctcccacttcaggatgtctacaagattggtggtattggaactgtgcctgttggtcgtgttgaaaccggtgtcattaagcctggtatggttgtgacttttggtcctactggtctgactactgaagttaaatctgttgagatgcaccatgaggctcttcaggaggctcttcctggtgacaatgtcggtttcaacgtcaagaacgttgctgttaaggatctcaagagaggttatgttgcttctaactccaaagatgacccagcaaagggcgctgccagcttcactgctcaagtcatcatcatgaaccatcctggtcagattggaaacggatatgctccagtgctcgattgccacacctcccacattgctgtcaagtttgctgagatcttgaccaagatcgatagacgttctggtaaggaacttgagaaggagcccaaattcttgaagaatggtgatgctggtatggttaagatgattcccaccaagcccatggtggttgaaacttttgctgagtacccaccattgggacgttttgctgtgagggacatgcgtcaaactgttgctgttggtgtcgtcaaaaatgttgacaagaaggaccctactggtgccaaagtcaccaaggctgctcagaagaagaagtgaggtgtttttgatgagattctggatttatgaactagttttgtttaattgcattagctattttcgattttgttttgaacaatttacctgcactggaaatgtctctagaagctttgtcatggttctctagcctcttttgaggatactggagttatcgagcaatttggtttttatccaagttgcttgatgggcaatgacattagtacctctggatgcctttctcgtgtctgttttttatagcgaatttcaagatgatctgctgagacggttttaatatgtgtttttgggatatcttttctcttctaaaaaaaaaaaaaaaaaaaaaacgtgcaaagggaagttactgattattggaaaaaatatgttttagctagaaaagcagctgcttgctaggggcattacggacttttttgcctcgactgctactgaaaagagagagtcgatgccattattgatgccattattcacttggcgcgagaaccaactgcattttaattttattattaattacaaaaaaataatg

SEQ ID NO: 680 - DNA, 1519 bp, Papaver somniferum
ccaccgcctatcaagcacccaggtttgcatctggaatgactcaacaaaacaaaggcaacaaaagatataaaactgcaatgatagctaaccaaagcaaaccagaacaaaaatgactacttttctgaagaagctctgtgctgcggagcttttcttatcgccgttctgttattttctaagaattcaatatgggtaaagagaaggttcacatcaacattgtcgtcattggacatgtcgactctggtaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgcactgtggaagtttgagaccaccaagtactactgcacagttattgatgctcctggacatcgtgactttatcaaaaacatgattactggtacttctcaggctgattgtgccgtcctcattatcgattccaccactggaggttttgaggctggtatctcaaaggatggtcagactcgtgagcatgctcttcttgctttcacccttggtgtcaagcagatgatctgttgttgtaacaagatggatgccaccacccccaagtactcaaaggctaggtacgatgaaattgtcaaggaggtctcatcttacttgaagaaggttggatacaacccagaaaaaattgcctttgttcctatctctggattcgagggagacaacatgattgaaaggtccaccaaccttgactggtacaagggaccaactctccttgaggctcttgacaacatctctgagccaaagagaccctcagacaagccccttcgtcttccccttcaagatgtttacaagattggaggtattggaactgtgccagttggacgtgttgaaactggagtcatcaagcctggtatggttgttacctttggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactccaaggatgacccagccagggaagctgccaacttcacctcccaggtcatcatcatgaaccatcctggtcagattggtaatggttatgctccagttcttgactgtcacacatctcacattgctgttaagtttgctgagatccaaaccaagatcgataggcgatctggaaaggagcttgagaaggagcccaagttcttgaagaatggtgatgctggtattattaagatgattccaaccaagcccatggttgtagagaccttcgctcagtatccacctcttggacgttttgctgttagggacatgaggcagacagttgctgttggtgtcatcaagggggttgagaagaaggacccaaccggagccaaggttaccaagtctgctgtcaa

SEQ ID NO: 681 - DNA, 1678 bp, Rosa hybrid cultivar
ttgcctcttgctgctgcgctgcttcaactcaaggctcttagatctctgttgaacttagcatatcatcatgggtaaggagaaggttcacatcaacattgtggtcattggccatgtcgactctgggaaatcgaccaccactggtcatctcatctacaagcttggaggtattgacaagcgtgtgattgagaggtttgagaaggaagctgctgagatgaacaaaaggtcattcaagtacgcctgggtgctcgacaagcttaaggctgagcgtgagcgtggtattaccattgatattgctttgtggaagtttgagaccacaaggtactactgcactgtcattgatgctccagggcatcgtgactttattaagaacatgattactggaacttcacaggctgactgtgctgttctcattattgattccaccactggtggttttgaggctggtatttccaaggatgggcagacccgtgagcatgctcttcttgctttcacccttggtgtgaagcaaatgatttgctgctgtaacaagatggatgctactactcccaagtactcaaaggcgaggtacgatgaaattgtgaaggaagtctcatcctatctgaagaaggttggttacaaccccgacaaaattgcctttgttcccatctctggatttgagggtgacaacatgattgagaggtccaccaaccttgactggtacaagggtcctacccttcttgaggcactcgaccagatcaacgagccaaagaggccctcagacaagcccctccgtctcccactgcaggatgtctacaagattggtggtattggaactgtgccagtgggtcgtgttgagactggagttatcaagcctggtatggttgtcacttttggtccaactggtctgaccactgaagttaagtctgttgagatgcatcacgaggctcttcaggaggctctccctggtgacaatgtcgggttcaatgttaagaatgttgctgtgaaggatctcaagcgtggttttgttgcatccaactccaaggatgatcctgcaaaggaggctgccaacttcacatcccaggtcatcatcatgaaccaccctggacagattggtaatggttatgccccagttcttgattgccacacttctcacattgctgtgaagttcggtgaaatcctcaccaagattgacaggaggtctggtaaggaacttgagaaggagcctaagtttttgaagaatggagatgctggtatggttaagatgcttcccaccaagcctatggttgttgagaccttctctgagtacccacccttgggacgttttgctgtccgtgacatgagacagactgttgctgttggtgttatcaagaacgtggagaagaaggatccaagtggtgctaaggtcaccaagtctgctgccaagaagaagtgaatggatcacaatgcaattttacccgccgaagacatcttatatttaagttgtgtgtttttgaaccgtttagttattctagcttttagttttctcgcttctagttctgtgtgtttctgcttgtccagtccttgcactcagaattgggtgcttgacaggcggtggtgacccaaatgttctagttgcgtcgtcttttcaatttgtcggagtttgagactgtttacttttgaagcttttgttgctaaatggatgatttttgtttggctataa

SEQ ID NO: 682 - DNA, 1828 bp, Solanum phureja
tacttgtggtttgcgttgttattctccatacgcggccagggttttagcgaagctctttctctcatttttccgtttgtgaaagttgtttagacatcatgggtaaagagaagattcatatcagcattgttgtcattggacatgtcgactctggaaagtcgaccactactggtcacttgatctacaagcttggtggtattgacaagcgtgtcattgagaggtttgagaaagaagcagccgagatgaacaagaggtccttcaagtatgcatgggtgcttgacaagcttaaggctgagcgtgaacgtggtattactattgacattgccttgtggaagtttgagaccacaaagtactactgcactgtgattgatgcccctggacacagggatttcatcaagaacatgattactggtacctctcaggctgactgtgctgtcctcatcattgactccacaactggtggttttgaagctggtatttctaaggatggacagacccgtgagcatgcattgcttgctttcacccttggtgtcaagcaaatgatttgctgctgtaacaagatggatgctaccactcctaagtactccaaggctaggtatgatgaaatcgtgaaggaagtttcttcctacctcaagaaggtaggatacaaccctgacaaaatcccctttgtccccatctctggttttgaaggagacaacatgattgagcgatcaaccaaccttgactggtacaagggcccaaccctacttgatgctcttgaccagattaacgagcccaagaggcccacagacaagcccctccgtcttccacttcaggatgtctacaagattggtggtattggaactgtacccgtcggtcgtgttgaaactggtgtcattaagcctggtatggttgtcacttttggtccaactggtctgaccactgaggttaaatctgttgagatgcaccacgaggctcttttggaggcacttcctggtgacaatgttgggttcaacgtcaagaacgttgcagttaaggatcttaagagaggtttcgttgcctctaactccaaagatgacccagcaaagggtgctgccagcttcactgcccaagttatcatcatgaaccaccctggtcagattggaaatggatatgccccagtgctcgactgccacacctcccacattgctgtcaagtttgctgagatcttgaccaagattgacagacgttctggtaaggaacttgagaaggagcccaagtttttgaagaatggtgatgccggtatggttaagatgattcccaccaagcccatggttgttgagaccttcgctgagtacccaccattgggacgttttgctgtgagggacatgcgtcaaactgttgctgttggtgtcgtcaagaatgtcgacaagaaagaccctactggtgccaaagtcaccaaggctgcccaaaagaagaagtgatgtgtttttgatgatattctgcattgatgaactagttttgtttaattgcattagctattttcaattttgttctgaacattttaccagtcatagacacggctccagaagcttttgtcatggttctctagcctcgtttgaggatagtggagttgttgagcaatttggtttgatccaagttgcttgatgggcagtgacaatagcacctttggatgtctttctcctgtctggttttttttatagcgaattccaagatgagctgctgaaacggttttaatatgttatgctttttaagatatcttctctcctgctttctcttccgcatttcctttattgttctgttgtgatcattgctcctagttataacttagtcattgttttttcctgtagaa

SEQ ID NO: 683 - DNA, 2132 bp, Sorghum bicolor
gtgggccccagggcagggtagccgccaaggcagggccgtccgtaggcgctacgaaagctggaggagttcctgttcgcatgatgacaatcgcacggccacggcaaaccctagccgccgggcaggtcggtccccgcgcggggggcggcggcgcggggggcgcgctatataaacagagcccttcatccgatgcctccaacccatctggcgacctcgatcccctcccctgttggttctgtctgttgacttccccccatcgagctagctagtcagctggtcccgttgccatggggaaggagaaggttcacatcaacattgtggtcattggtcatgttgactccggcaagtccaccaccaccggccacctcatctacaagcttggaggcatcgacaagcgtgtcatcgagaggtttgagaaggaggctgccgagatgaacaagaggtccttcaagtacgcctgggtgcttgacaagctcaaggccgagcgcgagaggggcatcaccattgacattgccctgtggaagtttgagaccaccaagtactactgcactgtgatcgacgctcctgggcaccgtgacttcatcaagaacatgatcaccggcacctcccaggctgattgtgcggtgctcatcattgactccaccactggtggctttgaggctggtatctccaaggacggccagacccgtgagcacgcactccttgctttcactcttggtgtcagacagatgatctgctgctgcaacaagatggatgccaccacccccaagtactccaaggctcggtacgacgagatcgtcaaggaagtgggttcctacctcaagaaggtggggtacaacccggacaagatccccttcgtgcccatctctgggttcgagggtgacaacatgatcgagaggtctacgaacctggactggtacaagggccccaccctccttgaggcgctggaccagattaacgagcccaagcggccctcggacaagcccctgcgccttcccctgcaggacgtgtacaagatcggcggcatcggcaccgtcccggtgggccgtgtggagaccggcctcattaagcccggcatggtggtcacctttggccccacgggcctgacgacggaggtcaagtcggtggagatgcaccacgagtcgatgcaggaggcgcttcccggcgacaacgtcggcttcaacgtcaagaacgtggcggtcaaggacctgaagcgtggctacgtggcctccaactccaaggacgaccccgccaaggaggctgccagcttcaccgcgcaggtgatcatcatgaaccaccccgggcagatcggcaacggctacgccccggtgctggactgccacacctcccacatcgccgtcaagttctcggagctgctcaccaagatcgaccggcggtcgggcaaggagctggagagcgcccccaagttccttaagaatggtgatgccggcttcgtcaagatgatccccacaaagcccatggtggtggagaccttctcggagtatcctccactggggcgcttcgctgttcgtgacatgaggcagacggttgcggtcggtgtgataaagagcgtggagaagaaggacccgacgggagccaaggtgaccaaggcggctgccaagaagaaatgatgatgatcctgcatatccatggttcctggtttcttgctggttggattatatacatgtcaaataagtgtccctattttgttgggtggtgctagtagtagttacaaaagaacaatttgatggttcagtgtctttacagtatgtgtcgacggttgtgttcgtgattgcctaccattataatatgcctaccattataatagtatttatcagtgacatgtttgatgtttctatgaggcgtgccatgtgcagatgccgattgcttgccttttggctaattgggctaatggctacacatgaacgcccagcagttaacctgttgtgtgtgttgtgcttggtactcagcaaggcgtactttttctgccaagtatttttagtcacattcatcgattagtacatctactcatctcatctcgtgtatgtccgtgatgaagtcttcactcttcagcttgggtacaagttaacttataagttgtataatagttattttttatttatcatattttaatt

SEQ ID NO: 684 - DNA, 1836 bp, Glycine max
gctacactccttctcttctcgcggcttctttctccaagattaagtttcagtagtaatgggtaaggaaaaggttcacattaacatcgtggtcattggccatgtcgactctgggaagtcaaccaccaccggtcaccttatctacaagctcggaggtattgacaagcgtgtcatcgagagattcgagaaggaagctgctgagatgaataagaggtctttcaagtatgcctgggtgcttgacaagctcaaggctgagcgtgaaagaggaatcaccattgatattgctctgtggaagtttgagaccacaaagtactactgcacagtcattgatgcccctggacatagggatttcatcaagaacatgattactggaacatcccaagctgactgtgctgttcttattattgattccaccactggtggttttgaagctggtatttccaaggatggacagactcgtgagcatgctctccttgcattcactcttggtgtgaggcagatgatttgctgctgcaacaagatggatgccactacacctaagtactccaaggcaaggtacgatgaaattgtcaaggaagtttcttcctacatgaagaaggtcggatacaaccctgacaaaattccttttgttcccatctctggttttgagggagataacatgattgagaggtctacaaaccttgactggtacaagggtccaacccttcttgaggcccttgatcagatcaatgagcccaagaggccatcggacaagcctctccgattgccccttcaggatgtctacaagattggtgggataggaactgtgcctgttggacgggttgaaaccggtgtcttgaaacctggaatggtggttacctttgcaccaactggactaacaactgaagttaagtctgtggagatgcaccatgaaactctcactgaggcccatcctggtgacaatgtgggattcaatgttaagaatgttgctgtcaaggatctcaagcgtggttttgttgcgtctaactctaaggatgaccctgccaaggaggctgctaacttcacatcccaagttatcatcatgaaccaccctggacagattggaaatggctatgcacctgttcttgattgccacacctcccacattgccgtcaagtttgctgaactcttgaccaagattgacaggcgatctggtaaggaacttgagaaggagcccaaattcctgaagaatggtgatgctggtttggtcaagatgattcccaccaagcccatggtggttgaaaccttctccgagtatcctccacttggtcgttttgctgtgagagacatgcgtcaaactgtggctgtgggagtcatcaagagcgtcgagaagaaggaccctactggagctaaggtcaccaaggctgcacagaagaaggccaaatgaattgtgctggatggtttatcaaggaaactctattattatgactacaataaatggtttcttgttcgtagtacttcattttttcgtgtagggaacttgtttatcagattttgtgtcaggtttgctccgtcatctcgcaacttttgttcccagaactgggttcttgatcgacggtggcaaggctatttctttttcattgttatgctttgtttctattacaatgtgtctctgtaagaacaataagctgcatagtactagtcctatgctgcaggtttggcttttgaatttcaagtctatattgtgttgttataattattcttattttaaatcttttgtgggtcattcatgtggcggtgaaagatattctggagccagaatgttggaagcatttcaaatgtgattggtgagatctttaaagcttaccgtgtttgcttctg

SEQ ID NO: 685 - DNA, 2025 bp, Glycine max
gctacactccttctcttctcgcggcttctttctccaagattaagtttcagtagtaatgggtaaggaaaaggttcacattaacatcgtggtcattggccatgtcgactctgggaagtcaaccaccaccggtcaccttatctacaagctcggaggtattgacaagcgtgtcatcgagagattcgagaaggaagctgctgagatgaataagaggtctttcaagtatgcctgggtgcttgacaagctcaaggctgagcgtgaaagaggaatcaccattgatattgctctgtggaagtttgagaccacaaagtactactgcacagtcattgatgcccctggacatagggatttcatcaagaacatgattactggaacatcccaagctgactgtgctgttcttattattgattccaccactggtggttttgaagctggtatttccaaggatggacagactcgtgagcatgctctccttgcattcactcttggtgtgaggcagatgatttgctgctgcaacaagatggatgccactacacctaagtactccaaggcaaggtacgatgaaattgtcaaggaagtttcttcctacatgaagaaggtcggatacaaccctgacaaaattccttttgttcccatctctggttttgagggagataacatgattgagaggtctacaaaccttgactggtacaagggtccaacccttcttgaggcccttgatcagatcaatgagcccaagaggccatcggacaagcctctccgattgccccttcaggatgtctacaagattggtgggataggaactgtgcctgttggacgggttgaaaccggtgtcttgaaacctggaatggtggttacctttgcaccaactggactaacaactgaagttaagtctgtggagatgcaccatgaaactctcactgaggcccatcctggtgacaatgtgggattcaatgttaagaatgttgctgtcaaggatctcaagcgtggttttgttgcgtctaactctaaggatgaccctgccaaggaggctgctaacttcacatcccaagttatcatcatgaaccaccctggacagattggaaatggctatgcacctgttcttgattgccacacctcccacattgccgtcaagtttgctgaactcttgaccaagattgacaggcgatctggtaaggaacttgagaaggagcccaaattcctgaagaatggtgatgctggtttggtcaagatgattcccaccaagcccatggtggttgaaaccttctccgagtatcctccacttggtcgttttgctgtgagagacatgcgtcaaactgtggctgtgggagtcatcaagagcgtcgagaagaaggaccctactggagctaaggtcaccaaggctgcacagaagaaggccaaatgaattgtgctggatggtttatcaaggaaactctattattatgactacaataaatggtttcttgttcgtagtacttcattttttcgtgtagggaacttgtttatcagattttgtgtcaggtttgctccgtcatctcgcaacttttgttcccagaactgggttcttgatcgacggtggcaaggctatttctttttcattgttatgctttgtttctattacaatgtgtctctgtaagaacaataagctgcatagtactagtcctatgctgcaggtttggcttttgaatttcaagtctatattgtgttgttataattattcttattttaaatcttttgtgggtcattcatgtggcggtgaaagatattctggagccagaatgttggaagcatttcaaatgtgattggtgagatctttaaagcttaccgtgtttgcttctggatcataactcaaaacctgcaacaaaatatgaagttatatggactagcccttactttgtttgtgagaatgtgaagcatgtcaaccaaacatgctatacggatcatttggtaatttatatggtaccaagacagatgtataaaaagagcccttattcaggttccctaattctaaaggcctagtttgctcta

SEQ ID NO: 686 - DNA, 1585 bp, Vinca minor
ttttctaagcacttccgagtttaacaattgaaatttaagatgggtaaggagaagactcacatcaacattgtggtcattggacatgtcgactctggcaagtccacaacaactggacatctcatttacaagcttggaggtattgacaagcgtgtgattgagagatttgagaaggaagctgctgagatgaacaagaggtcattcaagtatgcttgggtgcttgacaagctcaaggctgagagggagcgtggtattactattgatattgctttgtggaagtttgagaccacaaagtattactgcactgttattgatgctcctggacatcgtgactttattaagaacatgattactggtacatcccaggctgactgtgctgtgctcatcattgattccaccactggtggatttgaagctggtatctctaaggatggtcagacccgtgagcatgctctccttgctttcacacttggtgtcaagcaaatgatctgttgctgcaacaagatggatgctactactcccaagtactcaaaggcaaggtttgatgaaattgtgaaggaggtctcatcttatctgaagaaggttggatacaatcctgataaaattcctttcgttcctatctctgggtttgagggtgacaacatgattgagaggtctaccaaccttgattggtacaagggtccaactcttcttgaggcccttgacttgatcagcgagccaaagaggccaacagacaagcctcttcgtctccctcttcaggatgtctacaagattggtgggattggtactgttccagtgggaagggttgagactggtgtcctcaagccaggaactgttgtgacatttggacccactgggttgacaactgaagttaaatctgttgagatgcatcatgagacactccaagaagctcttccgggagacaatgttggctttaatgttaagaatgttgccgtcaaggatctcaagcgtggtttcgttgcatccaactcaaaggatgatccagccaaggaagctgctaacttcacatctcaggtcatcatcatgaaccatcctggtcaaattggtaatggctatgctcctgttctcgactgccacacttcccacattgctgtgaagtttgctgagatattggtcaagatcgacaggcgatctggtaaggagctcgagaaggagccaaagtttttgaagaacggagatgctggcttcgtcaagatgattcccaccaagcccatggttgttgagaccttctccgagtatccaccactcggtaggtttgccgtcagggacatgcgccagactgttgctgtgggtgttatcaagagtgttgaaaagaaggatcccactggagctaaagtcacaaaggcagctgctaagaagaagtgaacgatttgcgttattatttctctcaaagaagaatattatatgtttttaagtctttttcccattcttttagcatctcctgtttgtcataactcattgtcattgtccggttgctgctcccagaattgggtgttggatcgccggtggtagttgctatgttttgagagattatatgtgatgtgttgatttcgaattgcgaatgaaa

SEQ ID NO: 687 - DNA, 1715 bp, Citrullus lanatus
ggctataaatataccataaatctcattgctaatacctcgctgcttgctcctgcgtgaaatttaggctgcttctttcttttcatttctctgcaaattcttgtggttcgatttggttaatatcaaatgggtaaagaaaagattcatatcaacatcgtggttattggccatgtcgactctggaaagtcgaccaccactggtcatcttatctacaagcttggaggaattgacaagcgtgtgattgagagattcgagaaggaagctgctgagatgaacaagaggtcattcaagtatgcttgggtgctcgacaaacttaaggcagaacgtgaacgtggtattaccatcgacattgctctgtggaagtttgagaccaccaagtactactgcacagtcattgatgctcccggacatcgtgactttatcaagaacatgattactggaacttcacaggctgactgtgctgtcctcattattgactccactactggtggttttgaggctggtatttccaaggatggtcagacccgtgagcacgctcttcttgctttcacccttggtgtcaagcaaatgatctgctgctgcaacaagatggatgctaccactcccaaatactccaaggcaaggtacgacgaaatcgtgaaggaagtctcatcttacctcaagaaggtcggatacaacccagaaaaaatcccttttgttcccatctctggtttcgagggtgacaacatgattgagaggtccaccaaccttgactggtacaagggaccaaccctccttgaggctcttgacttgatctctgagcccaagaggccctcagacaagcccctccgtctcccacttcaggacgtttacaagattggtggtattggaactgtccctgttggacgtgttgaaactggtatcctcaagcctggtatggttgtcacctttggaccaactggactcaccactgaagttaagtctgttgaaatgcaccacgagtctctgccagaggccttgcctggtgacaatgttggcttcaacgtgaagaacgttgctgtcaaggatctcaagcgtggtttcgttgcctcaaactccaaggatgaccctgccaaggaggctgccaacttcacatcccaggttatcatcatgaaccaccctggccagattggtaacggttatgccccagtccttgattgccacacctcccacattgctgttaagtttgctgagatcctcaccaagattgatcgtcgatctggtaaggaactcgaaaaggagcccaaattcttgaagaacggtgatgccggtatggttaagatggttccgaccaagccaatggttgtggagacattctcctcatacccaccattgggtcgttttgctgttcgtgatatgcgtcaaaccgttgcagttggtgtgatcaagagtgtggagaagaaggacccaacaggagccaaggtcaccaaatccgctgtcaagaagaaataagccaaccaaccccgagcctgcattttgtgtcattgagaagaatggttttaatatgctaaatatgagacttttggtttttggtgctcttagtagttcttaattatttagtttacttgtctggttttgtgtttttttgtcttaattttgctttgttgtttctgagtcattttgagacattaaaattgttggatactgctgagggttaaatgtttttaatttaagcttaatttctcttcatccttttgttt

SEQ ID NO: 688 - DNA, 2264 bp, Ricinus communis
ggtttgacttttacaaggttccttcactgttgcgtctgggcaagttcgtcgttatgtttttttgttgagggtattaatgtaaataaacttacagtgcctgctcagaaaaccctagcctgtgtttttcactataaaagtgatcgtttatccttcatttgcttacaatttgcccttgtttttgctgcgtttcgctcagcagggcttttgttagagtttttctacttcaatctcttcagttttaggcatctataatgggtaaggagaaggttcacatcaacattgtggtcattggccatgtcgactctggaaagtcaactactactggccatctcatctataagttgggaggtattgacaagcgtgtcattgagagattcgagaaggaagctgctgagatgaacaagaggtcattcaagtatgcttgggtgcttgacaagcttaaggccgagcgtgagcgtggtatcaccattgatattgccttgtggaagtttgagacaccaagtactactgcaccgtcattgatgcacctggacatcgtgactttatcaagaatatgattaccggtacttcacaggctgactgtgctgttctgattattgattccaccactggtggttttgaagctggtatttccaaggatggtcagacccgtgagcatgctctccttgctttcaccctcggtgtcaagcaaatgatttgctgttgcaacaagatggatgctactactcccaagtactccaaggccaggtatgatgaaattgtcaaggaggtttcctcttacctgaagaaggtcggatacaaccccgataaaattcctttcgttcccatctctggcttcgaaggtgacaacatgatcgagaggtccaccaaccttgactggtacaagggaccaaccctacttgaagctcttgaccagatcaatgagccaaagaggcccacagacaagcctcttcgtctcccacttcaagacgtttacaagattggtggtattggaacagttccagtgggtcgggtggagactggtgtcctcaagcctggtatggttgtgacctttggacccagtggactgacaactgaagttaagtcggttgaaatgcatcacgaggctctccaggaggccctccctggtgacaatgttggtttcaatgttaagaatgttgctgtcaaggatcttaagagaggttttgttgcttcaaactccaaggacgatccagcaaaggaggcagccaacttcacatcccaagtcatcatcatgaaccatcctggtcagattggaaatggatatgctccagtgttggactgtcacacctcccacattgctgtgaagtttgctgagatcctaaccaagattgatcgtcgatccggtaaggagcttgagaaggagcccaaattcttgaagaatggtgatgctggtttcgtgaagatgattccaaccaagcccatggttgttgagaccttctccgagtaccctccattgggtcggtttgctgttagggacatgcgccaaactgttgcagtgggtgttatcaagagtgttgagaagaaggacccaagcggagctaaggtcaccaagtctgctgccaagaagggaggaaaatgagagttaaattattagctgttggaaggtttttttttaatgtacattgtctagttgctacgcccacatatttgccttgtataggcagtggatgcgtagtatgtttgaaggcaccattttgttttggatgtttgaaggcaccattttgttttggatgtttgaaggcattcttctagtgaggtttgtgtatggttgagaattttgagaatttacttacttatgccgactgataatgggagaacaaagtctactgttttctttcagggtatgttaatattctgatgctgtgtcgagtagctcttgtgatttggtacatgtggttctacggagaggatgaaattggccaatgagcttacaaacagcaaatcctccagagaatcgttaccaattctgacagagtccctgatgcaatttccactgtttattttgctgctagccatggtataaatctcagtatgctgcttttgttagaaaattggaagtacttgctgattttgctgcaagtcctcgttgccatcagaatccagatcatcattttccttgcatatttagattctttatgagttgctatttctaatctttttggcaatataaaagaaatgagaaaaattaatttattattattttttattatacctcttcaagaatctgcaattaatgttctttc

SEQ ID NO: 689 - DNA, 2148 bp, Panicum virgatum
gctgagtagccgctccgaaaggaagagaatgcggtggcgtccgtaggcgctacgaaagctttggatgagttgcgctatataaacagagcccctccctcccacctcgatggctcgatgcaaccaccgccctgccctcacctgttgacttgctccaattggccttgctcgtcgtcatctccacccaccttgagctcgagaggcctttctagccatgggtaaggagaaggttcacatcaacattgtggtcatcggccatgtcgactctggcaagtccacgaccaccggccacctcatctacaagctgggaggcatcgacaagcgcgtcatcgagaggttcgagaaggaggccgccgagatgaacaagaggtccttcaagtacgcctgggtcctcgacaagctcaaggccgagcgcgagaggggcatcaccatcgacattgccctgtggaagttcgagaccaccaagtactactgcacagtgatcgacgctcccggacaccgtgacttcatcaagaacatgatcaccgggacctcccaggccgattgcgccgtgctcatcatcgactccaccactggtggctttgaggcaggcatctccaaggacggccagacccgtgagcacgccctccttgccttcacgcttggtgtcaggcagatgatctgctgttgcaacaagatggacgccaccactcccaagtactccaaggctcggtacgacgagatcgtcaaggaagtggcgtcgtacctgaagaaggtggggtacaatccggacaagatccccttcgtgcccatttccgggttcgaaggtgacaacatgatcgagaggtcgacgaacctggactggtacaagggcccgaccctcctggaggcgctggaccagatcaacgagccgaagcggccgtcggacaagcccctccgccttcccctgcaggacgtgtacaagatcggcggcatcggcaccgtcccggtgggccgcgtggagacgggcgtcctgaagcccggcatggtggtcaccttcgcgcccaccggcctgacgacggaggtgaagtcggtggagatgcaccacgagtcgatgcaggaggcgctgccgggcgacaacgtcgggttcaacgtgaagaacgtggcggtcaaggacctgaagcgcggctacgtggcgtccaactccaaggacgaccccgccaaggaggccgccagcttcacggcgcaggtgatcatcatgaaccacccggggcagatcggcaatggctacgccccggtgctggactgccacacgtcccacatcgccgtcaagttctcggagctgctgaccaagatcgacaggcgctccggcaaggagctcgagagcgcccccaagttcctcaagaacggcgacgctgggttcgtcaagatgatccccaccaagcccatggtggtggagacgttctcagagtacccgccgctggggcggttcgctgtgcgggacatgaggcagacggtggctgtcggcgtgatcaagagcgtggagaagaaggacccaacgggagcaaaggtcaccaaggctgcggctaagaagaaataaaaatatataggtcgatccgtgccgtggatgttattataacatcccataagctagctagtggagtattttggctagaaagtttgcattactgttattatatcgtcggggttgtttatttgggtctcgcagtgcttagtatgtgtcggtgtcagtttccagaatcaatatatatgctatgtttttcgctgaaatcgtgaatgttttttgcttaagaatctagtctgcatggtctgaaggctcgactctgtttttttccaaatgcagatgggctgcctggattgtgccctgtgtcctgtccagcatacatctttttttattttttgaggttctgtccagcatacaacttagtactaactgtgtcctgttgtgaaaattagggtgcagagtgacaacatatgctcaacactttacacgcacacacacatgtagactgccatttaaattcagtgtgacagttgggcttgcttttgtgaatatatataactaactatgtgagtatttcttaccattgaccactttccagggtacctatttctcatgcatacctaattctaaatacactgcgacccttatgaactccaaaatcatgttgc

SEQ ID NO: 690 - DNA, 1678 bp, Aquilegia formosa
catctctttgccaaagcagcagcagcaaaagagagaaagaaagaaagaaagaaagaaagatcttcgcttcgttcttcatctttgtgattgtattgaaaagatactatggggaaagagaagtttcacatcaatattgtggttattggtcatgtcgattctggaaaatcaacaacaactggacatttgatctataagcttggaggtattgacaagcgtgtgatagaacgctttgaaaaggaggctgctgaaatgaacaagcgttccttcaagtacgcctgggtgcttgacaaacttaaggctgagcgtgaacgtggtatcactattgacattgccttgtggaagtttgaaacaactaagtactactgcactgtcattgatgctcctggtcatcgtgatttcatcaagaacatgattactggaacttctcaagctgattgtgctgttttgatcattgactcaactactggtggttttgaagctggaatttcaaaagatgggcagacacgtgagcatgcattgcttgcattcacactgggagtgaagcagatgatctgctgctgtaacaagatggatgccactacaccaaagtactcaaagggtaggtacgatgaaattgtgaaggaggtgtcttcctatttgaagaaagttggctacaatcctgacaagatcccctttgtcccaatttctggttttgagggtgacaatatgattgaaagatctaccaaccttgattggtataagggcccaactctcctcgaggctctggatcaagttaacgagcccaagcgtccctctgacaagcctctgcgtcttcccttgcaagatgtttacaaaattggtggtattggaactgtgcctgttggtcgtgttgagactggtgttatcaaacctggcatccttgttacttttggtccatctggtcttacaactgaagttaagtctgtggagatgcatcatgaggctcttcaagaggctctacctggtgacaatgttggctttaacgtaaagaatgttgctgttaaggatctgaagcgtggctatgttgcttctaattcaaaggatgaccctgctaaggaagctgctaacttcacctcacaagttatcatcatgaatcacccagggcagattggtaatggatatgcacctgtccttgactgtcacacatctcacattgcagtcaagtttgcagagatccagaccaagattgataggcgttctggaaaggagcttgagaaggagcccaagtttttgaagaatggtgatgcaggatatgtgaagatgattcctaccaagccaatggtggtggagaccttttcagagtatccaccacttggtcgttttgctgttcgtgatatgaggcagacagttgctgttggtgtgatcaaagctgtggagaagaaggagcccactggagccaaggtgaccaaggctgctgcaaagaagaagtgaaccgaaagtgattgtgcttctgtagctggaaaatgcagtaatgtcttttgttttcatcttatcgagtctgtaggtgcagtgtcgagtatctggatggagaactgggttcttgacagacggtggcatcggttttttatgcttttttgaatgtttgtttcgaaatttttgtttttcaggaatcttttcttaaagatctaagctgagtttcagacaataagtttgttttttc

SEQ ID NO: 691 - DNA, 1885 bp, Musa acuminata
atgcttcgcggcatcggagccaccgtcatatgtctccaatgccaacagcctaaagttaaggggtatcgacttgtcctggacttcctatatcaaagatcgtacggtcgagcagaaaaccctaggtcacatcttaccctcgtggatctctatataagcagctcgagggcctctccgtctccacgactcggcgctgcctctctcgttcgcctctccctctcgtgcgatcctctctcggttgcagactttgtcggagtagtcgtgtttgttttgagtcctaatcaccatggggaaagagaaggttcacatcagcattgtggtcattggccatgttgactccggcaagtcgaccaccaccggtcatctcatctacaagctgggtggtattgacaagcgtgtgatcgagaggtttgaaaaggaggctgcagaaatgaacaagaggtcattcaagtatgcctgggttctggacaagcttaaggccgagcgtgagagagggattaccattgatattgctctttggaagtttgagaccaccaagtactactgcactgtgattgacgctcccggacatcgtgattttatcaagaacatgatcactggaacctcccaggctgactgtgctgttctcatcattgattcgaccactggtggtttcgaagctggtatctctaaggatggccagactcgtgagcatgctctgcttgcttttactcttggagtcaaacagatgatttgctgctgcaacaagatggacgcaaccacccccaagtattccaaggccaggtatgatgaaatcgtgaaggaggtttcttcttacctcaagaaggtcggatataaccctgagaagatacctttcgttcctatctctggattcgagggtgacaacatgattgagaggtctaccaacctggactggtacaagggcccaactcttcttgaagccctcgacctgatccaggagcccaagaggccctcagacaagccccttcgtcttcctcttcaggatgtctacaaaattggaggcattggtactgttccagtcggccgtgtcgagactggtgtcctcaagcctggtatagttgtcacatttggtcccacaggtctgaccactgaagtcaagtcggttgagatgcaccacgaagcccttcaggaagccttgcctggcgacaatgttggctttaacgtgaagaatgttgctgttaaggatttgaagagaggtttcgttgcatctaactcaaaggacgatcctgctaaggaagctgccagcttcacgtcccaggtcatcatcatgaaccaccctggtcagattggaaatggttacgcccctgttctcgactgccacacttcccacattgctgtcaagtttgctgagatcctcaccaagatcgataggcgatccggaaaggagctcgagaaggagcctaagttcctcaagaatggtgatgctggctttgtgaagatgattcctactaagcccatggtcgtggaaacattcgcccagtatcctcctcttgggcggtttgccgtgagggacatgcgccagactgtggctgtcggagtcatcaagagtgtcgagaaaaaggatcccaccggtgctaagatcaccaaggctgcagtcaagaagaagtgagcaagttaaggatcaactgcaacttagtagtgtttgtttctttgttactgttctttgtctgcccgacagtttgatcggcacctgcaacttagctgcctgggagattttagttcttcttctccttggttatgaacctttcgcagagttaaattatttgctttagacttgtttattctcagtgcatgacgagtttgactttacattgaccttcgggttagaattgccattataattatttttacatatgcgattattaat

SEQ ID NO: 692 - DNA, 1604 bp, Fagus grandifolia
caaagccttcacaaccccagtctcctctctttctatcgtatagctatctcttgctatacttttcattgcggctagggtttcagcagaagctctcgttcaagttttttaagagttcataatgggtaaggaaaaggttcacattaacattgtggtcattggccatgtcgactctggaaagtcgaccaccactggacacttgatctacaagcttggaggaattgacaagcgtgtgatcgagaggttcgagaaggaggcagctgagatgaacaagaggtcattcaagtatgcctgggtgttggacaagcttaaggcagagcgtgagcgtggtattaccattgacattgccttgtggaaatttgagaccaccaggtactactgcactgtcattgatgctcccggacatcgtgactttattaagaacatgattactggaacgtcacaggctgactgtgccgtcctgattattgactccaccactggaggttttgaggctggtatttctaaggatggtcagacccgtgagcatgctttgcttgctttcacccttggtgtcaagcagatgatttgctgttgtaacaagatggatgccacaaccccaaagtactccaaggctaggtacgatgaaattgttaaggaagtctcatcctatttgaagaaggttggatacaaccctgacaaaatccctttgtccccatttctggttttgagggtgacaatatgattgagaggtctaccaacctcgactggtacaagggtcccaccctccttgatgctcttgaccagatctcagagcccaagagaccctcggacaagccccttcgtcttcctcttcaggatgtgtacaagatcggtggtattggaactgtgcctgttggacgtgttgagactggtgtcgtcaagcccggaatggttgtgacatttggccccactgggttgacaactgaagttaagtctgtggagatgcaccacgaagctctcctggaggcccttcccggtgacaatgttggcttcaacgtcaagaatgttgccgtgaaggatctcaagcgtggttttgttgcttccaactccaaggatgatcctgccagggaagctgccaacttcacctcccaggtcatcatcatgaaccaccctggtcagattggaaatggctatgctccagtccttgattgccatacctcccacattgctgttaagttcagtgagatcttgaccaagattgacaggcgatctggaaaggagcttgagaaggagcccaaatttttgaagaacggtgatgctggtatggttaagatgattcccaccaagcccatggttgttgagactttctctgagtatccacctcttggtcgttttgctgtgagggacatgcgtcagaccgttgctgttggtgtcatcaagagtgttgagaagaaggatccctctggtgccaaggtcaccaagtctgcagcaaagaagaagtgaaccgtgatggatcaacctcgtatttctgctacttactatcgttttgataatggttttgataaaaacttggttatgtttggtactgctttagttttcgtttgtctttcttttgtgtgttatagttttataccgtcgttgttggg

SEQ ID NO: 693 - DNA, 1690 bp, Beta vulgaris
gattttggtaaattcgtactatctgagatgggatcttagaaggataataaagtaaaaaaaaaagcatctatagcatttctctctcttataaaaccctaaatcttactctctttgcttctttcattcactttcttcctcctctcactgcggctagggttttggcgaagcttattctatctgcttcacaaatttaatcatgggaaaggaaaagattcatatcagtttggtcgtcattggccatgtcgattccggaaagtcgaccactactggtcacttgatctacaagcttggtggtattgacaagcgtgtgatcgagagatttgaaaaggaagctgctgagatgaacaagaggtccttcaagtacgcctgggtgctcgacaaacttaaagcagagcgtgagcgtggtattactattgatattgctttgtggaagtttgagaccaacaagtactactgcacagtcattgatgcccccggacatcgtgactttatcaagaacatgattactggtacctcccaggctgattgtgctatcctcattattgactccaccactggtggttttgaggctggtatctccaaggatggtcagacccgtgagcacgcacttcttgcctttactcttggtgtcaagcaaatgatttgctgctgtaacaagatggatgccaccacccccaagtactcaaaggctaggtacgaggaaatcgtgaaggaagtctcttcatacctgaagaaggttggttacaacccagacaaaatcccattcgttcccatttctgggtttgagggtgataacatgattgagaggtccaccaaccttgactggtacaagggaccaactcttcttgaggcccttgacttgatcaatgagccaaagaggccctcagacaagccccttcgtctcccactccaggatgtgtacaagattggaggtattggaacagtgcccgttggacgtgttgagaccggtgtcttgaagcctggtatgcttgttacttttggtcctactggattgaccactgaagttaagtcagtggagatgcaccacgaatctcttccagaagctctccctggtgacaatgttggcttcaacgtcaagaatgttgccgtcaaggatctcaagcgtggtttcgttgcttctgactccaagaatgaccctgccaaggaggcagccaatttcactgctcaggtgatcatcatgaaccaccctggacagattggaaatggttacgccccagtgctcgattgccacacctcccacattgctgtcaagtttgctgagcttgtgaccaagattgacagacgttcaggtaaggagattgagaaggagcccaagttcttgaagaatggtgatgctggtatggttaagatgattcccaccaagcctatggtggtggagactttctcagagtacccaccccttggtcgtttcgctgtcagagacatgaggcagactgtcgctgttggtgtcatcaagaacgtcgagaagaaggatccaaccggtgccaaagttaccaaggctgccctcaagaagaaatgagttgtttcaatcgtctaaattgaatgttctgttattgtggttaggtttatgtgagtcatggtttaggcttttagaacgaagatttatgagtactgttttgtatctttaatctttctgagttcttattttgtgagcagctcgggatttatt

SEQ ID NO: 694 - DNA, 1807 bp, Beta vulgaris
ctctcccccatctttctctttaacaactgcggctagggttctttcagatttgattttaagatatcaatatgggtaaggaaaagattcatatcagtttggtggtcattggccatgtcgactctggaaagtcgaccaccactggtcatttgatctacaagcttggaggtattgacaagcgtgtgatcgagagatttgagaaggaagctgctgagatgaacaagaggtccttcaagtatgcttgggtgcttgacaaacttaaggcagagcgtgagcgtggtattaccattgatattgccttgtggaagtttgagactaacaagtactactgcacagtcattgatgccccaggacatcgtgactttatcaagaacatgattactggaacctcccaggctgattgtgctatcctcattattgactccaccactggaggttttgaggctggtatctccaaggatggtcagacccgtgagcacgcacttcttgcctttactcttggtgtcaagcaaatgatttgctgctgtaacaagatggatgccaccacccccaagtactcaaaggctaggtacgaggaaatcgtgaaggaagtctcttcatacctgaagaaggttggttacaacccagacaaaatcccattcgttcccatttctgggtttgagggtgataacatgattgagaggtccaccaaccttgactggtacaagggaccaactcttcttgaggcccttgacttgatcaatgagccaaagaggccctcagacaagccccttcgtctcccactccaggatgtgtacaagattggaggtattggaacggtgcccgttggacgtgttgagaccggtgtcttgaagcctggtatgcttgttacttttggtcctactggactgaccactgaagttaagtcagtggagatgcaccacgagtctcttccagaggctctgcctggtgacaatgttggcttcaacgtcaagaatgttgctgtcaaggatctcaagcgtggttttgttgcttctgactccaagaacgaccctgccaaggaggcagccaatttcactgctcaggtgatcatcatgaaccaccctggacagattggaaatggttacgccccagtgctcgattgccacacctcccacattgctgtcaagtttgctgagctcgtgaccaagattgacagacgttcaggtaaggagattgagaaggagcccaagttcttgaagaatggtgatgctggtatggttaagatgattccgaccaagcccatggtggtggagactttctcagagtacccaccccttggtcgttttgctgtcagagacatgaggcagactgtcgctgttggtgtcatcaagaacgtcgagaagaaggatccaaccggtgccaaggttaccaaggctgccctcaagaagaaataaggtttatttgcatctatcactgctttggagcattggtattatgaaggctcggtagcaacattttggaacaatctgattttcagcggttttagttgggtctttgtgttatgtttagtgtatggtcttagttttggttataggttagtgtcttctctgatattcagctctagttctcagaattggatgctggatagacggtggcatggccctgtttcttgtttccttgtatgaatttctgaacacttctccctatgcagttcaggagttttatctttgtttttcctgggctggctgttgtgtaaaacggtcgtaattacacaagtcttgaattgctgaggcctaaactgcttgttttacattattattagcataatgactggttcctaaatcctgca

SEQ ID NO: 695 - DNA, 2975 bp, Ricinus communis
ctaaagcaacactgccatcgtcgaacaatctcacctcaaaaacagtataaagactatatttaatatcttaattcctcctctttcagatttcaggtgattgaccagtcagatgatgaactcttaaaagtctctttgaacgtgacaaggatgacgattcattcaagaaaaatttgaagaacaaaagatgttacaaggaagcttttattttctgtaacagaattaaagatcacttgggcgatcatgacaagtattggtaattcctgaagtgtttgtatttgtacagctagagagtgatgacagatatgaacttgaaaaacaaggttgctgatttgatcggaaacgatttcaaatttttacaagatttgaatgaacttttgattcaatgcgacgtcgacttcaccaaaacctagcagtctgtattttctttcatgatatttgtttttatttagatatatatttttcaaattttttttagaatttactcagctggcgaatgtgcttatttattgttcaatcaaacgaaaaataatgtcatgaatatcatactccgatctgttaatttcaaatttaaactattatctttccctacatgtatatgtataaactacagtatgatacaaattaattatgtaaagaaccttcagcagctctcatttaaggcatctgtctacccttttttttctttggcaactacaatgattgttatcaacaatctacatttaaaaagaaattgcagacatcagaggctgtctctttgatcgtagtaatgggtttgcagtgctcgtagctgtcgtatattattgaaaatgttgaagaagattaggggttttaatattgaaccaagggaaggacagattccatggtttgacttttacaaggttccttcactgttgcgtctgggcaagttcgtcgttatgtttttttgttgagggtattaatgtaaataaacttacagtgcctgctcagaaaaccctagcctgtgtttttcactataaaagtgatcgtttatccttcatttgcttacaatttgcccttgtttttgctgcgtttcgctcagcagggcttttgttagagtttttctacttcaatctcttcagttttaggcatctataatgggtaaggagaaggttcacatcaacattgtggtcattggccatgtcgactctggaaagtcaactactactggccatctcatctataagttgggaggtattgacaagcgtgtcattgagagattcgagaaggaagctgctgagatgaacaagaggtcattcaagtatgcttgggtgcttgacaagcttaaggccgagcgtgagcgtggtatcaccattgatattgccttgtggaagtttgagacaccaagtactactgcaccgtcattgatgcacctggacatcgtgactttatcaagaatatgattaccggtacttcacaggctgactgtgctgttctgattattgattccaccactggtggttttgaagctggtatttccaaggatggtcagacccgtgagcatgctctccttgctttcaccctcggtgtcaagcaaatgatttgctgttgcaacaagatggatgctactactcccaagtactccaaggccaggtatgatgaaattgtcaaggaggtttcctcttacctgaagaaggtcggatacaaccccgataaaattcctttcgttcccatctctggcttcgaaggtgacaacatgatcgagaggtccaccaaccttgactggtacaagggaccaaccctacttgaagctcttgaccagatcaatgagccaaagaggcccacagacaagcctcttcgtctcccacttcaagacgtttacaagattggtggtattggaacagttccagtgggtcgggtggagactggtgtcctcaagcctggtatggttgtgacctttggacccagtggactgacaactgaagttaagtcggttgaaatgcatcacgaggctctccaggaggccctccctggtgacaatgttggtttcaatgttaagaatgttgctgtcaaggatcttaagagaggttttgttgcttcaaactccaaggacgatccagcaaaggaggcagccaacttcacatcccaagtcatcatcatgaaccatcctggtcagattggaaatggatatgctccagtgttggactgtcacacctcccacattgctgtgaagtttgctgagatcctaaccaagattgatcgtcgatccggtaaggagcttgagaaggagcccaaattcttgaagaatggtgatgctggtttcgtgaagatgattccaaccaagcccatggttgttgagaccttctccgagtaccctccattgggtcggtttgctgttagggacatgcgccaaactgttgcagtgggtgttatcaagagtgttgagaagaaggacccaagcggagctaaggtcaccaagtctgctgccaagaagggaggaaaatgagagttaaattattagctgttggaaggtttttttttaatgtacattgtctagttgctacgcccacatatttgccttgtataggcagtggatgcgtagtatgtttgaaggcaccattttgttttggatgtttgaaggcaccattttgttttggatgtttgaaggcattcttctagtgaggtttgtgtatggttgagaattttgagaatttacttacttatgccgactgataatgggagaacaaagtctactgttttctttcagggtatgttaatattctgatgctgtgtcgagtagctcttgtgatttggtacatgtggttctacggagaggatgaaattggccaatgagcttacaaacagcaaatcctccagagaatcgttaccaattctgacagagtccctgatgcaatttccactgtttattttgctgctagccatggtataaatctcagtatgctgcttttgttagaaaattggaagtacttgctgattttgctgcaagtcctcgttgccat

SEQ ID NO: 696 - DNA, 1661 bp, Centaurea maculosa
caacctctaatcgcagaaagcaaagctcggtttaatcatgggtaaggaaaaggttcacatcaacatcgttgtcatcggtcatgtcgactctggaaagtcgaccaccaccggtcacttgatctacaagcttggaggtatcgacaagcgtgtgatcgagcgtttcgagaaggaagctgctgagatgaacaaacgttccttcaagtatgcctgggtgctagacaagctgaaggccgagcgtgaacgtggtatcaccatcgacattgccttgtggaagttcgagaccaacaagtactactgcactgtcatcgatgctcctggacatcgtgatttcatcaagaatatgatcaccggtacctcccaggctgactgtgctgtcctcattatagactccaccactggtggtttcgaagctgggatctccaaagacggtcaaacccgtgagcatgctttgcttgccttcacccttggtgtcaggcaaatgatctgttgctgtaacaagatggatgctactactcccaagtactccaaggctaggtatgatgaaattatcaaggaagtggcatcctacctcaagaaagttggatacaatccagacaaaatcccattcgttcccatctctggttttgagggagataacatgattgagaggtcaaccaatcttgactggtacaagggtccaactcttctcgaagctcttgaccagcttaatgaaccaaagaggccatcggacaagcctcttcgtctcccactccaggatgtctacaagatcggtggaattggaactgtgcccgttgggcgtgttgaaacgggtgtcatcaagcccggtatggtcgttactttcggcccaactggtttgaccactgaagttaagtcggttgaaatgcatcacgaggcactcctagaggccttgcccggtgacaacgttggtttcaacgttaagaacgttgctgtgaaggatcttaagcgtggctacgttgcttccaactccaaggatgatccagcaaagggagcggccagcttcactgctcaggtcattatcatgaaccaccctggtcagatcggaaacggatatgcacctgttctcgactgccacacttctcacattgctgttaagtttgccgagctgttgaccaagattgacaggaggtctggtaaggagctcgagaaggagccgaagtttctgaagaatggtgatgctggtatggtgaagatgattccgaccaagcccatggtggtggagacctttgctgagtatcctcctctgggacgttttgcggtgagggatatgcgtcagaccgttgctgtcggtgtgatcaagagcgtcgataagaaggacccaaccggcgccaagatcaccaaggctgcgataaagaagaagtgaaccggcccttttatgaatctgaaacttggaatgaactctattatggttttgttttgtgtgtttaatttctgttttggtgtgttttgtggtgtctgctgccatcttttggagccatttctcggaatggtggtgctgttgcgctttcgggatcatacctgggtgctcgacagacggtggcaggatttatggttgttgatttgagtctttgcttattatcaacttttatgaaacattatataagattcttgaatttacattcaaggtcttcatttatatatga

SEQ ID NO: 697 - DNA, 1715 bp, Centaurea maculosa
gcgctctgattttgctcttcttccccttttcatcaacctctaatcgcaaaaagcaaagctcggtttcatcatgggtaaggaaaaggttcacatcaacattgttgtcatcggtcatgtcgactctggaaagtcgaccaccaccgggcacttgatctacaagcttggtggtatcgacaagcgtgtgattgagcgttttgagaaggaagctgctgagatgaacaaacgttccttcaagtatgcctgggtgctggacaagcttaaggccgagcgtgaacgtggtatcaccatcgacattgccttgtggaagttcgagaccaacaagtactactgcactgtcatcgatgctcctggacatcgtgatttcatcaagaatatgatcactggtacctctcaggctgactgtgctgtcctcattattgactccaccactggtggtttcgaagccgggatctccaaggatggtcaaactcgtgagcatgctttgcttgccttcacccttggtgtcaggcaaatgatctgttgttgtaacaagatggatgctactacacccaagtactccaaggccaggtatgatgaaattatcaaggaagtggcatcctacctcaagaaagttggatacaaccctgacaaaatcccatttgtcccaatctctggttttgagggagataacatgattgagaggtctaccaatcttgactggtacaagggtccaactcttctcgaagcgcttgaccagcttaacgaaccaaagaggccgtcagacaagcctcttcgtctgccactccaggatgtctacaagattggtggaattggaactgtgcctgttggccgtgttgaaactggggttatcaagcctggtatggtcgttacttttgggccaactggtttgaccactgaagttaagtctgttgaaatgcatcacgaggccctcctcgaggcattgcccggtgacaacgttggtttcaatgttaagaatgttgctgtgaaggatcttaagcgtggttatgttgcttcgaactccaaggatgatcctgcaaagggagctgccagtttcactgctcaggtcattatcatgaaccaccctggtcaaatcggaaacggatatgcacctgttctcgattgccacacttctcacattgctgttaagtttgctgagctgttgaccaagattgacaggaggtcgggtaaggagctcgagaaggagccaaagtttttgaagaatggtgatgctggtatggtgaagatgattccaactaagcccatggtggtggagacatttgctgagtatcctcctctgggacgtttcgctgtgagggacatgcgtcagaccgttgctgttggtgtgatcaagagcgtcgataagaaggacccaaccggcgccaagatcaccaaggctgcaataaagaagaagtgaaccggcccttttatgattctgaaacttggagtgaactttattatggtttcgttatgtgtgtttaatttctgttttggtgtgttttgtgatgtttgctgccatcttttacggccatttctcggagtggtggtgctgttgcgctttcgggatcatacctgggtgctcgacagacggtggcaggagttatggtcgttgatttgagtctttgcttattatcaacatttatgaaacattatataagattcttgaatttacattcaaggtcttgatttatatatgatttggttttgttaaaaagaaa

SEQ ID NO: 698 - DNA, 1692 bp, Chelidonium majus
agagagagaggcgatctcgattcatccatccgtttcggaagtagtactctaaaaatttaacatgggaaaagagaaggttcatatcaacattgtcgtcattggacatgtcgactccggaaagtcgaccaccactggtcacttgatttacaagcttggaggtattgacaagcgtgttatcgagagattcgagaaggaagctgctgagatgaacaagaggtctttcaagtacgcctgggttcttgacaagcttaaggctgaacgtgagcgtggtatcaccatcgatattgctctatggaagtttgagaccactaggtactactgcacagtcattgatgctcctggacatcgtgactttatcaagaacatgattactggtacctctcaggctgactgtgctgtccttattattgattccaccactggtggttttgaagccggtatctctaaggatggacagactcgtgagcatgctcttcttgcttttacccttggtgtcaagcagatgatctgttgttgtaacaagatggatgccaccacccccaagtactccaaggctaggtacgatgaaattgttaaggaagtctcatcttacctgaagaaggttgggtacaacccagacaaaattgcctttgtccccatctctggttttgagggagacaacatgattgagaggtctaccaaccttgactggtacaagggtccaaccctccttgaggcccttgaccagatcaatgagcccaagagacccacagacaagcccctccgtcttccacttcaggatgtttacaagattggtggtattggaactgtgccagtgggacgtgttgaaactggtttgatcaagcctggtatggttgtcacttttggccctactggtttgaccactgaagttaagtctgtggagatgcaccacgaggctctcctggaagctcttcctggtgacaatgttgggttcaacgtcaagaatgttgctgtgaaggatctcaagcgtgggttcgttgcttccaactccaaggatgaccctgccagggaagctgccaacttcacctcccaggtcatcatcatgaaccaccctggtcagatcggtaacggttatgccccagtccttgactgccacacatcccacattgctgttaagttcggcgagatcctcacaaagattgacaggcgatctggaaaggagcttgagaaggagcccaagtttttgaagaatggagatgctggtattattaagatgcttcccaccaagcctatggttgtggagaccttcgctgaatacccaccacttggacgttttgctgtgagggatatgagacagactgttgctgtgggtgttatcaagagtgttgagaagaaggacccatctggtgctaaggttaccaagtctgctgccaagaagaaatagacgatattcagcagcaggtaagagtagcctcatcagcagcagggttatcttttgccattcatctatatgttctcaattttgttttggtaatgattttgtgactggtatcggtttatttctgctgttttttaagagtctgcttttaggatggttttaaggtttgatggtggtgtgtagtttggtaaactgccttgtgcaatctcggttgctatagatggattctccataactacatttttattttgttattgaacttcatttgaaatttcagtttaatagatctgagt

SEQ ID NO: 699 - DNA, 1765 bp, Chelidonium majus
ccgcctcaactttctttcgtctagggtttcggtgatctgtactttcgctccttcagcattacaagttatttgcttaaaggaattcaacaatgggaaaagagaaggttcacatcaacattgtcgttattggacatgtcgactctgggaagtcgaccaccacgggtcacttgatttacaagcttggaggtattgacaagcgtgtgattgagagattcgagaaggaagctgctgagatgaacaagaggtcattcaagtatgcctgggtgcttgacaagctgaaggctgagcgtgagcgtggtatcaccattgacattgctctatggaagtttgagaccaccaagtactactgcaccgtcattgatgcccctggacatcgtgactttatcaagaacatgattactggtacttcacaggctgactgtgccgtccttattatcgattccaccactggtggttttgaagctggtatctccaaggatggacagacccgtgagcacgctcttcttgctttcacccttggtgtcaagcagatgatctgttgttgtaacaagatggatgccaccacccccaagtactccaaggctaggtacgatgaaattgtgaaggaagtctcatcctacttgaagaaggttgggtacaatccagacaaaattgcttttgtccccatctctggttttgagggtgacaacatgattgagaggtccaccaaccttgactggtacaagggtccaaccctccttgaggcccttgaccagatcaatgagcccaagagaccctcagacaagccactccgtcttccacttcaggatgtttacaagattggtggtattggaactgtgccagtgggacgtgttgaaactggtttgatcaagcctggtatggttgtgacttttggccctactggtttgaccactgaagttaagtccgtggagatgcaccacgaggctctccaggaagctcttccaggtgacaatgttgggttcaacgtcaagaatgtggctgtgaaggatctcaagcgtgggtttgttgcgtccaactccaaggatgaccctgccagggaagctgccaacttcacctctcaagtcatcatcatgaaccacccaggacagatcggtaatggttatgccccagtgctcgactgccacacttcccacattgctgtgaagtttggtgagatcctcaccaagattgacaggcgatctggaaaggagcttgagaaggagcccaagttcttgaagaatggagatgctggtatggttaagatgcttccaaccaagcccatggttgtagagaccttctctgagtatcctcctcttggacgttttgctgtgagggacatgaggcagactgtcgctgttggagtcatcaagagcgttgagaagaaggacccatctggtgctaaggtcaccaagagtgcagccaagaagaagtgaaccgtgtggtcacatagtgcgttcgatgtctctgaatttccttatcataaatactgggtactagttagtggtgttatcaaatgtttagtgtttgtttgttgtggttttagttctctgccattgctttcgtcttgcagactttctcagaactgggtgctagaccgacggtggcagtgctattgaccatttgctttccttttaattttgagtcttgagtgtctatgaaatacttcgaatatttctaccctgcctcagtagttttcatattttgtgatactgagttgcaggtctgatgcagtttcatttctgttttcagttaatctagtatgtcg

SEQ ID NO: 700 - DNA, 1873 bp, Chelidonium majus
gccttcattttttttcattctcttttgtttgcgatactctcttctactcggcgagagcttttagcgagagattttccattctcatctgctgctaaaagctttttgctagtataactcttcaatctcaacatgggtaaagagaaggttcacatcaacatcgttgttattggacatgtcgactctgggaagtcgaccaccactggtcacttgatttacaagcttggaggtattgacaagcgtgtgattgagagattcgagaaggaagctgctgagatgaacaagaggtcattcaagtacgcctgggtgcttgacaagctgaaggctgagcgtgagcgtggtatcaccattgacattgctctatggaagtttgagaccaccaagtactactgcaccgtcattgatgcccctggacatcgtgactttatcaagaacatgattactggtacttctcaggctgactgtgctgtccttattatcgattccaccactggtggttttgaagctggtatctctaaggatggacagacccgtgagcatgctcttcttgctttcacccttggtgtgaagcagatgatctgttgttgtaacaagatggatgctaccacccccaagtactccaaagctaggtacgatgaaatcgttaaggaagtctcatcctacctgaagaaggttgggtacaatccagacaaaattgcctttgtccccatctctggttttgagggagacaacatgattgagaggtctaccaaccttgactggtacaagggaccaaccctccttgaggcccttgaccagatcaatgagcctaagaggccctcagacaagcccctccgtctcccacttcaggatgtttacaagattggtggtattggaactgtgccagtgggacgtgttgaaactggtttgatcaagcctggtatggttgtgacttttggccctactggtttgaccactgaagttaagtctgtggagatgcaccacgaggctctccaggaagctcttccaggtgacaatgttgggttcaatgtcaagaatgttgctgtgaaggatctcaagcgtgggtttgttgcgtccaactccaaggatgaccctgccagggaagccgctaacttcacctcccaggtcatcatcatgaaccaccctggtcagatcggtaacggttatgctccagtgcttgattgccacacttctcacatcgctgtgaagtttggtgagatcctcaccaagattgacaggcgatctggaaaggagcttgagaaggagcctaagtttttgaagaatggtgatgctggtatggttaagatgcttccaaccaagcctatggtggtggagaccttctctgagtaccctcctcttggacgttttgctgtcagagacatgaggcagactgttgctgttggagttatcaagagtgttgagaagaaggatccatctggagccaaggtcaccaagtctgctgcgaaaaagaagtgaaccgagcaatgtcatcgcctagttcctgtgtctgaattttattacaattactatcataaagactggttgcttgttagtcgtattatgaactctttaggttttgtttgttgtggttatagttctttgccatcatcttcgttaggcagccgttctcagaactgggtgcttgacaggcggtggcggtgctatctaccatcagtgtctgccttttaaattctttgctttggttttagtagttgatgaagtgagtgtctaaacagtattttgttagcctgcttcagtaggtgttatgacttgttctgctcattagcaggttggttgcttttttataatatggtgtcttgttttagtatattttcattgttctcagtttaatctttgatggtcattacagtataat

SEQ ID NO: 701 - DNA, 1427 bp, Cirsium arvense
acggtttcatcatgggtaaggaaaaggttcacatcaacatcgttgtcatcggtcatgtcgactctggaaagtcgaccaccaccgggcacttgatctacaagctcggaggtatcgacaagcgtgtgattgagcgttttgagaaggaagctgctgagatgaacaaacgttccttcaagtacgcctgggtgcttgacaagcttaaggccgaacgtgaacgtggtatcaccatcgacattgccttgtggaagttcgagaccaacaagtactactgcactgtcatcgatgctcctggacatcgtgatttcatcaagaatatgatcaccggtacctctcaggccgactgtgctgtcctcattatcgactccaccactggtggtttcgaagctgggatctccaaggacggtcagactcgtgagcatgctttacttgccttcaccctcggtgtcaggcaaatgatttgttgctgtaacaagatggatgctactacacccaagtactccaaggctaggtatgatgaaatcatcaaggaagtggcatcctacctcaagaaagttggatacaaccctgacaaaatcccatttgtcccaatctctggttttgagggagataacatgattgagaggtctaccaatcttgactggtacaagggtccaactcttctcgaagcgcttgaccagcttaacgaaccaaagaggccatcagacaagcctcttcgtttgccacttcaggatgtctacaagattggtggaattggaactgtgcccgttggccgtgttgaaactggggttatcaagcccggtatggtcgttacttttggcccaaccggtttgacaactgaagttaagtcggttgaaatgcatcacgaggcactcctcgaggcattgcccggtgacaacgttggtttcaacgttaagaatgttgctgtgaaggatcttaagcgtggttatgttgcttccaactccaaggatgatccagcaaagggagctgccagcttcactgctcaggtcattatcatgaaccaccctggtcaaatcggaaacggatatgcacctgttctcgattgccacacttctcacattgctgttaagtttgctgagctgttgaccaagattgacaggaggtcgggtaaggagctcgagaaggagccaaagtttttgaagaatggtgatgctggtatggtgaagatgattccaactaagcccatggtggtggagacatttgctgagtatcctcctctgggacgtttcgctgtgagggacatgcgtcaaaccgttgctgttggtgtgatcaagagcgtcgataagaaggacccaaccggcgccaagatcaccaaggctgcaataaagaagaagtgaaccggcccttttatgattctgaaacttggagtgaactttattatggtttcgttatgtgtgtttaatttttcg

SEQ ID NO: 702 - DNA, 1423 bp, Cirsium arvense
catcatcaacctctaatcgcaaaaagcaaagctcggtttcatcatgggtaaggaaaaggttcacatcaacatcgttgtcattggtcatgtcgactctggaaagtcgaccaccaccgggcacttgatctacaagcttgggggtatcgacaagcgtgtgattgagcgttttgagaaggaagctgctgagatgaacaaacgttccttcaagtatgcctgggtgctggacaagcttaaggccgagcgtgaacgtggtatcaccatcgacattgccttgtggaagttcgagaccaacaagtactactgcactgtcatcgatgctcctggacatcgtgatttcatcaagaatatgatcactggtacctctcaggctgactgtgctgtcctcattattgactccaccactggtggtttcgaagccgggatctccaaggacggtcaaactcgtgagcatgctttgcttgccttcacccttggtgtcaggcaaatgatttgttgctgtaacaagatggatgctactacacctaagtactccaaggctaggtatgatgaaattatcaaggaagtggcatcctacctcaagaaagttggatacaaccctgacaaaatcccatttgttcccatctctggttttgagggagataacatgattgagaggtcaaccaatcttgactggtacaagggtccaactcttctagaagcacttgaccagcttaatgaacccaagaggccatcagacaagcctcttcgtctgccacttcaggatgtctacaagatcggtggaattggaactgtgcccgttggccgtgttgaaactggggttatcaaacccggtatggtcgttacttttggcccaactggtttgaccactgaagttaagtctgttgaaatgcatcacgaggccctcctcgaggcattgcccggtgacaatgttggtttcaatgttaagaatgttgctgtgaaggatcttaagcgtggttatgttgcttccaactccaaggatgatccagcaaagggagcggccagcttcactgctcaggtcattatcatgaaccaccctggtcaaatcggaaacggatatgcacctgttctcgattgccacacttctcacattgctgttaagtttgctgagctgttgaccaagattgacaggaggtcgggtaaggagctcgagaaggagccaaagtttttgaagaatggtgatgctggtatggtgaagatgattccaactaagcccatggtggtggagacatttgctgagtatcctcctcttggacgttttgctgtgagggacatgcgtcagaccgttgctgttggtgtgataaagagcgtcgataagaaggacccaaccggcgccaagatcaccaaggctgcaataaagaagaagtgaaccggcccttttatgaatctgaaacttggagtgaac

SEQ ID NO: 703 - DNA, 1719 bp, Cleome gynandra
ctctcgctccgctaaagctctttttctctccggcgccgcgagagagatctcttaggttttcgattatctttctctgtttcatcttaacaactcgccatgggtaaggaaaaggttcacatcaacattgtggtcattggtcacgtcgactccggaaagtcgaccacaaccggtcacttgatctacaagttgggaggaattgacaagcgtgtgatcgagaggttcgagaaggaggctgctgagatgaacaagaggtccttcaagtacgcctgggtgttggacaagctcaaggctgagcgtgagcgtggtatcaccattgacattgctctgtggaaattcgagaccaccaagtattactgcactgtcattgatgctcccggacatcgtgactttatcaagaacatgatcactggtacatctcaggctgactgtgctgtcctcatcattgactccaccaccggtggttttgaggctggtatctccaaggatggtcagacccgtgagcatgctttgctcgctttcacccttggtgtcaagcagatgatctgctgctgcaacaagatggatgccaccacccccaagtactccaaggccaggtacgatgaaatcgtgaaggaagtctcttcctacctgaagaaggtcggttacaaccctgacaagatccccttcgtccccatctctggtttcgagggtgacaacatgattgagaggtccaccaaccttgactggtacaagggtcccacccttctggaggctcttgaccagatcaatgagccaaagaggccctcagacaagcccctccgtctccctcttcaggatgtgtacaagatcggtggtattggaactgtcccggtgggtcgtgttgagactggtgtcctcaagcctggtatggtggtgacctttgctccctctggactgaccactgaggttaagtctgttgagatgcaccacgaggctctccaggaggctctccctggtgacaatgttgggttcaacgtcaagaacgttgctgtcaaggatctgaagcgtggttacgttgcatccaactcgaaggatgacccggctaaggaagctgccagcttcacctcccaggtcatcataatgaaccaccccggtcagatcggtaacggatatgccccggtgctggactgccacacctcccacatagctgtcaaatttgcagagctcttgacgaagattgacagacgttccggtaaggagctggagaaggagccaaagttcttgaagaacggtgatgcaggtatggtgaagatgattccgaccaagcccatggttgtggagaccttctccgagtacccgcctcttggacgttttgctgtcagggacatgaggcagacggtggctgtcggagtcatcaagaacgtggagaagaaggaccccaccggtgccaaggtgaccaaggctgcggccaagaagggtgccaagtgaatggatgaaggtagtatcgtatccgcagatgaaggaagtatttccgtttcaagagacttgttatttatcattattgctagtttttattatttagaattgtttttggggcttgtggtatatctgtggtacagctttgtctctccgtcttgccctaattgggttcttgatcggcgatggcgtaagctttctcacaccctctttttggcttttgttgttgtctgaattctgaaccttcttttattaattctgcgggcggctttttgttttaaaagt

SEQ ID NO: 704 - DNA, 1724 bp, Cleome gynandra
cgaaacaaagaaagtaacgacggggaccctagttttgcatccttctctccagccgctcaactcatcagatttttttcttgcttccgaagtttcattttaacaactagccatgggtaaggaaaaggttcacatcaacattgtggtcattggacatgtcgactcaggaaagtcgaccaccactggtcacttgatctacaagttgggaggtattgacaagcgtgtgattgagaggttcgagaaggaggctgctgagatgaacaagaggtccttcaagtatgcctgggtgttggacaagctcaaggctgagcgtgagcgtggtattaccattgacattgctctgtggaagttcgagaccaccaagtactactgcactgtcatcgatgctcctgggcatcgtgactttatcaagaacatgatcacgggtacctctcaggctgactgtgccgttctcatcattgactccaccactggtggttttgaggctggtatctccaaggacggtcagacccgtgagcacgccttgctcgctttcactcttggtgtcaagcagatgatctgctgctgtaacaagatggatgccaccacccccaagtactccaaggctaggtacgatgaaatcgtgaaggaagtttcttcctacttgaagaaggtcggttacaaccccgacaaaatcccattcgtccccatctccggttttgagggtgacaacatgattgagaggtccaccaaccttgactggtacaagggccccacccttctcgaggctcttgaccagattaacgagccgaagaggccctcagacaagcccctgcgtctcccccttcaagatgtctacaagatcggtggtattggaactgtcccagtcggtcgtgttgagaccggtgtcctcaagcccggtatggttgttacctttgctccctctggtctaaccactgaggttaagtccgttgagatgcaccacgaggctcttcaggaggccctccctggtgacaacgtcgggttcaacgtcaagaacgttgccgtgaaggatctcaagcgtggttacgttgcatccaactccaaggatgacccagccaaggaagctgccagcttcacctcgcaggtcatcatcatgaaccaccctggtcagatcggtaacggttacgccccagtcctcgactgccacacctcccacatcgccgtcaaatttgccgagctcttgaccaagatcgacagacgttccggtaaggagctcgagaaggagcctaagttcttgaagaacggagatgccggtatggttaagatgattccgaccaagcccatggtggtcgagaccttctccgagtaccctcctctcggacgttttgccgttagggacatgaggcagaccgttgccgtcggtgtgatcaagaacgtcgagaagaaggacccgaccggtgccaaggtcaccaaggccgcggccaagaagggtgctaagtaaaggttgctggttcacaaaactggacaatctatcatatccgcagatgaaggaagtgtactgaatatttcttgttttgaaaaagacattttattcgtcgtttgtagttttaattatttactttcaatgtttgtggttttcctgtggtacagctttgtctcaccgtacggactctgttctcgtaactgggttcttgatcggcgatggcttatgctttactcagtttagccacatggttttggttgtgttgagtatttttctttttaat

SEQ ID NO: 705 - DNA, 1770 bp, Cleome spinosa
tcggggtctcaggctcagctgcccaacttcgcagatttcctagctcttgtataagtcttgcagatttattttagaagctcgctatgggtaaggaaaaggttcacatcaacatagtggtcattggtcatgtcgactctggaaagtcgaccaccaccggtcacttgatctacaagttgggaggtattgacaagcgtgtgatcgagaggttcgagaaggaggctgctgagatgaacaagaggtcattcaagtatgcctgggtgttggacaagctcaaggctgagcgtgagcgtggtatcaccattgacattgctctgtggaagtttgagacaaccaagtactactgcactgtcatcgatgctcccggacaccgtgacttcatcaagaacatgatcacgggtacctctcaggctgattgtgctgtcctcatcattgactccaccactggtggttttgaggccggtatctccaaggatggtcagacccgtgagcatgcattgcttgctttcacccttggtgtcaagcagatgatctgctgctgcaacaagatggatgccaccacccccaagtactccaaggccaggtacgatgaaatcgtgaaggaagtgtcttcctacctgaagaaggttggttacaaccctgacaagatcccctttgtccccatctctggttttgagggcgacaacatgattgagaggtccaccaaccttgattggtacaagggtcccacccttcttgaggctcttgaccagatcaatgagcccaagaggccctcggacaagcccctccgtctgcctcttcaggatgtctacaagatcggtggtattggtactgtcccagtgggccgtgttgagactggtgtcctcaagcccggtatggttgtgacttttgctccgtctggattgacaactgaggttaagtctgttgagatgcaccacgaggctctccaggaggctctccccggtgacaatgtcgggttcaacgtcaagaatgttgctgtcaaggatctgaagcgtggttacgttgcatccaactcaaaggacgacccggcaaaggaagctgccaacttcacatcgcaggtcatcatcatgaaccaccccggtcagatcggtaacgggtatgccccggtgctcgactgccacacctcccacatcgccgtgaagtttgcagagatcttgacaaagatcgacagacgttcgggtaaggagctggagaaggagcccaagttcttgaagaacggagatgcgggtatggtgaagatgattccgacaaagccgatggtggtggagacattctcggagtatccgcctctggggcgttttgcggtgagagacatgaggcagacggttgctgtcggagtcattaagagtgtggagaagaaggacccgacaggtgcgaaggtgacaaaggcagctgccaagaagggtgccaagtgaacgttgttggtccaaactcctactctatccgcagatgaaagaagtagaatctttcagagtgtttcgaaagaggaagacttgttacctgttattcctggtttttattattgttattttgctgttttgcttttgaggtttttgtggtacagcttcgtctctccgtcgtgtgagctccgttctcgtaactgggttctcgatcgacggtggcggcgttaagcttctccactgaatctccgatggcagtttttgtttctttgttcttatgtctccggctctgttccgaaccttttttttttcaagtgtctttgttttccgtacctttatatgaccatcgctt

SEQ ID NO: 706 - DNA, 1514 bp, Cleome spinosa
atgggtaaagagaaggttcacatcaacattgtggttattggccacgtcgactctggaaagtcgactaccactggccacttgatatacaagttgggtggtattgacaagcgtgtcatcgagaggttcgagaaggaagcggctgagatgaacaagaggtccttcaagtatgcctgggtgttggacaagcttaaggctgagcgtgagcgtggtattaccatcgatattgccctctggaagttcgagaccaccaagtactactgcactgtcattgatgctcctggtcaccgtgactttatcaagaacatgatcacgggtacctcccaggccgactgtgctgtcctgatcatcgactccaccaccggtggtttcgaggctggtatctccaaggatggtcagacccgtgagcacgccttacttgctttcacccttggtgtcaagcaaatgatttgctgctgtaacaagatggatgccaccacccccaagtactccaaggccaggtatgatgaaattgtcaaggaagtgtcttcctacctgaagaaggttggttacaatcccgacaagatcccattcgtgcccatctctggtttcgagggtgacaacatgatcgagaggtccaccaacctcgactggtacaagggaccaaccctcctcgaggcacttgaccagatcaacgagcccaagaggccatcagacaaacccctccgtctccctcttcaggatgtctacaagatcggcggtattggaactgtgccagtcggacgtgtagagaccggtgtcctcaaacctggaatggttgtcaccttcgctccatctggattgaccactgaagtcaaatctgtcgagatgcaccacgaggctcttcaagaggctctccccggtgacaatgttgggttcaacgtcaagaacgtcgctgtcaaagatctcaagcgtggatacgttgcctccaactcaaaggatgacccagccaaggaagctgccagtttcacatcacaggtcatcataatgaaccatccaggtcagatcggaaacggatacgctccggtcctcgactgccacacttcccacattgccgttaaatttgctgagctgttgacgaagattgaccgacggtcgggtaaggagctggagaaggaacccaagttcttgaagaacggggacgctggaatggtgaagatgattccgaccaagccaatggtggtggagacattctctgagtacccaccgcttggccgtttcgccgtgagggacatgagacagacggtggcggtcggagtgatcaagagtgtggagaagaaggacccgaccggtgctaaggtcacaaaggctgcagccaagaagggtgccaagtgagaactctcttcatcattggtttgaaactttgtgttggtttggttgagtctttatctctccggcttttttgtttttgttatttccagtcttgtgctctggttctaatgcctggactttcggacaactttttgtcatctatttcgtttatttcgttttgtacgttt

SEQ ID NO: 707 - DNA, 1684 bp, Gossypium hirsutum
ttcagctattacgtggagagccttttttgtgtagcgattctcagttagtcttttctttaagcttacagcttctctccagagttttataatgggtaaggagaaggttcacatcaaccttgttgtcattggccatgtcgactctggcaagtcgaccactaccggtcatttgatctacaagcttggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcgaccactggtggttttgaagctggtatctctaaagatggtcagactcgtgagcatgctttgcttgcttttaccctcggtgttaggcagatgatttgctgctgcaacaagatggatgcaacaaccccaaagtactcaaaggcaaggtttgatgaaattgtcaaggaagtctcttcttatcttaagaaagttggttacaaccctgagaagatcccatttgtcccaatctccggttttgagggtgacaacatgatcgagagatctacaaacctcgattggtacaagggtcctactctccttgaggctcttgaccagatcaccgagcccaagaggccctcggataagccactccgtcttccacttcaggatgtctacaagattggtggtattggaactgtccctgttggtcgtgttgaaactggtgtcctcaaacccggtatggttgttacttttggtcctactggtctgaccactgaagttaagtctgttgagatgcaccatgaatccctcccggaagctttccctggtgacaatgttgggttcaacgttaagaacgttgctgttaaggatcttaaacgtggttttgttgcttcaaactccaaggatgatccggccaaggaagctgccaacttcacctcacaggttatcatcatgaaccaccctggccaaatcggaaatggttatgccccagtcctcgactgccacacctctcacattgctgtcaaattttctgagctgttgaccaagattgacagacgatctggcaaggaactcgagaaggaacccaagttcttgaagaacggtgatgcaggtatggtaaagatgattcccaccaaacccatggtggttgagactttctccgaatacccaccactcggacgttttgctgtccgtgacatgcgccagaccgttgctgtcggtgtcatcaagagtgttgagaagaaggacccaactggtgctaaggtcaccaaatctgctgccaagaagaaatgagagattatttcagagataattatcagttttcattacagctttggacaattatcttaaatttggactttaaatttactttttatgagacttgttgatttgctttttaaacaaattctagttttatattttaatgtttttcaattctgagcgtttatatattatatcgaatgcttccatagcgacagagaaaaaaaaaaaaaaaaaactcgagaggacttcttaaagcgggcgcgggccccatcgatttgtcca

SEQ ID NO: 708 - DNA, 1655 bp, Gossypium hirsutum
tttataatgggtaaggagaaggttcacatcaaccttgttgtcattggccatgtcgactctggcaagtcgaccactaccggtcatttgatctacaagcttggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcgaccactggtggttttgaagctggtatctctaaagatggtcagactcgtgagcatgctttgcttgcttttaccctcggtgttaggcagatgatttgctgctgcaacaagatggatgcaacaaccccaaagtactcaaaggcaaggtttgatgaaattgtcaaggaagtctcttcttatcttaagaaagttggttacaaccctgagaagatcccatttgtcccaatctctggttttgagggtgacaacatgatcgagagatctacaaacctcgattggtacaagggtcctactctccttgaggctcttgaccagatcaccgagcccaagaggccctcggataagccactccgtcttccacttcaggatgtctacaagattggtggtattggaactgtccctgttggtcgtgttgaaactggtgtcctcaaacccggtatggttgttacttttggtcctactggtctgaccactgaagttaagtctgttgagatgcaccatgaatccctcccggaagctttccctggtgacaatgttgggttcaacgttaaaaacgttgctgttaaggatcttaaacgtggttttgttgcttcaaactccaaggatgatccggccaaggaagctgccaacttcacctctcaggttatcatcatgaaccaccctggccaaattggaaatggttatgccccagtcctcgactgccacacctctcacattgctgtcaaattttccgaactgttgaccaagattgacagacgatctggcaaggaactcgagaaggaacccaagttcttgaagaacggtgatgcaggtatggtaaagatgattcccaccaaacccatggttgttgagactttctctgaatacccaccacttggacgttttgctgtccgtgacatgcgccagactgttgccgtcggtgtcatcaagagtgttgagaagaaggacccaactggtgctaaggtcaccaaatctgctgccaagaagaaatgagagattatttgagagagaattatatcagttttcattacagctttggacaattatcttaaatttggactttagaatttactttttgtgagactttttgatttgctttttaaacaaatcctagttttatatttcaatgttttccaattctgagtgtttatatattatatcgattgcttccaatagcgacagataattcacagccttcactgttcttttcagctgtgctctcacttgcgaataggtgaggcaaattttacatagcttatactttttagtatggaacgatgaccaattaaaagttcggt

SEQ ID NO: 709 - DNA, 1674 bp, Gossypium hirsutum
gggggctctcactcaacgctctctcatcctgcttctagtcaagccaatctcaaaagactccccttttagctcacagctctctcgagttctgtaatgggtaaggagaaggttcacatcaacattgtggtcatcggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgaacgtgaacgtggtattaccatcgatattgccctctggaagtttgaaactaccaaatactactgcactgtcattgatgcccctggacaccgtgacttcatcaagaacatgattactggtacctcacaggctgactgtgctgttctcattatcgactcgaccactggtggtttcgaagctggtatctcaaaggatggtcagacacgtgagcatgctttgcttgcgtttacccttggtgtcaagcagatgatttgctgctgcaacaagatggatgcaacaactccaaaatactccaaggcaaggtatgatgaaattgtgaaggaagtctcctcatatcttaagaaagttggttacaaccctgacaagatcccatttgtcccaatctctggatttgagggtgataacatgattgagaggtctaccaaccttgactggtacaagggtcccactctccttgaggctcttgaccagatcaatgagcccaagaggccttcagacaagccgctccggctcccacttcaggatgtctacaagattggcagcattggaactgtgcctgttggtcgtgttgagactggtgtccttaagcctggtatggtagtgacctttggcccctctggtctgaccactgaagttaagtctgttgagatgcaccatgaagccctctctgaggctctccctggtgacaatgttggattcaatgtcaagaacgttgctgttaaggatctcaagcgtggtttcgttgcttcaaactctaaggatgatcctgcaaaggaggctgccagcttcacctctcaggtcatcatcatgaaccaccctgggcagattggaaacggatatgccccagtccttgactgccatacctcccacattgctgtgaagttttctgaattgctgaccaagatcgacaggcgatctggaaaggagcttgagaaggagcccaagttcttgaagaatggtgatgcagggatgataaagatggttcccaccaagcctatggttgtggagactttctctgagtacccaccccttggacggtttgctgtcagggacatgcgtcagactgtggctgttggtgtcatcaagagcgttgagaagaaggatccaaccggtgctaaggtcaccaaatctgctgccaagaagaaatgagattgcatttgatagtatcaaagccttttgattttggttttctatgtagtctggtacttaacagttttttagaccaattttgatatgtgttcatttggttgagactggcatctgcccacggattgtgtgtttgctttttccgtgtcaattgtagttgaattccttcaaagaatgctagtttgatatttccttggtttacttaatgttatgatggtcctaaggcttcgattttcaact

SEQ ID NO: 710 - DNA, 1695 bp, Gossypium hirsutum
ttcggctattacgtggagagccttttttttgttgtagcgattctcagttagtcttttctttaagcttacagcttctctccagagttttataatgggtaaggagaaggttcacatcaaccttgttgtcattggccatgtcgactctggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaaccactggtggttttgaagctggtatctctaaagatggtcagactcgtgagcatgctttgcttgcttttaccctcggtgttaggcagatgatttgctgctgcaacaagatggatgcaacaaccccaaagtactcaaaggcaaggtttgatgaaattgtcaaggaagtctcttcttatcttaagaaagttgggtacaaccctgagaagatcccgtttgttccaatctccggttttgagggtgacaacatgattgagagatctacaaacctcgattggtacaagggtcctactctccttgaggctcttgaccagatcaccgagcccaagaggccctcagataagccacttcgtcttccacttcaggatgtctacaagattggtggtattggaactgtccctgttggtcgtgttgaaactggtgtcctcaaacccggtatggttgttacttttggtcctactggtctgaccactgaagttaagtctgttgagatgcaccatgaatccctcccggaagctttccctggtgacaatgttgggttcaacgttaagaacgttgctgttaaggatcttaaacgtggttttgttgcttcaaactccaaggatgatccggccaaggaagctgccaacttcacctcacaggttatcatcatgaaccaccctggccaaatcggaaatggttatgccccagtcctcgactgccacacctctcacattgctgtcaaattttctgagctgttgaccaagattgacagacgatctggcaaggaactcgagaaggaacccaagttcttgaagaacggtgatgcaggtatggtaaagatgattcccaccaaacccatggtggttgagactttctccgaatacccaccactcggacgttttgctgtccgtgacatgcgccagaccgttgctgtcggtgtcatcaagagtgttgagaagaaggacccaactggtgctaaggtcaccaaatctgctgccaagaagaaatgagagattattgcagagataattatatcagttttcattacagctttggacaattatcttaaatttggactttaaatttactttttgtgagacttgttgatttgctttttaaacaaattctagttttatgttttaatgtttttcaattctgagcgtttctatattatatcgattgctccatagcgacagagaattcacagccgtcactgttcttttcagctgtgccctcacctgcgaataggtgaggcaaattttacatagct

SEQ ID NO: 711 - DNA, 2031 bp, Eucalyptus grandis
actctcaaaccctaatcctgccctgcccatcccttctgctgctgctgctcgtcacctctctctccctctcgcggccagctgcgagatctgccgagttaagcctcgtacatcaaaatgggtaaggagaagattcacatcagcattgtggtcattggccatgtcgattctgggaagtcaaccacaactggccacttgatatacaagctcggaggaatcgacaagcgtgtgattgagagattcgagaaggaagctgctgagatgaacaagagatcgttcaagtatgcttgggtgcttgacaagctcaaggccgagcgcgagcgcggtattaccattgatattgccttgtggaagttcgagaccaccaagtactactgcactgtcattgatgctcctggacatcgtgactttattaagaatatgattactggaacctcccaggccgactgtgctgtccttatcattgattccaccactggtggtttcgaagctggtatttccaaggatggccagacccgtgaacatgctctccttgctttcacccttggtgtcaggcaaatgatttgctgctgtaacaagatggatgccaccacccccaagtactccaaggctaggtatgatgaaattgttaaggaagtctcttcttacctgaagaaggtgggatataaccctgacaagattccatttgtccccatctccggattcgagggagacaacatgattgagaggtctaccaaccttgactggtacaagggtccaacattgctcgaggccctcgaccagattaatgagcccaagagaccatctgacaagcccctccgtctcccacttcaggacgtgtacaagattggtggtatcggaactgtccctgtcggccgtgttgagactggtgtcattaagcctgggatggttgtcacttttggtccctctgggttgaccactgaagttaagtctgtggagatgcaccatgaggctctccaggaggctcttccgggggacaacgttgggtttaatgtgaagaatgttgctgtcaaggatctcaagcgtggctacgttgcatccaactcgaaggacgatcccgccaaggaagcagccaactttacctcccaagttattatcatgaatcaccctggccagattggaaatggatatgcccctgttcttgactgtcacacctcccatattgctgtcaagttttctgagctgttgaccaagatcgacaggcgatcaggtaaggagcttgagaaggagcccaagttcttgaagaacggtgactctgggatggtgaagatgattcccaccaagcccatggttgtcgagactttctccgagtatcctccacttggtcgttttgctgtgagggacatgcgtcagaccgttgctgtcggtgttatcaagaatgttgagaagaaggatcccagtggagctaaggtcacaaagtctgctgcgaagaagaagtgaaccgtgcagtccagctctggcacttcaatatttgaaagtcgtctctatagtatttggaataaagcttgggctatcgttagcatttgctctcttggtcatctaggcatgtcatttgcaggttgtggcgccatctatctgtcctcatctagtgtctggtcccaaaattgggtgctcgataggcggtggcatggtttggccgtttacttaagtcagttttgagtctttacgctttgtggggaatgtacttttagaactctctgtttcgtttcgtttgggattggtctgttatttacatgtgataggcggtctcatatatcctgttttaccattcttctttgtgagtcatatcaaactttattgtggatgtaaacttgaccggttgtttggcaaaccggtacccctttttagctgttgggtttttgaagttggcactctggctatgtttgctttgcggggagtaggcataactaagttcaggtcagggatttggagaggataaatgctaagtatggattggtttataaaattgaaactacaacagaattgatgtgcagtaactatatcatttccgca

SEQ ID NO: 712 - DNA, 1813 bp, Euonymus alatus
tataagaatccacaaacccttctattcacttcatttcgctgctcttttgtcgttcatttctcaagcggctagggttatatagctaaagttctctcttaagctcaaaactaagactcggacaatgggtaaagagaaggttcacatcagcattgttgttatcggccatgttgactctggtaagtcaactactactggccacttgatctacaagcttggaggcattgacaagcgtgttattgagagatttgagaaagaagctgctgagatgaacaagaggtcattcaagtatgcttgggtgcttgacaagcttaaggctgagcgtgaacgtggtatcaccattgatattgccttgtggaagtttgagaccaccaagtactactgcactgtcattgatgcacctggacatcgtgacttcattaagaacatgattactggtacctcccaggctgactgtgctgttcttattattgactccactactggaggctttgaagctggtatctccaaggatgggcagactcgtgagcatgctcttcttgccttcactcttggtgtcaaacaaatgatttgttgctgtaacaagatggatgccaccaccccaaagtattcaaaagctagatatgatgaaattgtcaaggaagtttcttcttacctgaagaaggttggatacaatcctgacaaggttccttttgtccccatatctggatttgagggtgataacatgattgagaggtccaccaaccttgattggtacaagggtccaacccttcttgatgcccttgaccaggtgaacgaacccaagagaccctcagacaagcccctccgccttccactacaggatgtatataagattggtggaattggaactgttccagtgggacgtgttgagactggaatcatcaagcctggtatggttgttacctttggtccctctgggttgacaactgaagttaagtctgtggagatgcatcatgaagctcttcaagaggctcttcccggtgacaatgttggtttcaatgtgaagaatgttgctgtcaaggatctcaagcgtggttttgttgcctcaaattctaaggatgatcctgccaaggaggctgctaacttcactgcccaagttattattatgaatcacccggggcaaattggaaatggttatgcccccgtgcttgattgccacacttcccacattgcagtcaagtttgctgagttgcttacgaagattgaccggcgatctggcaaggagctggagaaggagcccaaattcttgaagaatggtgatgctgggttcgtgaagatgattcccaccaagcccatggtagtggaaaccttctctgagtaccctccattgggtcgttttgctgtcagggacatgcgtcagactgttgctgttggtgtcatcaaagctgtggaaaagaaggatcctactggagccaaggtgacaaaatctgctgtcaagaagggcaagtgaatcgtgctgactggcagtagccgtagagaagtttatcatcaaaagtacaataaagactggattcttatccagatttcatcgactggatgtttactgctttattttgatggttctagttttaagtcatctccatcatcgcgttcgtactgttcgcagaactgggttctggaccgacggtggcgtggttattttctttttcttgtgtgtcgtttgttgagttttgtcatgtcgaacctcgactatgttgctactgtttcctaagctttgttcctttgttggacagagtgggcattttatctgcattttacggtaatttatatctagtatgcgtgttaaaattgtgga

SEQ ID NO: 713 - DNA, 1818 bp, Euonymus alatus
gatttcgctgctcttttgtcgttcatttctcaagcggctagggttatagctaaagttctctcttaagctcaaaactaagactcggacaatgggtaaagagaaggttcacatcagcattgttgttattggccatgttgactctggtaagtcaactactactggccacttgatctacaagcttggaggcattgacaagcgtgttattgagagatttgagaaagaagctgctgagatgaacaagaggtcattcaagtatgcttgggtgcttgacaagcttaaggctgagcgtgaacgtggtatcaccattgatattgccttgtggaagtttgagaccaccaagtactactgcactgtcattgatgcacctggacatcgtgatttcattaagaacatgattactggcacctcccaggctgactgtgctgttcttattattgactccactactggaggttttgaagctggtatctccaaggatgggcagactcgtgagcatgctcttcttgccttcactcttggtgtcaaacaaatgatttgctgctgtaacaagatggacgccaccaccccaaagtattcaaaagctagatatgatgaaattgtcaaggaagtttcttcttacctgaagaaggttggatacaatcctgacaaggttccttttgtccccatatctggatttgagggtgataacatgattgagaggtccaccaaccttgattggtacaagggtccaacccttcttgatgcccttgaccaggtcaacgaacccaagagaccctcagacaagcccctccgcctcccactacaggatgtatataagattggtggaattggaactgttccagtgggacgtgttgagactggaatcatcaagcctggtatggttgttacctttggtccctctgggttgacaactgaagttaagtctgtggagatgcaccatgaagctcttcaagaggctcttcccggtgacaatgtcggtttcaatgtgaagaatgttgctgtcaaggatctcaagcgtggttttgttgcctcaaattctaaggatgatcctgccaaggaggctgctaacttcactgcccaagttattattatgaatcacccagggcaaattggaaatggttatgcccccgtgcttgattgccacacttcccacattgcagtcaagtttgctgagttgcttaccaagattgacaggcgatctggcaaggagcttgagaaggagcccaaattcttgaagaatggtgatgctgggttcgtgaagatgattcccaccaagcccatggtagtggaaaccttctctgagtaccctccattgggtcgttttgctgtcagggacatgcgtcagactgttgctgttggtgtcatcaaagctgtggaaaagaaggatcctactggagctaaggtgacaaaatctgctgtcaagaagggcaagtgaatcgtgctgactggcaatagccatagagaagtttatcatcataagtacaataaagactgggtccagatttcatcgactggatgtttactgctttgttttgatggttctagtgttaagtcgtcgccatcatcacttttgtactgttcgcagaactgggtactggaccgacggtggcgtggttattttctttttttgtgtgtcgtctgttgagttttgtcatgtcgaacctggactatgttgctactgttttcttaaagctttgttcctttgttggacagagtgggtattttatctgcattttaccatttatatctagtatgcgtgttaaaattgtggatctctctctgcttattgtggcttatttgaacttcttgttgaagttg

SEQ ID NO: 714 - DNA, 1775 bp, Euonymus alatus
gggactcttcacttctcttatcgttcatttcttgcgcggctagggttttagctaagctcttttaagtttgaaggtaagacttgacaatgggtaaagagaagattcacatcagcattgtggttattggccatgtcgactctggtaagtcaacaactactggccacttgatctacaagcttggaggcattgacaagcgtgttattgagagatttgagaaagaagctgctgagatgaacaagagatcattcaagtatgcctgggtgctcgataagcttaaagctgagcgtgaacgtggtatcaccattgatattgccttatggaagtttgagaccaccaagtactactgcactgtcattgatgcccctggacatcgtgatttcattaagaacatgattactggtacctcccaggctgactgtgctgttctgattattgactccactactggaggttttgaagctggtatctcgaaggacgggcagactcgtgagcatgctcttcttgcctttactcttggtgtcaaacaaatgatttgctgctgcaacaagatggatgccaccaccccaaagtactcaaaagctagatatgaggaaattgtcaaggaagtttcgtcctacctaaagaaggttggatacaaccctgataagattccatttgtccccatatctggatttgagggtgataacatgattgagaggtccaccaaccttgattggtacaagggtccaacccttcttgatgcccttgaccaggtgaacgaacccaagagaccctcagacaagcccctccgccttccactacaggatgtatataagattggtggaattggaactgttccagtgggacgtgttgagactggaatcatcaagcctggtatggttgttacctttggtccctctgggttgacaactgaagttaagtctgtggagatgcaccatgaagctcttcaagaggctcttcccggtgacaatgtcggtttcaatgtgaagaatgttgctgtcaaggatctcaagcgtggttttgttgcctcaaattccaaggatgatcctgccaaggaggctgctaacttcactgcccaagttattattatgaatcacccggggcaaattggaaatggttatgcccctgtgcttgattgccacacttcccacattgcagtgaagtttgctgagttgcttaccaagattgacaggcgatctggcaaggagcttgagaaggagcccaaattcttgaagaatggtgatgctggtttcgtgaagatgattcccaccaagcccatggtagtggaaaccttctctgagtaccctccattgggccgttttgctgtcagggacatgcgtcagactgttgctgttggtgtcatcaaagctgtggaaaagaaggatcctactggagccaaggtgacaaaatctgctgtcaagaagggcaagtgaatcgtgctgactggcagtagccgtagagaagtttatcatcaaaagtacaataaagactggattcttatccagatttcatcgactggatgtttactgctttattttgatggttctagttttaagtcatctccatcatcgcgttcgtactgttcgcagaactgggttctggaccgacggtggcgtggttattttctttttcttgtgtgtcgtttgttgagttttgtcatgtcgaacctcgactatgttgctactgtttcctaagctttgttcctttgttggacagagtgggcattttatctgcattttacggtaatttatatctagtatgcgtgttaaaattgt

SEQ ID NO: 715 - DNA, 1728 bp, Flaveria ramosissima
aacctgacattcttttcactttcctccatctgccttgagagatcgtctgcataatcttcgttaagaatgggtaaagaaaagacgcatatcagtattgttgtcattggacatgtcgactccgggaagtctacgactactggacatcttatctacaagcttggtggtatcgacaagcgtgtgatcgaaaggttcgagaaggaagctgctgagatgaacaagaggtccttcaaatatgcttgggtgctcgacaagctcaaggcagagcgtgaaagaggtattaccattgatattgccttgtggaagtttgagaccaccaagtactactgcactgtcattgatgctcccggacatcgtgatttcattaagaacatgattactggtacctcccaagctgactgtgctgttctcatcatcgactcaaccactggtggtttcgaggctggtatttccaaggatggtcagacccgtgagcatgctcttcttgctttcactcttggtgtcaagcaaatgatttgctgctgtaacaagatggatgccaccacaccaaaatactcaaaggcaaggtatgatgaaattgtgaaggaagtttcttcatacttgaagaaggtcggatacaaccccgacaaaatcccatttgtgccaatctctggttttgaaggagacaacatgattgagaggtccaccaaccttgactggtacaagggtcccacccttcttgaagctcttgaccagatcaacgagcccaagagaccctcagacaagccactccgtctcccacttcaggacgtgtacaagatcggtggtattggaactgtgccagtgggacgtgttgagactggtgtgatcaagcctggtatggttgtcacctttggaccatctgggttgaccactgaagttaagtctgttgagatgcaccatgaagctctaaccgaggctctccccggtgacaatgttgggttcaatgtcaagaatgttgcagtcaaggatctcaagcgtggttacgttgcctcaaactccaaggatgatcctgccaagggtgcggccagcttcacttctcaggtcattatcatgaaccaccctggtcagatcggtaacggttatgcccccgttcttgattgtcacacctcccacattgccgtcaagttctctgagcttttgaccaagatcgacagacgatctggtaaggagctcgagaaggagcctaagttcttgaagaacggtgatgccggtatggttaagatgcttccaaccaagcccatggttgtcgagacctttgctgaatacccaccactcggaaggtttgccgtgagagacatgcgtcagacggttgcagtcggtgttatcaagagcgtcgagaagaaggacccgaccggggccaaggtgaccaaggctgcagtgaagaagggtgccaagtgaggtgaggtggtttatggagtattttatgttttgtcatttgatttactagttttgaactttattttgtggaggagttttgtttgtttttcgatcttggaagctttcattattattgtgggagttttatgggttgcagacttttgttgtgggttaatttatagcggtcttctacaacgggtttgtagttggtggttgaaaaacttatatttatgaaatccaactctttttatcattttcttcgaaatagtaattttagtaaaaaaaaattacaaattctacagcaactaaaggtttcgatctaaacgcccaggt

SEQ ID NO: 716 - DNA, 1635 bp, Flaveria ramosissima
ttcactttcctccatctaccttgagagatcgtctgcataatcttcgttaaggatgggtaaggaaaagacgcatatcagtattgttgtcattggacatgtcgactccgggaagtctaccactactggacatcttatctacaagcttggtggtattgacaagcgtgtgatcgaaaggttcgagaaggaagctgctgagatgaacaagaggtccttcaaatacgcttgggtgcttgacaagctaaaggcagagcgtgaaagaggtattacaattgatattgccttgtggaagtttgagaccaccaagtactactgcactgtcattgatgctcccggacatcgtgatttcattaagaacatgattactggtacctcccaagctgactgtgctgttctcatcatcgactcaaccactggtggtttcgaggctggtatttccaaggatggtcagacccgtgagcatgcgcttcttgctttcactcttggtgtcaagcaaatgatttgctgctgtaacaagatggatgctaccaccccgaaatactccaaggcaaggtatgatgaaattgtgaaggaagtttcttcatacttgaagaaggtcggatacaatcccgacaaaatcccatttgtgccaatctctggttttgaaggagacaacatgattgagaggtccaccaaccttgactggtacaagggtcccacccttcttgaagctcttgaccagatcaacgagcccaagagaccctcagacaagccactccgtctcccacttcaggacgtgtacaagatcggtggtattggaactgtaccagtgggacgtgttgagactggtgtgatcaagcctggtatggttgtcacctttggaccatctgggttgaccactgaagttaagtctgttgagatgcaccatgaagctctaactgaggctctccctggtgacaatgttgggttcaatgtcaagaacgttgcagtcaaggatctcaagcgtggttacgttgcctcaaactccaaggatgatcctgccaagggtgcggccagcttcacctctcaggtcattatcatgaaccaccctggtcagatcggtaacggttatgccccagttcttgattgtcacacctcccacattgccgtcaagttctctgagcttttgaccaagatcgacagacgatctggtaaggagctcgagaaggagcctaagttcctgaagaacggtgatgccggtatggttaagatgcttccaaccaagcccatggttgtcgagacctttgctgaatacccaccacttggaaggtttgccgtgagagacatgcgtcagacagttgcagtcggtgttatcaagagcgtcgagaagaaggacccgaccggagccaaggtgaccaaggctgcagtgaagaagggagccaagtgaggtgaggtggtttgtggtttggtttatggagtattttatgttttgtcatttgatttactagttttgaactttattttgttgaggagttttgtttgtttttcaatcttggaagctttcattattattgtgggagttctatgggttgcagacttttgttgtgggttaatttatagtggtctacttcaatgagtttgtagttggtgggtgaaaaacttatatttatgatatccata

SEQ ID NO: 717 - DNA, 1484 bp, Flaveria ramosissima
cgctagcacgtggtagtctaacgacagagtacgatgggagtcttcgtcttcctccatctaccacacaagtcgtctgcagataattcgttaaggatgggtaaagaaaagactcatatcagtattgttgtcattggacatgtcgactctggcaagtccacaacaactggacacttgatctataagcttggaggaattgacaagagagtcatcgaaagattcgagaaggaggctgctgagatgaacaaaaggtcattcaaatacgcctgggttcttgacaagctcaaggctgagcgtgaaagaggtatcaccattgatattgccttgtggaagttcgagacaaccaagtactactgtactgtcattgatgctcctggacatcgtgactttatcaagaacatgattacgggtacctcccaagctgactgtgccgtgcttatcattgattccaccacgggtggttttgaagctggtatttccaaggatggtcagacccgtgagcacgctcttcttgctttcactcttggtgtcaagcaaatgatttgctgctgtaacaagatggatgccacaacaccaaagtactccaagtcaaggtatgaggaaattgtgaaggaagtgtcatcttacttgaagaaggtgggatacaaccctgacaaaatcccattcgttccaatctctgggtttgaaggagacaacatgattgagaggtcgaccaaccttgactggtacaagggtccaacccttcttgaagctcttgaccagatcaatgagcccaagagaccatcagacaagccccttcgtcttccacttcaggacgtgtacaagattggtggtattggaactgtgccagtgggacgtgttgagactggtgtgatcaagcctggtatggttgtcacttttggaccatctggattgaccactgaagttaagtctgttgagatgcaccatgaagctcttactgaggctcttcctggtgacaatgttgggttcaacgttaagaatgttgctgtcaaggatctcaagcgtggttatgttgcatcaaactccaaggatgacccggctaagggtgctgctagcttcacctcccaggttatcatcatgaaccaccctggtcagatcggtaacggttatgcacctgttcttgattgccacacctcccacattgccgtcaagttctctgagcttcttaccaagatcgacagacgatctggtaaggaacttgagaaggagcctaaattcttgaagaatggtgatgctggtatggtaaagatgcttcccaccaagcctatggtggttgagacttttgcagagtacccaccacttggtagatttgctgtgagagacatgcgtcaaacggttgctgtgggtgtgatcaagagtgtcgagaagaaggacccaacaggagccaaggttaccaaggccgcagtgaagaagggagccaagtgaggtggtcttgtcttatggtttaatggtgtatttttattttc

SEQ ID NO: 718 - DNA, 1599 bp, Flaveria ramosissima
agatatctcagaatgggtaaagaaaagactcacatcagcattgtggttattggccatgtcgactctggcaagtcaaccactactggtcaccttatttacaagcttggaggtattgacaagcgtgttattgagagatttgagaaagaagctgctgaaatgaacaagaggtcattcaaatacgcatgggttcttgacaaactaaaggctgagcgtgaacgtggtatcaccattgatattgctttgtggaagtttgagaccaccaagtactactgtactgttattgatgctcctggacatcgtgatttcattaagaacatgattactggtacctctcaggctgattgtgctgttctgatcattgactcaaccactggtggttttgaagctggtatttccaaagatggtcagacgcgtgaacatgctttgcttgccttcacccttggtgtgaagcaaatgatctgttgctgtaacaagatggatgccactacccccaagtactctaagtcaaggtatgaggaaattgtcaaggaagtctcatcctacctgaagaaggttggctacaaccctgacaaaattccatttgtacccatctctggatttgagggtgacaacatgattgagaggtcaacaaacctcgactggtacaagggtccaactcttctagaagctcttgaccagattaacgaacctaaaagaccatccgacaaaccacttcgtctaccacttcaagatgtgtacaagattggtggtattggaactgttcctgttggacgtgttgaaactggtgtcatcaaacctggtatggttgtcacttttggtccatctgggttgaccactgaagttaagtcagttgagatgcaccacgaggcactaactgaagcactccctggtgacaacgttgggttcaacgtcaagaacgtcgctgtcaaggatctgaagcgtggttatgttgcatccaactctaaggatgaccctgctaagggtgcagccagtttcacctcacaggtcatcatcatgaaccaccctggtcagattggaaatggttatgctccagttctggattgccacacctctcacattgcagtcaagttttctgagcttttgaccaaaattgacagacggtctggtaaagagctggaaaaggagcccaaatttttgaagaatggtgatgccgggatggttaagatgcttcccaccaagcccatggttgttgagacttttgctgaatacccaccacttggtcgttttgctgttcgtgacatgcgtcagacggttgctgttggtgtgatcaagagtgtggagaagaaggaccccactggagctaaggtgaccaaggctgcagtcaagaagggagctaaatgatggggttggagtgttttgttatcgaatgatgatggagtttttatcgtattttggaactatctttattatgtttattttggttaagaatttttggtgtttggtcttcttggtgcttgcatttctgtactctagcctcactttgtgaggatggttggaggtattgagcaacttgttgcttgatgacggtggtgcaagttaccagaggacaacttttgtttgaatggttatgttgaactt

SEQ ID NO: 719 - DNA, 1403 bp, Flaveria ramosissima
cttcctccatccaccacacaagtcgtctgcagatcaatcgttaaggatgggtaaagaaaagactcacattagtattgttgtcattggacatgtcgactccggcaagtccacaacaactggacacttgatctacaagcttggaggaattgacaagagagtcatcgaaagattcgagaaggaggctgctgagatgaacaaaagatccttcaaatacgcctgggttcttgacaaacttaaggccgagcgtgaaagaggtatcaccattgatattgccttgtggaagtttgagacaaccaagtactactgcactgtcattgatgctcctggacatcgtgactttatcaagaacatgattactggtacttctcaggccgactgtgcggtgcttatcattgattccaccactggtggttttgaagctggtatttccaaggatggtcagacccgtgagcacgctctacttgctttcacccttggtgtcaagcaaatgatttgctgctgtaacaagatggatgctacaacaccaaagtactccaaggcaaggtacgacgaaattgtgaaggaagtgtcatcttacttgaagaaggtgggatacaaccctgacaaaatcccatttgttccaatctctgggttcgaaggagacaacatgattgagaggtcgacaaaccttgactggtacaagggtccaacccttcttgaagctcttgaccagatcaatgagcccaagagaccatcagacaagcccctccgtcttccacttcaggacgtgtacaagatcggtggtattggaactgtgccagtgggacgtgttgagaccggtgtgatcaagcctggtatggttgtcacttttggaccatctggattgaccactgaagttaagtctgttgagatgcaccatgaagctctgactgaggctcttcctggtgacaatgttgggttcaacgttaagaatgttgctgtcaaggatctcaagcgtggttatgttgcatccaactccaaggatgacccagctaagggtgctgctagcttcacctcccaggttatcatcatgaaccaccctggtcaaatcggtaacggttatgcacctgttcttgattgccacacctcccacattgctgtcaagttctctgaacttttgaccaagatcgacagacgatctggtaaggaacttgagaaggagcctaaattcttaaagaatggtgatgctggtatggttaagatgcttcccaccaagcctatggttgtcgagactttcgcagagtatccaccacttggtaggtttgccgtcagagacatgcgtcaaacggttgctgtgggtgtgatcaagagcgttgagaagaaggacccaacaggagccaaggttaccaaggccgcagtgaagaagggagccaagtgaggtggtt

SEQ ID NO: 720 - DNA, 1547 bp, Flaveria ramosissima
ttcctccatccaccacacaagtcgtctgcagatcaatcgttaaggatgggtaaagaaaagactcacatcagtattgttgtcattggacatgtcgactccggcaagtccacaacaactggacacttgatctacaagcttggaggaattgacaagagagtcatcgaaagattcgagaaggaggctgctgagatgaacaaaagatccttcaaatacgcctgggttcttgacaaacttaaggccgagcgtgaaagaggtatcaccattgatattgccttgtggaagtttgagacaaccaagtactactgcactgtcattgatgctcctggacatcgtgactttatcaagaacatgattacgggtacttcccaggccgactgtgcggtgcttatcattgattccaccactggtggttttgaagctggtatttccaaggatggtcagacccgtgagcacgctcttcttgctttcactcttggtgtcaagcaaatgatttgctgctgtaacaagatggatgccacaacaccaaagtactccaaggcaaggtacgacgaaattgtgaaggaagtgtcatcttacttgaagaaggtgggatacaaccctgacaaaatcccattcgttccaatctctgggttcgaaggagacaacatgattgagaggtcgacgaaccttgactggtacaagggtccaactcttcttgaagcacttgaccagatcaatgagcccaagagaccatcagacaagcccctccgtcttccacttcaggacgtgtacaagatcggtggtattggaactgtgccagtgggacgtgtcgagactggtgtgatcaagcctggtatggttgtcacttttggaccatctggattgaccactgaagttaagtctgttgagatgcaccatgaagctttgactgaggctcttcctggtgacaatgttgggttcaacgttaagaatgttgctgtcaaggatctcaagcgtggttatgttgcatccaactccaaggatgacccagctaagggtgctgctagcttcacctcccaggttatcatcatgaaccaccctggtcaaattggtaacggttatgcacctgttcttgattgccacacctctcacattgctgtcaagttctctgaactgttgaccaagatcgacagacgatctggtaaggaacttgagaaggagcctaaattcttaaagaatggtgatgctggtatggttaagatgcttcccaccaagcctatggttgtcgagactttcgcagagtatccaccacttggtaggtttgcagtcagagacatgcgtcaaacggttgctgtgggtgtcatcaagagcgttgagaagaaggacccaacaggagccaaggttaccaaggccgcagtgaagaagggagccaagtgaggtggtttgtgttttggctttatggtgttattttattttctaatgtttcatttactagttttggacttgtattttcttgtagagtttgttatttgatccttgaagctttcatttgttgttgaaaggtttttgggttgcagacatttgtttag

SEQ ID NO: 721 - DNA, 1650 bp, Flaveria ramosissima
aattcatctatcgatctcatcaaagcggcgaaacagattattaacaaagatatctcagaatgggtaaagaaaagactcacatcagcattgtggtcattggccatgtcgactctggcaagtcaaccactactggtcaccttatttacaagcttggaggtattgacaagcgtgttattgagagattcgagaaagaagctgctgaaatgaacaagaggtcattcaaatacgcatgggttcttgacaaactaaaggctgagcgtgaacgtggtatcaccattgatattgctttgtggaagtttgagaccaccaagtactactgtactgttattgatgctcctggacatcgtgatttcattaagaacatgattactggtacctctcaggctgattgtgctgttctgatcattgactcaaccactggtggttttgaagctggtatttccaaagatggtcagacacgtgaacatgctttgcttgccttcacccttggtgtgaagcaaatgatctgctgctgtaacaagatggatgccactacccccaagtactctaaggcaaggtatgatgaaattgtcaaggaagtctcatcctacctgaagaaggttggctacaaccctgacaaaattccatttgtacccatttctggatttgagggtgacaacatgattgagaggtcaacaaaccttgactggtacaagggtccaactcttctggaagctcttgaccagattaacgaacctaaaagaccatctgacaagccacttcgtctaccacttcaagacgtgtacaagattggtggtattggaactgtgcctgttggacgtgttgaaaccggtgttatcaaacctggtatggttgtcacttttggtccatctgggttgaccactgaagttaagtcagttgagatgcaccacgaggcactgactgaagctctccctggtgacaacgttgggttcaatgtcaaaaacgttgctgtcaaggatctgaagcgtggttatgttgcatccaactcaaaggatgaccctgctaagggtgcagccagtttcacctcacaggtcatcatcatgaaccaccctggtcagattggaaacggttacgccccagttctggattgccacacctctcacattgcagtcaagttttctgagcttttgaccaaaatcgacagacggtctggtaaagagctagaaaaggagcccaaatttttgaagaacggtgatgccgggatggttaagatgcttcccactaagcccatggttgttgagacttttgctgagtacccaccacttggtcggtttgctgttcgtgacatgcgtcagacggttgctgttggtgtgatcaagagcgtggagaagaaggacccaactggagctaaggtgaccaaggctgcagtcaagaagggagctaaatgatggggttggagcgttttgttatcgaatgttgatggagcttttatcgtattttggaactatctctattatgtttatttttggttaagaatttttggtgtttggtcttcttggtgcttgcatttctgtactctagcctcgctttgtgaggatggtggaggtattgagcaacttgttgcttgatgatggtggtgcaagttaccagaggacaacttttgtttgaatggttatgttgaacttctat

SEQ ID NO: 722 - DNA, 1562 bp, Flaveria ramosissima
tcgatcccatcaaagcggcgaagcagatcattaacaaagatatctcagaatgggtaaagaaaagactcacatcagcattgttgttattggccatgtcgactctggcaagtcaaccactactggtcaccttatttacaagcttggagggattgacaaacgtgttattgagagatttgagaaagaagcagctgaaatgaacaagaggtcattcaaatacgcatgggttcttgacaaactaaaggctgagcgtgaacgcggtatcaccattgatattgctttgtggaagtttgagaccaccaagtactactgtactgttattgatgctcctggacatcgtgattttattaagaacatgattactggtacctctcaggctgattgtgctgttctgatcattgactcaaccactggtggttttgaagctggtatttccaaagatggtcagacacgtgaacatgctttgcttgcttttacccttggtgtgaagcaaatgatctgctgctgtaacaagatggatgccactactcctaagtactctaaggcaaggtatgatgaaattgtcaaggaagtctcatcctacctgaagaaggttgggtacaaccctgacaaaattccatttgtacccatttctggatttgagggtgacaacatgattgagaggtcaacaaaccttgactggtacaagggtccaactcttctggaagctcttgaccagattaacgaacccaaaagaccatctgacaagccacttcgtctaccacttcaagatgtgtacaagattggtggtattggaactgtgcctgttggacgtgttgaaactggtgtcatcaaacctggtatggttgtcacttttggtccatctgggttgaccactgaagttaagtcagttgagatgcaccacgaggcactgactgaagctctccctggtgacaacgttgggttcaacgtcaagaatgttgctgtcaaggatctgaagcgtggttatgttgcatccaactcaaaggatgaccctgctaagggtgcagccagtttcacctcacaggttattatcatgaaccaccctggtcagattggaaacggttatgccccagttctggattgccacacctctcacattgcagttaagttttctgagcttttgaccaaaatcgacagacggtctggtaaagagttggaaaaggagcccaaatttttgaagaatggtgatgcaggaatggttaagatgcttcccactaagcccatggttgttgagacttttgctgagtacccaccactcggtcggtttgctgttcgtgacatgcgtcagactgttgcagttggtgtgatcaagagcgtggagaagaaggacccaactggagctaaggtgaccaaggctgcagtcaagaagggagctaaatgatggggttggagcgttttgttatcgaatgatgatggagcttttatcgtattgtggaaccatctttattatgtttatttttggttaagaatttttggtgtttggtcttcatggtgcttgcatttctgtactctagcctcactttgtgaggatggtggaggtattg

SEQ ID NO: 723 - DNA, 1586 bp, Flaveria ramosissima
ttcttcgtcttcctccatccaccacacaagtcgtctgcatatcaatcgttaaggatgggtaaagaaaagacacacatcagtattgttgtcattggacatgtcgactccggcaagtccacaacaacaggacatttgatctacaagcttggaggtattgacaagagagtcatcgaaagattcgagaaggaggctgctgagatgaacaaaagatccttcaaatacgcctgggttcttgacaaacttaaggccgagcgtgaaagaggtatcaccattgatattgccttgtggaagtttgagacaaccaagtactactgcactgtcattgatgctcctggacatcgtgattttatcaagaacatgattactggtacttctcaggccgactgtgcggtgcttatcattgactccaccactggtggttttgaagctggtatctccaaggatggtcagacccgtgagcatgctcttcttgctttcacccttggtgtcaagcaaatgatttgctgctgtaacaagatggatgccacaacaccaaagtactccaaggcaaggtatgacgaaattgtgaaggaagtgtcatcgtacttgaagaaggtgggatacaaccctgacaaaatcccatttgttccaatctctggttttgaaggagacaacatgattgagaggtcgacgaaccttgactggtacaagggtccaacccttcttgaagctcttgaccagatcaatgagcccaagagaccatcagacaagcccctccgtcttccacttcaggacgtatacaagattggtggtattggaactgtgccagtgggacgtgttgagactggtgtgatcaagcctggtatggttgtcacttttggaccatctggattgaccactgaagttaaatctgttgagatgcaccatgaagctcttactgaggctcttcctggtgacaatgttgggttcaacgttaagaatgttgctgtcaaggatctcaagcgtggttatgttgcatcaaactccaaggatgacccggctaagggtgctgctagcttcacctcccaggttatcatcatgaaccaccctggtcagatcggtaacggttatgcacctgttcttgattgccacacctcccacattgccgtcaagttctctgagcttcttaccaagatcgacagacgatctggtaaggaacttgagaaggagcctaaattcttgaagaatggtgatgctggtatggtaaagatgcttcccaccaagcctatggttgttgagacttttgcagagtacccaccacttggtagatttgctgtgagagacatgcgtcaaacggttgctgtgggtgtgatcaagagtgtcgagaagaaggacccaacaggagccaaggttaccaaggccgcagtgaagaagggagccaagtgaggtggtcttgtcttatggtttaatggtgtatttttatttcaattgtttcatttactagttttggacttatattttcttgtgtagttttgttatttgatccttgagctttcattgttgtgtaaaggtttttgggttgcagactatttgttgttggtttaaatttatagtttgttggtctagct

SEQ ID NO: 724 - DNA, 1495 bp, Flaveria ramosissima
cttcgttaaggatgggtaaggaaaagacgcatatcagtattgttgtcattggacatgtcgactccggcaagtctaccactaccggacatcttatctacaagcttggtggtatcgacaagcgtgtgattgaaaggttcgagaaggaagctgctgagatgaacaagaggtccttcaaatacgcttgggtgctcgacaagctcaaggcagagcgtgaaagaggtattaccattgatattgccttgtggaagttcgagaccaccaagtactactgcactgtcattgatgctcccggacatcgtgatttcatcaagaacatgattactggtacctcccaagctgactgtgctgtcctcatcatagactcgacaactggtggttttgaggctggtatttccaaggatggtcagacccgtgagcacgcccttcttgctttcactcttggtgtcaagcaaatgatctgctgttgtaacaagatggatgccaccacaccaaaatactccaagtcgaggtatgaggaaattgtcaaggaagtttcttcatacttgaagaaggtcggatacaaccccgacaaaatcccatttgtgccaatctctggtttcgaaggagacaacatgattgagaggtcaaccaacctcgactggtacaagggtccgacccttcttgaagctcttgaccagatcaacgagcccaagagaccctcagacaagccactccgtctcccacttcaggacgtgtacaagatcggtggtattggaactgtgccagtgggtcgtgttgagactggtgtgatcaagcctggtatggttgtcaccttcggaccatctgggttgaccactgaagtcaagtctgttgagatgcaccatgaagccctaaccgaggctctccccggtgacaatgtcgggttcaacgtcaagaacgttgctgtcaaggatctcaagcgtggttacgttgcctcaaactccaaggatgatcctgccaagggtgcagccagcttcacctctcaggtcatcatcatgaatcacccaggccagattggtaacggttatgccccagttcttgattgccacacctcccacattgccgtcaagttctctgagcttttgaccaagatcgacagacgatccggtaaggagcttgagaaggagcctaagttcttgaagaacggtgatgctggtatggttaagatgcttcccaccaagcccatggttgtcgagacctttgctgaatacccaccacttggaaggttcgccgtgagagacatgcgtcagacagttgccgtcggtgttatcaagagcgtcgagaagaaggacccaaccggagccaaggtgaccaaggctgcagtgaagaagggagccaagtgaggtgaggtggtttgtggtttggtttatggagtattttatgttttgtcatttgatttactagttttgaactttattttgttgaggtagttttgtttgtttttcgattctttgaagctttcattaatattgtggaa

SEQ ID NO: 725 - DNA, 1511 bp, Flaveria ramosissima
acattcttcactttcctccatctaccttgagagatcgtctgcataatcttcgttaaggatgggtaaggaaaagacgcatatcagtattgttgtcattggacatgtcgactccgggaagtctaccaccaccggacatcttatctacaagcttggtggtatcgacaagcgtgtgatcgaaaggttcgagaaggaagctgctgagatgaacaagaggtccttcaaatacgcttgggtgctcgacaagctcaaggcagagcgtgaaagaggtattaccattgatattgccttgtggaagttcgagaccaccaagtactactgcactgtcattgatgctcccggacatcgtgatttcatcaagaacatgattactggtacctcccaagctgactgtgctgtcctcatcatcgactcgaccactggtggtttcgaggctggtatttccaaggatggtcagacccgtgagcacgctcttcttgctttcactcttggtgtcaagcaaatgatctgctgttgtaacaagatggatgccaccaccccgaaatactccaaggcaaggtatgatgaaattgtgaaggaagtttcttcatacttgaagaaggtcggatacaaccccgacaaaatcccatttgtgccaatctctggtttcgaaggagacaacatgattgagaggtccaccaacctcgactggtacaagggtcccacccttcttgaagctcttgaccagatcaacgagcccaagagaccctcagacaagccactccgtctcccacttcaggacgtgtacaagattggtggtattggaactgtgccagtgggacgtgttgagactggtgtgatcaagcctggtatggttgtcacctttggaccatctgggttgaccactgaagttaagtctgttgagatgcaccatgaagccctaaccgaggctctccccggtgacaatgttgggttcaacgtcaagaacgttgctgtcaaggatctcaagcgtggttacgttgcctcaaactccaaggatgatcctgccaagggtgcagccagcttcacctctcaggtcattatcatgaaccaccctggtcagatcggtaacggttatgccccagttcttgattgccacacctcccacattgccgtcaagttctctgagcttttgaccaagattgacagacgatctggtaaggagctcgagaaggagcctaagttcttgaagaacggtgatgctggtatggttaagatgcttcccaccaagcccatggttgtcgagacctttgctgaatacccaccacttggaaggttcgccgtgagagacatgcgtcagacggttgcagtcggtgttatcaagagcgttgagaagaaggacccgaccggagccaaggtgaccaaggctgcagtgaagaagggagccaagtgaggtgaggtggtttgtggtttggtttatggagtattttatgttttgtcatttgatttactagttttgaactttattttgttgaggagttttgttgtttttcgat

SEQ ID NO: 726 - DNA, 1460 bp, Flaveria ramosissima
cttcctccatctaccacacaagtcgtctgcagatcaatcgttaaggatgggtaaagaaaagactcacatcagtattgttgtcattggacatgtcgactccggcaagtccacaacaactggacacttgatctacaagcttggaggaattgacaagagagtcatcgaaagattcgagaaggaggctgctgagatgaacaaaagatccttcaaatacgcctgggttcttgacaaacttaaggctgagcgtgaaagaggtatcaccattgatattgccttgtggaagttcgagacaaccaagtactactgcactgtcattgatgctcctggacatcgtgactttatcaagaacatgattactggtacttctcaggccgactgtgcggtgcttatcattgattccaccactggtggttttgaagctggtatttccaaggatggtcagacccgtgagcacgctcttcttgctttcacccttggtgtcaagcaaatgatttgctgctgtaacaagatggatgccacaacaccaaagtactccaaggcaaggtatgacgaaattgtgaaggaagtgtcatcttacttgaagaaggtgggatacaaccctgacaaaatcccattcgttccaatctctgggttcgaaggagacaacatgattgagaggtcgacgaaccttgactggtacaagggtcctacccttcttgaagctcttgaccagatcaatgagcccaagagaccatcagacaagcccctccgtcttccacttcaggacgtgtacaagatcggtggtattggaactgtgccagtgggacgtgtcgagactggtgtgatcaagcctggtatggttgtcacttttggaccatctggattgaccactgaagttaagtctgttgagatgcaccatgaagctctgaccgaggctcttcctggtgacaatgttgggttcaacgttaagaatgttgctgtcaaggatctcaagcgtggttatgttgcgtccaactccaaggatgacccagctaagggtgctgctagcttcacctcccaggttatcatcatgaaccaccctggtcaaatcggtaacggttatgcacctgtacttgattgccacacctctcacattgctgtcaagttctctgaactgttgaccaagatcgacagacgatctggtaaggaacttgagaaggagcctaaattcttgaagaatggtgatgctggtatggttaagatgcttcccaccaagcctatggttgtcgagacttttgcagagtatccacctcttggtaggtttgccgtcagagacatgcgtcaaacggttgctgtgggtgtgatcaagagcgttgagaagaaggacccaacaggagccaaggttaccaaggccgcagtgaagaagggagccaagtgaggtggtttgtgttttggttaatggtgtattttatttcaatgtttcatttactagttttggactt

SEQ ID NO: 727 - DNA, 1424 bp, Flaveria ramosissima
tttcctccatctaccttgagaaatcgtctgcataatcttcgttaaggatgggtaaggaaaagacgcatatcagtattgttgtcattggacatgtcgactccgggaagtctaccactaccggacatcttatctacaagcttggtggtatcgacaagcgtgtgatcgaaaggttcgagaaggaagctgctgagatgaacaagaggtccttcaaatacgcttgggtgctcgacaagctcaaggcagagcgtgaaagaggtattaccattgatattgccttgtggaagttcgagaccaccaagtactactgcactgtcattgatgctcccggacatcgtgatttcatcaagaacatgattactggtacctcccaagctgactgtgctgttctcatcatcgactcgaccactggtggttttgaagccggtatttccaaggatggtcagacccgtgagcacgcgcttcttgctttcactcttggtgtcaagcaaatgatttgctgctgtaacaagatggatgccaccaccccgaaatactccaaggcaaggtatgatgaaattgtgaaggaagtttcttcatacttgaagaaggtcggatacaaccccgacaaaatcccatttgtgccaatctctggtttcgaaggagacaacatgattgagaggtccaccaacctcgactggtacaagggtcccacccttcttgaagctcttgaccagatcaacgagcccaagagaccctcagacaagccactccgtctcccacttcaggacgtgtacaagattggtggtattggaactgtgccagtgggacgtgttgagactggtgtgatcaagcctggtatggttgtcacctttggaccatctgggttgaccactgaagttaagtctgttgagatgcaccatgaagccctaaccgaggctctccctggtgacaatgttgggttcaacgtcaagaacgttgctgtcaaggatctcaagcgtggttacgttgcctcaaactccaaggatgatcctgccaagggtgcagccagcttcacctctcaggtcatcatcatgaaccaccctggtcagatcggtaacggatacgccccagttcttgattgccacacctcccacattgccgtcaagttctctgagcttttgaccaagatcgacagacgatctggtaaggagctcgagaaggagcctaagttcttgaagaacggtgatgctggtatggttaagatgcttcccaccaagcccatggttgtcgagacctttgctgaatacccaccactcggaaggttcgccgtgagagacatgcgtcagacggttgcagtcggtgttatcaagagcgtcgagaaaaaggacccgaccggagccaaggtgaccaaggctgcagtgaagaagggagccaagtgaggtgaggtggtttgtggtttggttatg

SEQ ID NO: 728 - DNA, 1474 bp, Flaveria ramosissima
cttcctccatccaccacacaagtcgtctgcagatcaatcgttaaggatgggtaaagaaaagactcacatcagtattgttgtcattggacatgtcgactccggcaagtccacaacaactggacacttgatctacaagcttggaggaattgacaagagagtcatcgaaagattcgagaaggaggctgctgagatgaacaaaagatccttcaaatacgcctgggttcttgacaaacttaaggccgagcgtgaaagaggtatcaccattgatattgccttgtggaagttcgagacaaccaagtactactgcactgtcattgatgctcctggacatcgtgactttatcaagaacatgattactggtacttctcaggccgactgtgcggtgcttatcattgattccaccactggtggttttgaagctggtatttccaaggatggtcagacccgtgagcacgctcttcttgctttcacccttggtgtcaagcaaatgatttgctgctgtaacaagatggatgccacaacaccaaagtactccaaggcaaggtacgacgaaattgtgaaggaagtgtcatcttacttgaagaaggtgggatacaaccctgacaaaatcccgttcgttccaatctctgggttcgaaggagacaacatgattgagaggtcgacgaaccttgactggtacaagggtccaacccttcttgaagctcttgaccagatcaatgagcccaagagaccatcagacaagcccctccgtcttccacttcaggacgtgtacaagattggtggtattggaactgtgccagtgggacgtgttgagactggtgtgatcaagcctggtatggttgtcactttcggaccatctggattgaccactgaagttaagtctgttgagatgcaccatgaagctcttactgaggctcttcctggtgacaacgttgggttcaacgttaagaatgttgctgtcaaggatctcaagcgtggttatgttgcatccaactccaaggatgacccagctaagggtgctgctagcttcacctcccaggttatcatcatgaaccaccctggtcaaatcggtaacggttatgcacctgttcttgattgccacacctcccacattgctgtcaagttctctgaacttttgaccaagatcgacagacgatctggtaaggaacttgagaaggagcctaaattcttaaagaatggtgatgctggtatggttaagatgcttcccaccaagcctatggttgtcgagactttcgcagagtatccaccacttggtaggtttgccgtcagagacatgcgtcaaacggttgctgtgggtgtgatcaagagcgttgagaagaaggacccaacaggagccaaggttaccaaggccgcagtgaagaagggagccaagtgaggtggttttgtgttttggctttatggtgtatttttattttcaatgtttcatttactagttttggacttatattttctt

SEQ ID NO: 729 - DNA, 1651 bp, Gerbera hybrid cultivar
aaaatctctctcaaatcggcgagcaagagagcttgccagcagattcttcgttaagtgtcattgatatttcataatgggtaaggaaaagattcacatcagcatcgtcgtcatcggacatgtcgactccggcaagtccacaaccaccggtcacctgatctacaagctaggaggtattgacaagcgtgtgatcgaaaggttcgaaaaggaagccgcagaaatgaacaaaagatctttcaagtacgcgtgggtccttgacaaactgaaggccgagcgtgaacgtggtatcaccatcgatatcgccctctggaagttcgaaaccaccaaatactactgcacagtcatcgatgctcctggacatcgtgatttcatcaagaacatgattactggaacctcccaggctgactgtgccgtccttatcatcgactctaccactggtggtttcgaagctggtatctccaaggatggacagacccgtgagcacgctctgcttgccttcactcttggtgtcaagcaaatgatctgctgctgtaacaagatggatgctactacacccaagtactcaaagtcccgatatgaggaaatcgtgaaggaagtttcttcgtacttgaagaaggttgggtacaacccagacaaaatcccgttcgtcccaatctctgggtttgaaggtgacaacatgattgagcgttcaaccaaccttgactggtacaagggcccaaccctgcttgaagcacttgaccagatcaacgagccaaagagaccttccgacaagccactccgcctcccacttcaggacgtttacaagattggaggcattggaactgtgccagttggacgtgtggagactggtgtgatcaagcctggtatggttgtcacttttggcccatctgggttgaccactgaagtcaagtcagttgagatgcaccacgaagctcttcaagaggctcttcctggtgacaatgttggatttaacgttaagaatgtggctgtgaaggatttgaagcgtgggtatgttgcttcgaactctaaagatgatccggcaaagggtgccgctaatttcacttctcaggttatcatcatgaaccacccgggccagattggtaacggttacgcaccggttcttgactgccacacgtctcacattgccgtgaagttttctgagcttttgaccaagattgatagacgatctggcaaggagctcgagaaggagcccaagtttttgaagaacggtgatgctggtatggttaagatgattccgaccaagccgatggttgttgagacctttgctgagtacccaccgttgggtcggtttgccgtgagggatatgcgtcagacagttgctgttggtgtgataaagagtgtggacaagaaggacccaactggagccaaggtgaccaaggcagcagtgaagaagggagccaagtgagaggaggttgtggttggttgttatggtgtctttttatttgatgttgttttgattactagttttgatgatgaaccttttataatttgttttaagagttttggtgtctggactgttttgttgtgggttaaatcttatagtggtctgccaaaatttgagtttgtagttggtcgtaaaacgcttttatatctgttatccacccaacttctatatcaaaaaaaaaaaaaaaaa

SEQ ID NO: 730 - DNA, 2681 bp, Gossypium raimondii
gctgatgtgagatgtcaagtatgagccgttggattatctttaatccaacgggtaagaaagaaaccctagttaaaccaaagttgaatcactggctacttaagctaaaggaggctgcctccctcacttgctttctactttcatttcggctattacgtggagagccttttttgtgtagcgattctcagttagtcttttctttaagcttacagcttctctccagagttttataatgggtaaggagaaggttcacatcaaccttgttgtcattggccatgtcgactctggcaagtcgaccactactggtcatttgatctacaagcttggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaaccactggtggttttgaagctggtatctctaaagatggtcagactcgtgagcatgctttgcttgcttttaccctcggtgttaggcagatgatttgctgctgcaacaagatggatgcaacaaccccaaagtactcaaaggcaaggtttgatgaaattgtcaaggaagtctcttcttatcttaagaaagttgggtacaaccctgagaagatcccgtttgttccaatctccggttttgagggtgacaacatgattgagagatctacaaacctcgattggtacaagggtcctactctccttgaggctcttgaccagatcaccgagcccaagaggccctcagataagccacttcgtcttccacttcaggatgtctacaagattggtggtattggaactgtccctgttggtcgtgttgaaactggtgtcctcaaacccggtatggttgttacttttggtcctactggtctgaccactgaagttaagtctgttgagatgcaccatgaatccctcccggaagctttccctggtgacaatgttgggttcaacgttaagaacgttgctgttaaggatcttaaacgtggttttgttgcttcaaactccaaggatgatccggccaaggaagctgccaacttcacctcacaggttatcatcatgaaccaccctggccaaattggaaatggttatgccccagtcctcgactgccacacctctcacattgctgtcaaattttctgagctgttgaccaagattgacagacgatctggcaaggaactcgagaaggaacccaagttcttgaagaacggtgatgcaggtatggtaaagatgattcccaccaaacccatggtggttgagactttctccgaatacccaccactcggacgttttgctgtccgtgacatgcgccagaccgttgctgtcggtgtcatcaagagtgttgagaagaaggacccaactggtgctaaggtcaccaaatctgctgccaagaagaaatgagagattatttcagagataattatatcagttttcattacagctttggacaattatcttaaatttggactttaaaatttactttttgtgagacttgttgatttgctttttaaacaaatcctagttttatattttaatgttttccaattctgagtgtttatatattatatcgattgcttccaatagcgacagagaattcacagccttcactgttcttttcagctgtgctctcacctgcgaataggtgaggcaaattttacatagctatactttttagtatggaacgatgaccaattaaaagttcggtttaattgatttgttttgatttttgatgtaatcgatttaatatcatgtttcaaattggcttgtttttatctgacggatttatttatttgtgattagtgtaaaaatgagattaaatataatatttaaatattgtagtggtattgtaacgtaagataaaaaattaatcgtattgtactagagataaacacatgttcaaagagatctttagttcgattcgataaattgagtatgaattttatattattattgaaactaatttatttgataaaaatgaaaatatttataattatataaaaaagttgtagtgattggtgatctgacaattttgcaaatatctcaagtttttgtggcagaaatccataggagaacatgaaaagataaggcgcactttctggtttgccaaaaactagagtttagaatcaatcagtagtctctttcaaagtttagtggcaaaaattaataattgccatttgttcactatgctattcctcaaccattgttctggatcgttgtggaacaatattctgataccaataatgtatccaaattacaaaaaaagaaaaagaaaaaaaaggggtcatacatatatatgcatttgggtgtttaaagataaatttacggtctatgaagattaatcagagcttgataatcaaagtaatattatattgaaacgcactgagcatcacgagtggatcgagatcatccatttcgccgactttccaacgtttacggtctcgatttgtttggagaacttgaacaaattgagtatgtaacctcaccaaattcttcctcatataacttccat

SEQ ID NO: 731 - DNA, 1695 bp, Carpinus betulus
acgctctcacattctgcctctctcgttgcttctcctcttccagggtcttaggttttctctctaagccgcctcagcctcttaagctagttttgtgatttagaatgggtaaagagaaggttcacattaacatcgtcgtcatcggccatgtcgactccggcaagtcgaccaccaccggccacttgatctacaagcttggaggaatcgacaagcgtgtgatcgagaggttcgagaaggaagccgctgaaatgaacaagaggtcattcaagtacgcctgggtgctcgacaagctcaaggccgagcgtgagcgtggtatcaccatcgatattgccttgtggaagttcgagaccaccaagtactactgcactgtcatcgatgctcccggacatcgtgactttatcaagaacatgattactgggacttcacaggccgactgtgctgtccttatcattgattccaccactggtggttttgaagctggtatttccaaggacggacagacccgtgaacacgctctccttgcctttacccttggtgtcaggcagatgatttgctgctgtaacaagatggatgcaactacccctaaatactccaaggcgaggtatgatgaaattgtgaaggaagtttcttcctacctgaagaaggttggttacaaccctgacaaaatcccatttgttcctatctctggtttcgagggtgacaacatgattgagaggtccaccaaccttgactggtacaagggcccaaccctccttgatgctcttgacctgctctctgaacccaagaggccctcagacaagcctcttcgactccctcttcaggatgtttacaagattggtggtattggaactgtcccagttggtcgtgttgagactggtatcatcaagcctggtatggttgtcacctttggcccaactggactaaccactgaagttaagtctgttgaaatgcaccacgaggcccttctggaggctttgccaggtgacaatgttggcttcaacgtcaagaacgttgctgtgaaggatctcaagcgtggttatgttgcatccaactcaaaggatgaccctgccaaggaagctgctaacttcacatctcaggtcattatcatgaaccaccctggtcagattggaaatggttacgccccagttctcgactgccacacctgccacattgctgtcaagtttgctgaacttgtcaccaagattgacaggcggtctggtaaggagatcgagaaggagcccaagtttttgaagaacggtgatgcagggattgtgaagatgattcccaccaagcccatggttgtcgagactttctccgagtacccacctcttggtcgttttgctgttagggacatgcgccagactgttgctgttggtgttatcaagagcgttgagaagaaggatccctctggtgctaaggtcaccaaatctgctgccaagaagaagtgaaagcggccacccattttcattgatgctgagaacaatttatatctctattactgtgtgttttttcaatttctagacggttttgtcgctagtattatctctattggttttatgtgttccatgtccggtcgtcgcacccagaactgggtgctagacaggcggtggtagcacattgccagtgttcgagtcctggagttttaacacccttttattgtggatgttgagttaatttaaatttaaggtttttaattta

SEQ ID NO: 732 - DNA, 1735 bp, Carpinus betulus
actcacattctgcctcactctctgccttttctctttcagggtttagggtttctctctcagccgccttagcctcttaagttgtttttgtgatttagaatgggtaaagagaaggttcacatcaacatcgtggtcatcggccatgtcgactccggcaagtcgaccaccacaggacacttgatctacaagcttggaggaatcgacaagcgtgtgatcgagaggttcgagaaggaagccgctgaaatgaacaagaggtcattcaagtacgcctgggttctcgacaagctcaaggccgagcgtgagcgtggtatcaccatcgatattgccctgtggaagttcgagaccaccaagtactattgcactgtcatcgatgctcccggacatcgtgactttatcaagaacatgattactgggacttcacaggccgactgtgccgtccttatcattgattccaccactggtggttttgaagctggtatttccaaggacggccagacccgtgagcacgctctccttgcctttacccttggtgtcaggcagatgatttgctgctgtaacaagatggatgcaactacccctaaatactccaaggcgaggtatgatgaaattgtgaaggaagtttcttcctacctgaagaaggttggttacaaccctgacaaaatcccatttgttcctatctctggtttcgagggtgacaacatgattgagaggtccaccaaccttgactggtacaagggcccaaccctccttgatgctcttgacctgctctctgaacccaagaggccctcagacaagcctcttcgacttcctcttcaggatgtttacaagattggtggtattggaactgtcccagttggtcgtgttgagactggtatcatcaagcctggtatggttgtcacctttggcccaactggtctaaccactgaagttaagtctgttgaaatgcaccacgaggctcttctggaggctttgccgggtgacaatgttggcttcaacgtcaagaacgttgctgtgaaggatctcaagcgtggttatgttgcatccaactcaaaggatgaccctgccaaggaagctgctaacttcacatctcaggtcattatcatgaaccaccctggtcagattggaaatggttacgccccagttctcgactgccacacctgccacattgctgtcaagtttgctgaacttgtcactaagattgacaggcggtctggtaaggagatcgagaaggagcccaagtttttgaagaacggtgatgcagggattgtgaagatgattcccaccaagcccatggttgttgagactttctctgagtacccacctcttggtcgttttgctgttagggacatgcgccagactgttgctgttggtgttatcaagagtgttgagaagaaggatccctctggtgctaaggtcaccaaatctgctgccaagaagaagtgaatggtgcgttcgcccattttcattgatgctgtgaacaatttatatctctattactgtgtggttttggaatttctagtcggttttgtctctagtcttatttatatgggttttatgtgttccatgtctggttgtctcacccagtactgggtgctagacaggcggtggcaacacattgccagtgtcgagtccgggagttttaacacccttttgttgtggatgttgagttaatttaaatttaagctttttaatttagaatattatatacctgtttttgactcctttttaaaagttgttt

SEQ ID NO: 733 - DNA, 1767 bp, Carpinus betulus
gggcacatagcgcttgccacccttacgcactcacattctgcctcactctctgccttttctctttcagggtttagggtttctctctcagccgccttagcctcttaagttgttttgtgatttagaatgggtaaagagaaggttcacatcaacatcgtggtcatcggccacgtcgactccggcaagtcgaccaccacaggacacttgatctacaagcttggaggaatcgacaagcgtgtgatcgagaggttcgagaaggaagccgctgaaatgaacaagaggtcattcaagtacgcctgggttctcgacaagctcaaggccgagcgtgagcgtggtatcaccatcgatattgccctgtggaagttcgagaccaccaagtactattgcactgtcatcgatgctcccggacatcgtgactttatcaagaacatgattactgggacttcacaggccgactgtgccgtccttatcattgattccaccactggtggttttgaagctggtatttccaaggacggccagacccgtgagcacgctctccttgcctttacccttggtgtcaggcagatgatttgctgctgtaacaagatggatgcaactacccctaaatactccaaggcgaggtatgatgaaattgtgaaggaagtttcttcctacctgaagaaggttggttacaaccctgacaaaatcccatttgttcctatctctggtttcgagggtgacaacatgattgagaggtccaccaaccttgactggtacaagggcccaaccctccttgatgctcttgacctgctctctgaacccaagaggccctcagacaagcctcttcgactccctcttcaggatgtttacaagattggtggtattggaactgtcccagttggtcgtgttgagactggtatcatcaagcctggtatggttgtcacctttggcccaactggactaaccactgaagttaagtctgttgaaatgcaccacgaggcccttctggaggctttgccaggtgacaatgttggcttcaacgtcaagaacgttgctgtgaaggatctcaagcgtggttatgttgcatccaactcaaaggatgaccctgccaaggaagctgctaacttcacatctcaggtcattatcatgaaccaccctggtcagattggaaatggttacgccccagttctcgactgccacacctgccacattgctgtcaagtttgctgaacttgtcactaagattgacaggcggtctggtaaggagatcgagaaggagcccaagtttttgaagaacggtgatgcagggattgtgaagatgattcccaccaagcccatggttgtggagactttctctgagtacccacctcttggccgttttgctgttagggacatgcgccagactgttgctgttggtgttatcaagagcgttgagaagaaggatccctctggtgctaaggtcaccaaatctgctgccaagaagaagtgaatggtgcgttggcccattttcattgatgctgcgaacaatttatatctctattactgtgtggttttggaatttctagtcggttttgtctctagtcttatttctatgggttttatgtgttccatgtctggttgtcgcacccagtactgggtgctagacaggcggtggcaacacattgccagtgtcgagtccgggagttttaacacccttttgttgtggatgttgagttaatttaaatttaagctttttaatttagaatattatatacctgttttgactcctttttaaaaattgttttgtagg

SEQ ID NO: 734 - DNA, 1857 bp, Medicago truncatula
ctcaattctcacaattctgttccttgcaaatcgactagggtttccgcagcgcagccttttctccttcgtctcaagatctttttgtggttttcagcttttaagaactaatgggtaaagaaaaggttcacatcaacattgtggtcattggccatgtcgactctgggaaatcaaccaccactggtcacttgatctacaagcttggaggtattgacaagcgtgtcattgagaggtttgagaaagaagctgctgagatgaacaagcgttcattcaagtatgcctgggtccttgacaagctcaaggctgaacgtgaaagaggtatcaccattgacattgctctctggaagtttgagacaaccaagtactactgcactgtcatcgatgcccccggacacagggatttcattaagaacatgatcaccggaacatcccaagctgattgtgccgttctcatcattgattccactactggtggttttgaagccggtatttctaaggatggtcagacccgtgaacatgctctccttgctttcactcttggtgtgaagcaaatgatctgctgttgcaacaagatggatgctactacacccaagtactccaagggtagatatgatgaaattgtgaaggaagtttcatcctatttgaagaaggttggctataacccagacaaaattccatttgttcccatctctggttttgagggagataacatgatcgagcgctctacaaaccttgactggtacaagggtccaacccttcttgaggcccttgaccaaatcaatgagcctaagaggccttcagacaagcccctccgactaccacttcaggatgtctacaagattggaggaattggaactgtgcctgtggggcgtgtcgagactggtgtcataaaacctggaatggttgtcacttttgcccctactggactgacaactgaagtcaagtccgtggagatgcatcatgaagctctcacagaggcccttcctggtgacaatgtgggatttaatgtcaagaatgttgctgttaaggatctcaagcgtgggtatgttgcctcaaactccaaggatgacccagccaaggaggctgctaactttacatctcaagtgatcataatgaatcaccctggccagattggaaatggctatgcccctgttcttgactgccacacctcccacattgctgtcaagtttgctgagcttgttactaagattgataggcgttctggtaaggagattgagaaggagcccaaattcttgaagaatggcgatgctggtattattaagatgattcccaccaagcccatggtggttgagactttctctgaatatcctccactcggccgttttgctgttagagacatgcgtcaaactgtggctgttggggtcatcaaggctgtggagaagaaggatcccagtggaggacttaagcagaccaagtcagcattgaagaagaagtgaaccgagcaggatgatctatttacttgggaagcatatcatagttattacaataaatggtctttggtccttagtatttctatttctcttctagtttacttgtttttcatattaagtgtcaagtctgcaccttcatctcttagcttgtgttctcagaactgggttctagatcgacggtggcagtactatatctgttttgtttttatgctttaattgttgtgtctagtctgaacacttggattttgtaagcaagcagtaagttccaggacttgctgactttgtttctaaatatcaactctttatttttgtgtttattccttggtgtgatgtttaagtttttgctggggcatggttctatatggtttaggcaattttgttgcctagaatgtcaggagcattttttaat

SEQ ID NO: 735 - DNA, 1730 bp, Medicago truncatula
ttctttgttgaatttgcagaactttttgtggttttaaacttttaaggacaatgggtaaggaaaaggttcacattaacattgttgtcattggccatgtcgactctgggaagtcaactaccactggtcacttgatctacaagcttggaggtattgacaagcgtgtgattgagaggtttgagaaagaagctgctgagatgaacaagcgttcattcaagtatgcttgggttcttgacaagctcaaggctgagcgtgaaagaggtatcacaattgacattgctctgtggaagtttgagaccactaagtactactgcactgtcattgatgcccctggacacagggatttcattaagaacatgattactggtacatcccaagctgattgtgctgttctcatcattgattccaccactggtggttttgaagctggtatttccaaggatggtcagacccgtgaacatgctctccttgctttcactcttggtgtgaagcaaatgatctgctgttgcaacaagatggacgccactactcccaagtactccaagagcaggtatgatgaaattgtgaaggaagtatcatcctacatgaagaaggttggctataacccagataaaattccatttgttcccatctctggttttgagggagataacatgattgagcgctctacaaatcttgactggtacaagggtccaacacttcttgaggctcttgatcaaatcaatgagcctaagaggccatcagacaagcccctccgactacctcttcaggatgtctacaagattggaggaattggaactgttcctgtgggacgtgttgagactggtgtcataaaacctggaatggttgtcacttttgcccctactggactgacaactgaagtcaagtccgtggagatgcatcatgaagctctcacagaggcccttcctggtgacaatgtgggatttaatgtcaagaatgttgctgttaaggatctcaagcgtgggtatgttgcctcaaactccaaggatgacccagccaaggaggctgctaactttacatctcaagtgatcataatgaatcaccctggccagattggaaatggctatgcccctgttcttgactgccacacctcccacattgctgtcaagtttgctgagcttgttactaagattgataggcgttctggtaaggagattgagaaggagcccaaattcttgaagaatggagatgctggtattattaagatgattcccaccaagcccatggtggttgagactttctctgaatatcctccactcggccgttttgctgttagagacatgcgtcaaactgtggctgttggggttatcaagggtgtggagaagaaggatcccagtggaggacttaagcagaccaagtcagcagccaagaagaaatgaaccgtgcaggatggtctatctacttgggaagtttatagtcgttattacaataaatggtttgtggttcttagtatttctatttcgtgtcttgttaagttgttttttggattaagtgtgaagtctgcaccgtcatctcccagcttttgttcccagaactgggttctagatcgacggtggcatgactagtttatttttcttgtttctgctttaattgtcttgtcttgtgtgaacacctgaattttacaagcagcaagtttccggacctgctgtttgtttttaatatcaactctatatctgcgtgtttattccttggtgtgatgtttaatctttgct

SEQ ID NO: 736 - DNA, 1687 bp, Cajanus cajan
ttgtgtttcttttaattaattacagtttaagtcatcatgggtaaggaaaaggttcacattaacattgtcgtcattggacatgtcgactctggaaagtcaaccaccaccggtcacttgatctacaagcttggaggtattgacaagcgtgtgattgagaggttcgagaaggaagctgctgagatgaacaagaggtcattcaagtacgcctgggtgctcgacaagcttaaggctgagcgtgaaagaggaattaccattgatattgctctgtggaaattcgagaccaccaagtactactgcacagtcattgatgctcctggacatcgtgactttatcaagaacatgatcactggaacctcccaggctgattgtgctgtccttatcattgattccactactggtggttttgaagctggtatttccaaggatggacaaacccgtgagcatgctctgcttgcctttacacttggtgtcaagcaaatgatctgttgctgtaacaaggtataagatttaggccaagtactctaaggctaggtatgatgaaattgttaaggaagtctcttcctacttgaagaaggttggttacaacccagacaagattccatttgttcccatctctggatttgagggtgacaacatgattgagaggtccaccaaccttgactggtacaagggaccaaccctccttgaggctcttgaccaaatcaacgagcccaagaggcccacagacaagcccctcaggcttccattgcaggacgtctacaagattggtggtattggtaccgtgccagttggaagagttgagaccggtgtcttgaagcccggtatggtggtgacttttggtcccactgggctgacaactgaagttaagtctgtggagatgcaccacgaggctctccaagaggctcttccaggtgacaatgtcggcttcaatgtgaagaacgttgcagtcaaggatctcaagcgtggtttcgttgcatccaactccaaggatgaccctgcaaaggaagctgccaacttcacatcccaggtcattatcatgaaccatcctggccagattggtaacggatacgcaccagtgctcgattgccacacctctcacattgctgtcaagtttgctgagctcgtgaccaagatcgacaggcgatctggtaaggagctcgagaaggagcccaagttcttgaagaatggtgatgcaggtttcgttaagatggttccaaccaagcccatggtggtggagactttctctgagtaccctcctcttggtcgttttgccgtgagggacatgcgtcaaaccgtggctgttggagtcatcaagagtgttgagaagaaagacccaaccggcgccaaggtcaccaaggctgcccagaagaagaaatgattgcttgtgtgtgatcatgttcatggttacagaaaaaccttgttctccctttatagtagtttatcattgcagagtcttaggtgtttgttttattttcaagtttctgccgatttcttgtagccataggtttcaaaactgggttcttgatcggcggtggtgaattttcattgcagttgtttttgggagttctgtttttgtttcgatgtaagagtcttccattttcgcaaagcagctatagggttttagtttattcctttgctgctgaggatgttttaattgcatttaattcataagaaagttttgtcaact

SEQ ID NO: 737 - DNA, 1674 bp, Plantago ovata
actcaaacacaaatttctctctacactcggaaaagcgagaaagctctctcactctcagctagtacactatgggtaaggaaaagtttcatatcaacattgttgtcattggccatgtcgattctggaaaatcgaccaccactggtcacttgatctacaagttgggaggtattgacaagcgtgtcattgagaggttcgagaaggaggctgctgagatgaacaaaaggtcattcaagtatgcctgggtgctcgacaagcttaaggccgagcgtgaacgtggtatcactattgacattgccttgtggaagttcgagaccaccaagtactactgcacagtcattgatgcccctggacatcgtgatttcatcaagaacatgattactggtacctcacaggctgactgtgctgttctcattattgactccaccactggaggttttgaagctggtatctccaaggatgggcagacccgtgagcatgcgttgcttgctttcactcttggagtcaagcaaatgatttgctgttgtaacaagatggatgctaccacacccaagtactccaagtctaggtacgatgaaattgtcaaggaagtgtcctcctacctaaagaaggttggatacaacccagacaaaattgcattcgtgcccatttctggattcgagggagacaacatgattgagaggtccacaaacctcgattggtacaagggtcctacccttctagaggctcttgacaacatctctgagccaaagaggccatcagacaagccccttcgtctacctcttcaggatgtgtacaagattggtggtattggaactgtgccagttggacgtgtggagactggtgtcatcaagcctggtatggttgttacctttggccccactggtttgacaactgaagttaagtctgttgagatgcaccacgagtccatgccagaggctcttcctggtgacaatgttggatttaacgttaagaatgttgctgtcaaggatctgaagagaggttatgttgcctccaactccaaggatgaccctgccaaggaagctgctaacttcacttcccaggtcatcatcatgaaccaccctggccagattggacaaggttatgccccagtgctcgactgtcacacttcccacattgctgtcaagtttgctgaacttgtcaccaagattgacaggcgatctggtaaggagctcgagaaggagcccaagtttttgaagaatggtgatgctggtatggttaagatgattccaaccaagcctatggttgtggagacctttgctgagtacccaccattgggtcgttttgctgttcgtgacatgaggcaaactgttgctgttggtgtcatcaagaatgttgagaagaaagacccatcaggtgccaaggttactaaggccgctgccaaaaaaggtgccaagtgaggatgctgcttgttctcgttttcatgctttagttttcaattttgtttttttggacaagttctgcttttgtttatggtggaaggatgttttctggatatttggcctgcgttttgttttggattttgagatgtagacatcttgcaccatagttctatccaacttaaattttcgtttatttggtgaataatgcttttgagtttcttccagaatgagtttcatacaaagatatgtacagaagttgtcggaaacattaaga

SEQ ID NO: 738 - DNA, 1553 bp, Plantago ovata
cggccgggggacattttctcgcctcgctctcttactcaaacacaaatttctctctaccctcggaaaagcgagaaagctctctcactctcagctagaatactatgggtaaggaaaagtttcacatcaacattgttgtcattggccatgtcgattctgggaaatcgaccaccactggtcacttgatctacaagttgggaggtattgacaagcgtgtcattgagaggttcgagaaggaggctgctgagatgaacaaaaggtcattcaagtatgcctgggtgctcgacaagcttaaggccgagcgtgaacgtggtatcactattgacattgccttgtggaagttcgagaccaccaagtactactgcacagtcattgatgcccctggacatcgtgatttcatcaagaacatgattactggtacctcacaggctgactgtgctgttctcattattgactccaccactggaggttttgaagctggtatctccaaggatggtcagacccgtgagcatgcgttgcttgctttcactcttggagtcaagcaaatgatttgctgttgtaacaagatggatgctaccacacccaagtactccaagtctaggtacgatgaaattgtcaaggaagtgtcctcctacctaaagaaggttggatacaacccagacaaaattgcattcgtgcccatttctggattcgagggagacaacatgattgagaggtccacaaacctcgattggtacaagggtcctacccttctggaggctcttgacaacatctctgagccaaagaggccatcagacaagccccttcgtctacctcttcaggatgtgtacaagattggtggtattggaactgtgccagttggacgtgtggagactggtgtcatcaagcctggtatggttgttacctttggccccaccgggttgacaactgaagttaagtctgttgagatgcaccacgagtccatgccagaggctcttcctggtgacaatgttggatttaacgttaagaatgttgctgtcaaggatctgaagagaggttatgttgcctccaactccaaggatgaccctgccaaggaagctgctaacttcacttcccaggtcatcatcatgaaccaccctggccagattggacaaggttatgccccagtgctcgactgtcacacttcccacattgctgtcaagtttgctgaacttgtcaccaagattgacaggcgatctggtaaggagctcgagaaggagcccaagtttttgaagaatggtgatgctggtatggttaagatgattccaaccaagcctatggttgtggagacatttgctgagtacccaccattgggtcgttttgctgttcgtgacatgaggcaaactgttgctgttggtgtcatcaagaatgttgagaagaaagacccatcaggtgccaaggttactaaagccgctgccaaaaaaggtgccaagtgaggatgctgcttgttctccatttcatgctttagttttcatttttgattttttggacaagttctgcttttgtttatggtggaaggatgttttctggatatttgg

SEQ ID NO: 739 - DNA, 1856 bp, Platanus occidentalis
ttaaaatctagaaatttgtcatgggtaaggagaaggttcacattaacattgtggtcattggccatgttgactctggtaagtcgaccactactggacatcttatttataagcttggaggaattgacaagcgtgtgattgagagattcgagaaggaggctgctgagatgaacaagaggtcattcaagtatgcctgggtgttggacaagctcaaggccgagagggagcgtggaattaccattgatattgctctgtggaagtttgagaccaccaagtactactgcactgtcattgatgctcctgggcatcgtgacttcattaagaacatgattactggtacttcccaagctgactgtgctgtcctcatcattgattctaccactggtggttttgaagctggtatctccaaggatggccagactcgtgagcatgccctccttgccttcacgcttggagtcaagcagatgatttgctgctgtaacaagatggatgcaactaccccgaagtactccaaggcaaggtatgaagaaattgtgaaggaagtctcatcctacttgaaaaaagtgggttacaaccctgataagatcccctttgtccccatctctgggtttgagggtgacaacatgatcgagaggtccaccaaccttgactggtacaagggcccaacccttcttgaggctcttgacttgatcctggagcccaagaggcccacagacaagccccttcgtctcccactccaggatgtttacaagattggtggtattggcactgtccctgtgggtcgtgttgagactggtgtgctcaagcctggtatggttgtgacctttggccccactggactgaccactgaagttaagtctgtggagatgcaccatgaggctctccaggaggccctgcccggagacaatgttggcttcaatgtgaagaacgttgctgtcaaggatctcaagcgtggttttgttgcttccaactccaaggatgatcctgccagggaggctgccaacttcacctcccaggttatcatcatgaaccaccctggccagatcggaaacggttatgccccagtgctcgactgccacacctctcacattgctgtgaagttttctgagatcctgaccaagatcgacaggcgatctggtaaggaacttgagaaggagcccaaatttttgaagaatggtgatgctggttttgtgaagatgatcccaactaagcccatggtggtggagaccttctccgagtatcccccacttggtcgttttgctgtgagggacatgcgccagaccgttgctgttggagtcatcaagagtgtggagaagaaggatccctctggagccaaggtcactaagtcggcagccaagaaaaagtgaaccgtgcaggttgctgaagaagctgaaaatattgatagcaatcgtaaagacttggtacttagtagtagtgttttcaaatgtttaattggtcggtttgttggctacagtttgctgttgtctcctaagggtagctgctcccagaattgggtgctcgacaggcgatggcaggagtattacctggattgtctgcggtctcctactctacctagtctctgtcatttcttttcttggtgaaagttgagagacaaattggaatttctaagcagcagctcagtgagtttttaggtttggtgctcctgggttgctcggatgtgttattttattactttgtggttattatataggtcttgttaatggtcaataacatgctctcttataattcaggttacaagggattttcatattagtctgaatactgaatctgcttcactaggttaaaaaaaaaaaaaaaaacaaactagtagtgtggcggctctcagagcacaggaggag

SEQ ID NO: 740 - DNA, 2027 bp, Papaver somniferum
ataccgtaagtccattgaataactgtccgaagtcgtagctttttagggttgtgttgaatagaagttgaacgccattccttgtaatctccgaggttaaagaagtcattataagcttagtacaacagtagtggaggccacgataaacaagggcatctcacaactttaatatcaatgccgaccacatggagtagataggtatcaacggtcactaacgagctatttaaatccagatacatttggataaaacgtgatccaacgaactagaaagaaaccctaatctcatttggagggtttataggctgagacgcctcctatttttcagtctctacaaatttgttaagctctactcggagctttcaatctcgatttcaaatctcagtcaatttctaagaattcaatatgggtaaagagaaagttcatatcaacattgtcgtcattggacatgtcgactctggaaaatcgaccaccactggtcacttgatctacaagctaggaggtattgacaagcgtgtgatcgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagtcattgatgccccaggacatcgtgatttcatcaagaacatgattactggtacctctcaggctgattgtgccgtccttatcattgactccaccactggaggttttgaggccggtatctccaaggatggacagactcgtgagcacgctcttcttgctttcacccttggtgtcaagcagatgatctgttgttgtaacaagatggatgccaccacccccaagtactcaaagggtaggtacgaagaaattgtaaaggaagtctcttcatacttgaagaaggttggatacaacccagacaaaattgccttcgtccccatctctggtttcgagggagacaacatgattgagaggtccaccaaccttgactggtacaagggaccaactcttctcgaggctcttgacaacatctctgagcctaagagacccacagacaagccccttcgtcttccccttcaagatgtttacaagattggaggtattggaactgtgccagtgggacgtgttgaaactggtttcatcaagcctggtatggttatcacttttggacccactgggttgactactgaagttaagtctgttgagatgcaccacgaggctctcctagaagctcttccaggtgacaatgttggattcaatgtcaagaatgttgctgtgaaggatctcaagcgtggtttcgtcgcttcaaactccaaggatgaccctgctaaggaagcagccaacttcacctcccaggtcatcatcatgaaccatcctggccagatcggtaacggttatgccccagtccttgactgtcacacatctcacattgctgttaagttctctgaaatcctcaccaagatcgacaggcgatctggaaaggagctcgagaaggagcccaagttcttgaagaatggtgatgctggtattattaagatgattccaaccaagccaatggttgtggagaccttctctgagtatccacctcttggtcgttttgctgtcagagacatgaggcagactgttgctgttggtgttatcaaggctgttgagaagaaagacccaaccggagccaaggtcaccaagtctgctgttaagaagaaatagatgtgttactggagatttgagttggcaacagcagggttttccagtatgctcaattttgttatgatgcttctacatgtgtcataggcttttatcatttttcatgttttgtatttcaaggattttgaacttcattgaggattctaggtgctaatctagttttgccttgttgtttgctgcaagatgattggttcttgtttgatgaaccaagttttactttggtatattgaactctgatttaaaatttgaaggataatagatcttagttgtgacctgctttaaattaa

SEQ ID NO: 741 - DNA, 1628 bp, Papaver somniferum
aaaaagctctgtgccgctgagctttatctagtcaccgtttcagttaatttctaagaattcaatatgggtaaagagaaggttcatatcaacattgttgtcattggacatgtcgactctggaaaatctaccacaactggtcacttgatctacaagcttggaggtattgacaagcgtgttattgaaagattcgagaaggaggctgctgagatgaacaagaggtcattcaagtatgcatgggttcttgacaagcttaaggctgaacgtgagcgtggtattaccattgatattgccttatggaagtttgagaccaccaagtactactgcacagttattgatgctcctggacatcgtgactttatcaaaaacatgattactggtacttctcaggctgattgtgctgtcctcatcatcgattctacaactggaggtttcgaggctggtatctcaaaggatggtcagactcgtgagcacgcccttcttgctttcacccttggtgtcaagcagatgatctgttgttgtaacaagatggatgccaccacccccaagtactcaaaggctaggtacgatgaaattgtaaaggaggtctcatcttacttgaagaaggttggatacaacccagacaaaattgcctttgttcctatctctggattcgagggagacaacatgattgagaggtccaccaaccttgactggtacaagggtccaactctccttgaggctcttgacaatatctctgagccaaagagaccctcagacaagccccttcgtcttccacttcaggatgtttacaagattggaggtattggaactgtgccagtgggacgtgttgaaactggattcatcaagcctggtatggttgttacttttggacccaccgggttgaccactgaagttaagtctgtggagatgcaccacgaagcccttcaagaagctcttccaggagacaatgttgggttcaatgtcaagaatgttgctgtgaaggatctcaagcgtggtttcgtcgcctccaactccaaggatgaccctgccagggaagcagccaacttcacctcccaggtcatcatcatgaaccatcctggtcagatcggtaacggttatgccccagttcttgactgtcacacatctcacattgctgttaagttcgctgagatcctcaccaagattgataggcgatctggaaaggagcttgagaaggagcccaagttcttgaagaatggtgatgctggtattattaagatgcttccaacaaagcccatggttgttgagaccttctctcagtacccacctcttggacgttttgctgttagggacatgaggcagacagttgctgttggtgtcatcaaggaagttgagaagaaggacccaacaggagccaaggttaccaagtctgctgtcaagaagaaatgaagtgtgctgccaaggttacctagagggatggtgctaagaggatctacaggaggaacttgtctttatttctttgctattagtcagttttgctttttgttggttaggtatatgtgcagtctttggttttgttggtcctttgttttgttgcgcagtccggatggctaaaccgtgggtgcttgacgaggcggtggcaaacgaagacggttgggctggttctagtt

SEQ ID NO: 742 - DNA, 1694 bp, Papaver somniferum
ctgcggagcttttcttatcgccgttctgttattttctaagaattcaatatgggtaaagagaaggttcacatcaacattgtcgtcattggacatgtcgactctggtaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgccgtcctcattattgattccaccactggaggttttgaggctggtatctcaaaggatggtcagactcgtgagcatgctcttcttgctttcacccttggtgtcaagcagatgatctgttgttgtaacaagatggatgccaccacccccaagtactcaaaggctaggtacgatgaaattgtcaaggaggtctcatcttacttgaagaaggttggatacaacccagaaaaaattgcatttgttcctatctccggattcgagggagacaacatgattgaaaggtccaccaaccttgactggtacaagggaccaactctccttgaggctcttgacaacatctctgagccaaagagaccctcagacaagccccttcgtcttccccttcaggatgtttacaagattggaggtatcggaactgtgccagttggacgtgttgaaactggagtcatcaagcctggtatggttgttacctttggacccaccggtttgaccactgaagttaagtctgtggagatgcaccacgaagcccttctagaagctcttccaggagacaatgttgggttcaatgtcaagaatgttgcagtgaggatctcagcgtggtttcgtcggctccaactcaaaggatgaccctgccagggaagctgccaacttcacctcccgaggtcatcatcatgaaccatcctggtcagatcggtaacggttatgctccagttcttgactgtcacacatctcacattgctgttaagttcgctgagatccaaaccaagatcgataggcgatctggaaaggagcttgagaaggagcccaagttcttgaagaacggtgatgctggtattattaagatgattccaaccaagcccatggttgtggagaccttcgctcagtacccacctcttggacggtttgctgttagggacatgaggcagacagttgctgttggtgtcatcaagggagttgagaagaaggacccaacaggagccaaggttaccaagtccgctgtcaagaagaaatgaagtgtgctgccaaggttaactagagggatggtgctaggggggtctataggaggaacttctctttattgctttactactagtcagtttcatttttgctttttgtttgttaggtatctgtgcagtctcttgttttgtatggcttttgttttgttgcgtgtccggatgcaaacctgggtgcttgacaggcggtggcaacaagatgttaggctgttcagtttaagttcctttaaaaacatgtttgattttgggttttcaattcacaacttttttcttgcttaacctgttaattgaaaatggtgtttg

SEQ ID NO: 743 - DNA, 1815 bp, Papaver somniferum
tctaatcgccgtttcagttaatttctaagaattcaatatgggtaaagagaaggttcacatcaacattgtcgtcattggacatgttgactctggtaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgattttatcaaaaacatgattactggtacttctcaggctgattgtgccgtcctcattatcgattctaccactggaggttttgaggctggtatctcaaaggatggtcagactcgtgagcatgctcttcttgctttcactcttggtgtcaagcagatgatctgttgttgtaacaagatggatgccaccacccccaagtactcaaaggctaggtacgatgaaattgtgaaggaggtctcatcttacttgaagaaggttggatacaacccagacaaaattgcctttgttcccatctctggattcgagggagataacatgattgagaggtccaccaaccttgactggtacaagggaccaactctccttgaggctcttgacaatatctctgagccaaagagaccctcagacaagccccttcgtcttccacttcaggatgtttacaagattggaggtattggaactgtgccagtgggacgtgttgaaactggattcatcaagcctggtatggttgttacttttggacccaccgggttgaccactgaagttaagtctgtggagatgcaccacgaagcccttcaagaagctcttccaggagacaatgttgggttcaatgtcaagaatgttgctgtgaaggatctcaagcgtggtttcgtcgcctccaactccaaggatgaccctgccagggaagcagccaacttcacctcccaggtcatcatcatgaaccatcctggtcagatcggtaacggttatgccccagttcttgactgtcacacatctcacattgctgttaagttcgctgagatcctcaccaagattgataggcgatctgggaaggagcttgagaaggagcccaagttcttgaagaatggtgatgctggtattattaagatgcttccaaccaagcccatggttgttgagaccttctctcagtacccacctcttggacgttttgctgttagggacatgaggcagacagttgctgttggtgtcatcaaggaagttgagaagaaggacccatcaggagccaaggttaccaagtctgctatcaagaagaaatgaagtgtgcttttaactagagggatggtgctaggaggatcatcaggagggacttgtctttgcttcattattattagtcagtttcgtttttgctttttgttggttaggtatctgtgcagtctcctgttttgtattgcttttgttttgttgcgcatccggatgcaaacctgggtgcttgacaggcggtggcaacaggatgttaggctgctcagttgaagttcctttaaatacttaagtttgattttgggttttcaagtttctgttcacaagttttacttgcttaaccctggtaactgaaaaccgtatttggtagttattgtctgtggagctgtaccttaagtgccttcttgttttgtgttgtgtgtcatatttttagaagactgcagatttttagcactgattcactttggtggacgcctgcaatgctgtgccattgc

SEQ ID NO: 744 - DNA, 1400 bp, Papaver somniferum
cggagcttatctaattcggcgtttcagttaatttctaagaattcagtatgggtaaagagaaggttcacatcaacattgtcgtcattggacatgtcgactctggaaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatatcgccttgtggaagtttgagaccaccaagtactactgcacagttattgatgctcctggacatcgtgactttatcaaaaacatgattactggtacttctcaggctgattgtgctgtcctcattattgattctaccactggaggttttgaggctggtatctcaaaggatggccagactcgtgagcacgctcttcttgctttcacccttggtgtcaagcagatgatctgttgttgtaacaagatggatgccaccacccccaagtactcaaaggctaggtatgatgaaattgtcaaggaggtctcatcttacttgaagaaggttggatacaacccagacaaaattgcctttgttcctatctctggattcgagggagacaacatgattgagaggtccaccaaccttgactggtacaagggaccaactcttctcgaggctcttgacaatatctctgagccaaagagaccctcagacaagccccttcgtcttccccttcaggatgtttacaagattggaggtattggaactgtgccagtgggacgtgttgaaactggattcatcaagcctggtatggttgttacctttggacccactgggttgaccactgaagttaaatctgtggagatgcaccacgaagcccttcaagaagctcttccaggagacaatgttgggttcaatgtcaagaatgttgcagtgaaggatctcaagcgtggttttgtcgcctccaactccaaggacgaccctgccagggaagctgccaacttcacctcccaggtcatcatcatgaaccatcctggtcagatcggtaacggttatgccccagtccttgactgtcacacatctcacattgctgttaagtttgctgagatcctcaccaagattgataggcgatctggaaaggagcttgagaaggagcccaagttcttgaagaatggtgatgctggtatcattaagatgcttccaacaaagcccatggttgtagagaccttctctcagtacccacctcttggtcgttttgctgttagggacatgaggcagacagttgctgttggtgttatcaaggaagttgagaagaaggacccaacaggagccaaggttaccaagtctgctgtcaagaagaaatgaagtgtgctg

SEQ ID NO: 745 - DNA, 1377 bp, Secale cereale
aggtgtacacgcagacgtacagtcgggactacctcccctcgcccgccgccgccgcctcctcctcctctcggctccttctccttcattcgagtttcagccatgggtaaggagaagactcacatcaacattgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtacgcctgggtgcttgataagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggtccccttcgtccccatctctgggtttgagggtgacaacatgattgagaggtccaccaaccttgactggtacaagggccctaccctgcttgaggcgcttgaccagatcaacgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggtcaagtctgttgagatgcaccatgagtctctcctggaggcgcttcctggtgacaacgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacggttgctgttggtgtcatc

SEQ ID NO: 746 - DNA, 1301 bp, Secale cereale
caatcgtggtcgattggccgatgtcgactctggcgaagtcgaccaccactggccatctgatctacaagcttggaggtatcgacaagcgtgtgatcgagaggttcgagaaggaagccgctgagatgaacaagaggtcgttcaagtacgcctgggtgcttgacaagctgaaggccgagcgtgagaggggtatcacaattgatattgccctgtggaagttcgagaccaccaagtactactgcaccgtcattgactgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgctttgctgtgcgtgacatgagacaaacggttgctgttggtgtcatcaagggcgtggagaagaaggaccccaccggtgccaaggttaccaa

SEQ ID NO: 747 - DNA, 1981 bp, Silene vulgaris
atacttcttcttctctctcatcaatttctagggtttccgtctaatcttcttcagcttttgataagaagttatcatgggtaaggaaaagattcatatcagtattgtcgtcattggacatgtcgactctggcaagtccacaaccactggtcatttgatctacaagcttggaggtattgacaagcgtgttattgagaggttcgagaaggaagctgctgagatgaacaagaggtctttcaagtatgcctgggttcttgacaagcttaaggctgaacgtgagcgtggtatcaccatcgatattgccttgtggaagtttgagaccactaagtactactgcacagtcattgatgcccctggacatcgtgatttcatcaagaatatgatcactggtacttcccaggcagattgtgctgtcctcattatcgattccaccactggtggttttgaagctggtatctccaaggatggtcagacccgtgagcatgcacttcttgctttcacccttggtgtcaagcaaatgatctgttgtcttaacaagatggatgccaccactcccaagtactcaaagtcccgttatgaagaaatcgtgaaggaagtcagttcataccttaagaaggttgggtacaatcccgacaaggtcccattcgttcccatctccggatttgagggtgacaacatgattgataggtccaccaaccttgactggtacaagggaccaacccttcttgaggctcttgaccaggtttcagagcccaagaggccctcagacaagccacttcgtcttccactccaggatgtctacaagattggtggtattggaacggtgcctgttggacgtgttgagactggaatcatcagacccggtatgcttgtgactttcggcccaactgggttgaccactgaagttaagtctgttgagatgcaccacgagtccatgcccgaggctctccctggtgacaatgttggtttcaatgtgaagaatgttgctgtcaaggatctcaagcgtggttttgttgcttctgactcaaagaatgaccctgccaaggaggccgccaacttcacatcacaggtcattatcatgaaccaccctggccagatcggtaacggatatgccccagttctcgattgccacacctcccacattgctgtcaagtttgctgagcttgtcaccaagatcgacaggcgatcaggtaaggagcttgagaaggaacccaagttcttgaagaacggagatgctggtatggttaagatgattcccaccaagcccatggttgtcgagaccttctctgagtacccaccccttggccgtttcgccgtcagggacatgaggcagaccgttgctgttggtgttatcaagaatgttgagaagaaagaccccactggagccaaggtcaccaaggctgctcttaagaagaaatgattttgtcagtcggttgcatcagctggcatgggttttatcagtaggcctttgttttgctattttcatgttttggttgttgttatcgaactgttgtcttcgttgtcttcaggcatctgttctcagaattgggtgcttgataggcgatggtatctctcgttttgagttttaatattttgagtctagtattgggttgtcccaataactcttgatgttttcggattatcaggtttatgtcctcatttagaactacatttttcatgttttatacgtggtgtgtgcttgctttctgctctctttcttccgtctttcgtattagttctttattcttgattaatagagcacttgatagtgtttcaaaccttcactggtatgaacacttgagtgcttctgcaatttctctacttttaggagaaattgatgcaaccttcggcaagtgcaattttttttgatatccacttgagtttctcgagtatactgaatccgttgttaactttgctaagttatagtcttgtggtcttgtagaagataagccacaggatatgggcctgtaattcttctgctaac

SEQ ID NO: 748 - DNA, 1489 bp, Silene vulgaris
taaggaaaagattcacatcagtattgtcgtcattggacatgtcgactctggcaagtccaccactactggtcacttgatctacaagcttggtggtattgacaagcgtgttatcgagaggttcgagaaggaagctgctgagatgaacaagaggtctttcaagtatgcttgggtgcttgacaagctcaaggccgagcgtgagcgtggtattaccattgatattgccttgtggaagtttgagaccaccaaatactactgcacagtcatcgatgctcctggtcaccgtgactttatcaagaacatgattactggaacctcccaggctgattgtgctgtcctcattattgactccaccactggaggttttgaggctggtatctctaaggacggtcagacccgtgagcatgctcttcttgctttcacccttggtgtcaagcagatgatctgttgtcttaacaagatggatgccaccactcccaagtactcgaagtccaggtatgaggaaattgtgaaagaagtcagttcatacctgaagaaggttgggtacaacccagacaaggttccatttgttcccatctctggttttgagggtgacaatatgattgagaggtccaccaaccttgactggtacaagggtcctacccttcttgaggctcttgaccaggtttctgagcccaagaggccctcagacaagcccctacgacttccacttcaggatgtttacaagattggaggtattggaacggtgcctgtcggacgtgttgagactggtgtcatcaggcctggtatgcttgttacctttggtccaactgggttgaccactgaggtaaagtctgttgagatgcaccacgagtccatgcctgaggccctcccaggtgacaatgttggattcaatgttaagaatgttgcagtcaaggatctcaagcgtggttttgtcgcctctgactcaaagaatgaccctgctaaggaggcagccaacttcacatcacaggtcatcatcatgaaccaccctggccagatcggaaacggttatgccccagtcctcgactgccacacctctcacattgctgtcaagtttgctgagcttgtcaccaaaattgacagacgatcaggaaaggagttggagaaggagcccaagttcttgaagaatggtgatgctggtatggttaagatgattcccacaaagcccatggttgtggagaccttctcagagtacccacctcttggtcgtttcgctgtgagggacatgaggcagactgtggccgttggtgtcatcaagaatgttgagaagaaggatcccacaggtgccaaggtcaccaaggctgctttgaagaagaaatgagtttgggaggctgttgcaccgtattacttgcttgttcagtagggatttattttgctattttcattttctagtttttaaacaattggcttcaccgtatctggcatctattctcagaattgggtgctagagtgacgctggtatacctgttga

SEQ ID NO: 749 - DNA, 1722 bp, Solanum phureja
taaattctccctcatttttcaacttattatatgtgctgtgcttctcaagacttttagttgatcaacatgggtaaagagaaggttcacatcaacattgtggttattggccatgttgactctggaaaatctaccaccactggtcacttgatctacaagctaggtggtatcgacaaacgagtcatcgagaggtttgagaaagaagctgctgagatgaacaagaggtcattcaagtatgcctgggttcttgacaagcttaaggctgaacgtgaacgcggtatcactattgatattgccttgtggaagtttgagactaccaagtactactgtactgttattgatgctcctggtcatagggatttcatcaagaacatgattactggtacctctcaagctgactgtgctgtcctgattatcgactccacgactggtggttttgaagctggtatctctaaggatggacagactcgtgaacatgcgttgcttgctttcacacttggtgttaggcaaatgatttgctgctgcaacaagatggatgctaccacacctaagtactccaaggctaggtacgatgaaattgtgaaggaagtgtcttcttaccttaagaaggttggttacaaccctgacaagatcccatttgtgcccatttctggtttcgaaggagataatatgattgagagatcaactaacctagactggtacaagggtccaacacttcttgaggctcttgaccagcttaatgaacctaagaggccctcggacaaaccccttcgtcttccacttcaggatgtctataagattggtggtattgggactgtccctgtaggtcgtgttgaaactggtgtcatcaagcctggtatggttgtgacttttggtcctactggtctgactactgaagttaagtctgttgagatgcatcatgaagctcttcaggaggcacttcctggtgacaatgttggtttcaacgtcaagaatgttgcggttaaggatcttaagcgtggatttgttgcttccaactccaaggatgacccagctaagggggctgctagcttcaccgctcaggtcatcatcatgaaccatccaggacagattggaaatggatatgctccagtgctggactgtcacacctcccatattgctgtcaagtttgctgagatcttgactaagattgacaggcgttctggtaaggaactcgagaaggagcctaagttcttgaagaacggtgatgctggtatggttaagatgattcccaccaagcccatggttgttgagaccttctccgagtacccaccattggggcgttttgctgtgagggacatgcgtcaaactgttgctgttggtgttatcaagagtgttgacaagaaggacccatctggagccaaggtcaccaaggctgctcagaagaaaaaatgaatggtgcagttcaactctggagtacccagagatatcgatatctactataataaagtgtgttacgaaaacttgctatgctttactcttcctgttcatgttcagtcttttatgttgttgggttcttgttttctgccttgtatgtcaggtatcctttcccagaactgggtgcttgacagacggtggcaaaatacatagttccagtcgtttggtttttctttagaggtgtcttggtccatccaagacgtctctaaagatatgtttatttgtgtttcttataatacgtaaatcgtacttttctgtctttgtgctgat

SEQ ID NO: 750 - DNA, 1731 bp, Glycine max
ctcttcactccttcgttcactcttcttctcttgcggctagggttttagcgcagcttcttctagatttaaggaagatgggtaaggaaaaggttcacatcagtattgtggttattggccatgttgactctgggaagtccactaccactggccacctgatctacaagcttggaggcattgacaagcgtgttattgagagatttgagaaggaagctgctgagatgaacaagaggtctttcaagtatgcctgggtgcttgataagcttaaggctgagcgtgaaagaggaatcacaattgatattgccttgtggaagtttgaaaccaccaagtactattgcacagtcattgatgcccctggacacagggatttcatcaagaacatgatcactgggacatcccaagctgactgtgctgttcttatcattgattccactactggtggttttgaagctggaatttcaaaggatggacagactcgtgaacatgctctgctttcattcacccttggtgtgaaacagatgatttgttgctgtaacaagatggatgctactacaccaaagtactccaaggccaggtatgatgaaattgtgaaggaagtttcttcctatttgaagaaagtaggatacaaccctgacaagattccttttgttcctatatctggttttgagggagacaacatgattgagaggtccacaaaccttgactggtacaagggtcctactctgctagatgcacttgaccagatctctgagcccaagaggccttctgacaagcccctcaggctaccccttcaggatgtgtacaagattggaggaattggaactgtgcctgtgggacgggttgagactggtgtcttgaagcctggaatggtggtgacttttgcaccaactggactgacaaccgaagttaagtctgtggaaatgcaccatgaagctctcacagaggctcttcccggtgataatgttggattcaatgttaagaatgttgctgttaaggatctcaagcgtggttatgttgcctcgaactcaaaggatgatcctgccaaggaggctgctaacttcactgcccaggttatcatcatgaaccatcctggtcagattggaaatggctatgcccctgttcttgactgccacacttcccacattgctgtcaagtttgctgaactcatgaccaagattgacaggcgatctggcaaagagcttgagaaggaacccaagtttttgaagaatggtgatgctggttttgttaagatgattccgaccaaacccatggtggttgaaactttctctgagtaccccccacttggtcgctttgctgtcagggatatgcgtcaaactgttgctgtgggagtcatcaagaacgtggagaagaaggatcctactggagccaaggtcaccaaggctgcccagaagaagaagtgaatcgtgcggtttggttcatcaggggatgtcgtttcttatggttacaataaatgttggtttcttgcccttgtgtcttcgtttctaggtagcttgtttttcggacatagtttgaagtctccaccatcatctcgcaacttttgttcccagaattgggttcttgatcgacggtggcaagactccttttatcattctgttttaatgtgttgtgtttgtgagaacccctgattacatttttgttaagcgcagcgagttttagggctttgccgttgcgttgttggtttgctttttaaatgtcaactttatatttgtgttc

SEQ ID NO: 751 - DNA, 2069 bp, Glycine max
atccacgcgatattaggcgcgtgcaaatcactctaatccgaaactagtagacatgggaagcacgagctatacgcgagcgtttcaattgccgccacgaaagcagagaaggccagaaacggaaccacggtaaaatggtaagggtattttcgtaaacagaagaaaagagttgtagctataaataaaccctctaacccacggcgcactatttctcttcactccttcgttcactcttcttctcttgcggctagggttttagcgcagcttcttctagatttaaggaagatgggtaaggaaaaggttcacatcagtattgtggttattggccatgttgactctgggaagtccactaccactggccacctgatctacaagcttggaggcattgacaagcgtgttattgagagatttgagaaggaagctgctgagatgaacaagaggtctttcaagtatgcctgggtgcttgataagcttaaggctgagcgtgaaagaggaatcacaattgatattgccttgtggaagtttgaaaccaccaagtactattgcacagtcattgatgcccctggacacagggatttcatcaagaacatgatcactgggacatcccaagctgactgtgctgttcttatcattgattccactactggtggttttgaagctggaatttcaaaggatggacagactcgtgaacatgctctgctttcattcacccttggtgtgaaacagatgatttgttgctgtaacaagatggatgctactacaccaaagtactccaaggccaggtatgatgaaattgtgaaggaagtttcttcctatttgaagaaagtaggatacaaccctgacaagattccttttgttcctatatctggttttgagggagacaacatgattgagaggtccacaaaccttgactggtacaagggtcctactctgctagatgcacttgaccagatctctgagcccaagaggccttctgacaagcccctcaggctaccccttcaggatgtgtacaagattggaggaattggaactgtgcctgtgggacgggttgagactggtgtcttgaagcctggaatggtggtgacttttgcaccaactggactgacaaccgaagttaagtctgtggaaatgcaccatgaagctctcacagaggctcttcccggtgataatgttggattcaatgttaagaatgttgctgttaaggatctcaagcgtggttatgttgcctcgaactcaaaggatgatcctgccaaggaggctgctaacttcactgcccaggttatcatcatgaaccatcctggtcagattggaaatggctatgcccctgttcttgactgccacacttcccacattgctgtcaagtttgctgaactcatgaccaagattgacaggcgatctggcaaagagcttgagaaggaacccaagtttttgaagaatggtgatgctggttttgttaagatgattccgaccaaacccatggtggttgaaactttctctgagtaccccccacttggtcgctttgctgtcagggatatgcgtcaaactgttgctgtgggagtcatcaagaacgtggagaagaaggatcctactggagccaaggtcaccaaggctgcccagaagaagaagtgaatcgtgcggtttggttcatcaggggatgtcgtttcttatggttacaataaatgttggtttcttgcccttgtgtcttcgtttctaggtagcttgtttttcggacatagtttgaagtctccaccatcatctcgcaacttttgttcccagaattgggttcttgatcgacggtggcaagactccttttatcattctgttttaatgtgttgtgtttgtgagaacccctgattacatttttgttaagcgcagcgagttttagggctttgccgttgcgttgttggtttgctttttaaatgtcaactttatatttgtgttcaatttttgcttggtttgcttttaaaaaatcaaatttatgtgtcaaattttggctttggatattttaactatcggctgttgctttctttttccatgttatgatttgtctgaatgacgatgcaagaattttc

SEQ ID NO: 752 - DNA, 1742 bp, Glycine max
cattacttctcttcacacctttgttcactcttcttctcttgcggctagggttttagcgcagcttcttctagatttaaggaagatgggtaaggaaaaggttcacatcagtattgtggtcattggccatgtcgactctgggaaatccactaccactggtcacctgatttacaagcttggaggcattgacaagcgtgttattgagaggtttgagaaggaagctgctgagatgaacaagaggtctttcaagtatgcctgggtgctggacaaacttaaggctgagcgtgaaagaggaatcaccattgatattgctttgtggaagtttgaaacaacaaagtattattgcacagttattgatgcgcctggacatagggatttcattaagaatatgattactgggacatcccaagctgactgtgctgttcttatcattgattcgaccactggtggttttgaagctggtatttccaaggatggacagactcgtgaacatgctctgctttcattcacccttggtgtgaaacagatgatttgctgctgtaacaaaatggatgctactacacccaagtattccaaggccaggtatgatgaaattgtgaaggaagtctcttcctacttgaagaaagtaggatacaaccctgacaagattccttttgttcctatctctggttttgagggagacaacatgattgagaggtccacaaaccttgactggtacaagggtccaactctgcttgatgcacttgaccagattagtgagcccaagaggccctctgacaagcccctcaggcttccccttcaggatgtgtacaagattggaggtattggaactgtgccagtgggacgtgttgagaccggtgtcttgaagcctggaatggtggtgacttttgcaccaactggactgacaactgaagtcaagtctgtggagatgcaccatgaatctcttacagaggcacatcctggtgacaatgtgggattcaatgttaagaatgttgctgttaaggatttgaagcgtggttatgttgcctcaaactcaaaggatgaccctgcaaaggaggctgctaacttcacagcccaagtcatcatcatgaaccaccctggtcagattggaaatggctatgcccctgtcctcgactgccacacttctcacattgctgtcaagtttgctgaactcatgaccaagattgacaggcgatccggcaaagagcttgagaaggagcccaagtttttgaagaacggtgatgctggttttgttaagatgattccaaccaaacccatggttgttgaaactttctccgagtatcctccacttggtaggtttgctgttagggacatgcgtcaaactgttgctgtgggagtcatcaagaacgttgagaagaaggatcctaccggagccaaggtcaccaaggctgcccagaagaagaagtgaatcgtgcgggctggttcatcaggggatgttggttacaataaatgttggtttcttttctgtactcttgtgtcttcttttctaggtagcttgtttttcggacaaagtttgaagtctccaccatcatctcgcaactgttgttcccagaactgggttcttgatcgacggtggcaaaattgcttttatttatctgtgttttaatgtgttgtgtttgtcggaacccctgattacatttttgttaagcgcagcgagtttcaggactttgctgcgttgtgttgctttggtttattaaatgtcaactttctatttgtagtgttca

SEQ ID NO: 753 - DNA, 1652 bp, Saccharum officinarum
gacgttcgcctgcagctaccgtcctgaattcccgggctcgatcccctcccctgtcggctctgtctgttgacttcccccatcgagctaagtagtcagctgctcccgttgccatggggaaggagaaggttcacatcaacattgtggtcattggccatgtcgactccggcaagtccaccaccaccggccacctcatctacaagctaggaggcattgacaagcgtgtcattgagaggtttgagaaggaggctgccgagatgaacaagaggtccttcaagtacgcctgggtgcttgacaagctcaaggccgagcgcgagaggggcatcaccattgacattgccctgtggaagtttgagaccaccaagtactactgcactgtgattgacgctcctgggcaccgtgacttcatcaagaacatgatcaccggcacctcccaggctgattgtgcggtgctcatcattgactccaccactggtggctttgaagctggtatctccaaggacggccagacccgtgagcacgcactccttgctttcactcttggtgtgaggcagatgatctgctgctgcaacaagatggacgccaccacccccaagtactccaaggctcgttacgacgagatcgtcaaggaagtgggttcctacctgaagaaggtggggtacaacccggacaagatccccttcgcgcccatctctgggttcgagggtgacaacatgatcgagaggtcgacgaacctggactggtacaagggccccaccctccttgaggcgctggaccagatcaacgagcccaagcggccctcggacaagcccctgcgccttcccctgcaggacgtgtacaagatcggcggcatcggcaccgtcccggtgggccgcgtggagaccggcctcattaagcctggcatggtggtcacctttgggcccacgggcctgacgacggaggtcaagtcggtggagatgcaccacgagtcgatgcaggaggcgctgcccggcgacaacgtcggcttcaacgtcaagaacgtggcggtcaaggacctgaagcgcggctacgtggcctctaactccaaggacgatcccgccaaggaggctgccagcttcaccgcgcaggtgatcatcatgaaccaccccgggcagatcggcaacggctacgctccagtgctggactgccacacgtcccacatcgccgtcaagttctcggagctgctcaccaagatcgaccggcggtcaggcaaggagctggagagcgcccccaagttcctcaagaacggcgacgctggcttcgtcaagatgatccccacaaagcccatggtggtggagaccttctcggagtaccctccactggggcgcttcgctgttcgtgacatgaggcagacggttgctgtcggcgtgataaagagcgtggagaagaaggacccgacgggagccaaggtgaccaaggcggctggcaagaagaaatgatgatgatcctgcatgtggccatgggtcctggtctctttgggtagaagatcaattatgttattataaataagtactgttttgttgggtggtactagtagtagttacaaaagaacaattttactggttcagtgtgttcacagtgtgtggacggttgtgttcgtgattgtctaccataataatatccctatgtgcctgtcc

SEQ ID NO: 754 - DNA, 1765 bp, Solanum lycopersicum
aaataaagtttccttcatttttcaacttattatatgtgctgtgccttctctagacttctagttgatcaacatgggtaaagagaaggttcacatcaacattgtggttattggccatgttgactctggcaaatcgactaccactggtcacttgatctacaagctaggtggtatcgataaacgtgtgatcgagaggtttgagaaagaagcagctgagatgaacaagaggtcattcaagtatgcatgggtgcttgacaagcttaaggctgagcgtgaacgtggtattaccattgatattgccttgtggaagtttgagaccacaaagtactactgcactgtgattgatgctcctggacacagagatttcatcaagaacatgattactggtacctctcaggctgactgtgctgtcctgattatcgactccacgactggtggttttgaagctggtatctctaaggatggacagactcgtgaacatgcgttgcttgctttcacacttggtgttaggcaaatgatttgttgctgcaacaagatggatgctaccacacctaagtactccaaggctaggtatgatgaaattgtgaaggaagtgtcttcttaccttaagaaggttggttacaaccctgacaagatcccatttgtgccgatttctggtttcgaaggagataatatgattgagagatcaactaacctggactggtacaagggtccaacccttcttgaggctcttgaccagcttaatgagcctaagaggccctcggacaaacccttgcgtcttccacttcaggatgtctacaagattggaggtattggaactgtacctgtcggtcgtgttgaaactggtgtgattaagcctggtatggttgtcacttttggtccaactggtctgaccactgaggttaaatctgtggagatgcaccacgaggctcttcaggaggcacttcctggtgacaatgttgggttcaacgtcaagaacgttgcagttaaggatcttaagagaggttacgttgcctccaactccaaagatgacccagctaagggggctgctagcttcaccgctcaggtcatcatcatgaaccatccaggacagattggaaatggatatgctccagtgctggactgtcacacctcccatattgctgtcaagtttgctgagatcttgactaagattgacaggcgttctggtaaggaactcgagaaggagcctaagttcttgaagaacggtgatgctggtatggttaagatgattcccaccaagcccatggttgttgagacctttgctgagtacccaccattgggacgttttgccgtgagggacatgcgtcagactgttgctgttggagttgtcaagaacgttgacaagaaagacccaactggagccaaggtcaccaaggctgctcagaagaaaaaatgaatactgcagttcaactctggagttcccagagatatcaatatctactataataaagtgtgttatgaaaacttgctatgctttactcttcctgctcatgttcagtcttttatgttgttgtttggttcttgttttctgccctgtatgtcaggtatcctttcccagaactgggtgctcgacagacggtggcaaaagacacagttaagagtcatttggtttatcttttgaggtgcctaggttcatccaagacaggctaagaagctttgttatttatgttttcttataacacgtaaatcgtactttttctgtttttgtgctgataatcttctattgcatcatctatcctgtttttcc

SEQ ID NO: 755 - DNA, 1543 bp, Triticum aestivum
ccgccgccgccgcctcctcctctcggttccctctccttccttcgagagcttcagccatgggtaaggagaagactcacatcaacatcgtggtcattggccacgtcgactctggcaagtcgacgaccactggccacctgatctataagcttggaggcattgacaagcgtgtgatcgagaggttcgagaaggaagccgctgaaatgaacaagaggtctttcaagtacgcctgggtgcttgacaagctcaaggccgagcgtgagaggggtatcaccatcgatattgccctctggaagttcgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgctctccttgctttcactcttggagtgaagcagatgatctgctgctgcaacaagatggacgccaccactcccaagtactcaaaggcgcgttacgaagaaattgtgaaggaggtctcttcctacctgaagaaggtcggctacaaccctgaaaaggttcccttcgtccccatctctgggttcgagggtgacaacatgattgagaggtccaccaaccttgactggtacaagggcccaaccctgcttgaggcgcttgaccagatcaatgagcccaagaggccctcagacaagcccctccgtcttcccctccaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgccgtgaaggatctgaagcgtggttttgttgcatccaacttcatgaaccaccctggtcagattggcaacggctacgccccagtgctggactgccacacctcgcacattgctgtcaagtttgctgagctggtgaccaagattgacaggcgatctggtaaggagatagaggccgcgcccaagttcctcaagaatggtgatgctggcatagtgaagatgattcccaccaagcccatggttgtggagacctttgccacttatcctcctcttggtcgttttgctgtccgtgacatgaggcagactgtggctgttggtgtcatcaagggcgtcgagaagaaggacccaaccggggccaaggtgaccaaggctgccatcaagaagaagtaattcgacattgatatccaaatcactgttcagacaccaagcagtttttagtattggctgagttttgttaagggcattgttcgtactggtatattttagctgttcagctgttagcgctgcatatcgtgcccttggtggtcgtctgtcttgtgccttttacatactgtgtcctaatgtaagcttcggtgaaacctgga

SEQ ID NO: 756 - DNA, 1974 bp, Glycine max
aaaagagttgtagctataaataaaccctctaaccctcgtcgcattacttctcttcacacctttgttcactcttcttctcttgcggctagggttttagcgcagcttcttctagatttaaggaagatgggtaaggaaaaggttcacatcagtattgtggtcattggccatgtcgactctgggaaatccactaccactggtcacctgatttacaagcttggaggcattgacaagcgtgttattgagaggtttgagaaggaagctgctgagatgaacaagaggtctttcaagtatgcctgggtgctggacaaacttaaggctgagcgtgaaagaggaatcaccattgatattgctttgtggaagtttgaaacaacaaagtattattgcacagttattgatgcgcctggacatagggatttcattaagaatatgattactgggacatcccaagctgactgtgctgttcttatcattgattcgaccactggtggttttgaagctggtatttccaaggatggacagactcgtgaacatgctctgctttcattcacccttggtgtgaaacagatgatttgctgctgtaacaaaatggatgctactacacccaagtattccaaggccaggtatgatgaaattgtgaaggaagtctcttcctacttgaagaaagtaggatacaaccctgacaagattccttttgttcctatctctggttttgagggagacaacatgattgagaggtccacaaaccttgactggtacaagggtccaactctgcttgatgcacttgaccagattagtgagcccaagaggccctctgacaagcccctcaggcttccccttcaggatgtgtacaagattggaggtattggaactgtgccagtgggacgtgttgagaccggtgtcttgaagcctggaatggtggtgacttttgcaccaactggactgacaactgaagtcaagtctgtggagatgcaccatgaatctcttacagaggcacatcctggtgacaatgtgggattcaatgttaagaatgttgctgttaaggatttgaagcgtggttatgttgcctcaaactcaaaggatgaccctgcaaaggaggctgctaacttcacagcccaagtcatcatcatgaaccaccctggtcagattggaaatggctatgcccctgtcctcgactgccacacttctcacattgctgtcaagtttgctgaactcatgaccaagattgacaggcgatccggcaaagagcttgagaaggagcccaagtttttgaagaacggtgatgctggttttgttaagatgattccaaccaaacccatggttgttgaaactttctccgagtatcctccacttggtaggtttgctgttagggacatgcgtcaaactgttgctgtgggagtcatcaagaacgttgagaagaaggatcctaccggagccaaggtcaccaaggctgcccagaagaagaagtgaatcgtgcgggctggttcatcaggggatgttggttacaataaatgttggtttcttttctgtactcttgtgtcttcttttctaggtagcttgtttttcggacaaagtttgaagtctccaccatcatctcgcaactgttgttcccagaactgggttcttgatcgacggtggcaaaattgcttttatttatctgtgttttaatgtgttgtgtttgtcggaacccctgattacatttttgttaagcgcagcgagtttcaggactttgctgcgttgtgttgctttggtttattaaatgtcaactttctatttgtagtgttcaatttttggcttggtttgctttttctttataatttgtgttcaaattttggcttggtttgcttttactataatttgtgttcaaattttgggttggattttttaacgatcggctgtttgctcttcttcctctgttttgatgtgttcgtgactatgcaagaatcttcaattttgctaaaataaacttgctttgac

SEQ ID NO: 757 - DNA, 2387 bp, Ricinus communis
ggcaactacaataatggttatcaataatttacatttaaaaaacaaattgcagacatcaaaggctggctctttgatcgtagtaatgggtttggagtgctcgtagctgtcgtatattattgaaaattttgaacaagattaggggttttaatattgaacccagggaaggacagattcggtggtttgacttttagaaggttccttcactgttgcgtctgggcaagttcgtcgttgtgtttttttgtcgagggtatttatgtaaataaacttacagtgcctgctcagaaaaccctagcctgtgttttcactataaaagtgatcgtttctgcttgatttgcctacaattggccctgtttttgctccgtttcgttcggcagggcttttgttagagtttctctacttcaatttcttaagttttaggcatcaataatgggtaaggagaaggttcacatcaacattgtggtcattggccatgtcgactctggaaagtcaactactactggccatctcatctataagttgggaggtattgacaagcgggttattgagagattcgagaaggaagctgctgagatgaacaagaggtcattcaagtatgcttgggtgcttgacaagcttaaggccgagcgtgagcgtggtatcaccattgatattgccttgtggaagtttgagaccaccaagtactactgcaccgtcattgatgcacctggacatcgtgactttatcaagaatatgattaccggtacctcacaggctgactgtgctgttctgattattgattccaccactggtggttttgaagctggtatttccaaggatggtcagacccgtgagcatgctctccttgctttcaccctcggtgtcaagcaaatgatttgctgctgcaacaagatggatgctactactcccaagtactccaaggccaggtatgatgaaattgtcaaggaggtttcctcttacctgaagaaggtcggatacaaccccgataaaattcctttcgttcccatctctggcttcgaaggtgacaacatgatcgagaggtccaccaaccttgactggtacaagggaccaaccctacttgaagctcttgaccagatcaatgagccaaagaggcccacagacaagcctcttcgtctcccacttcaagacgtttacaagattggtggtattggaacagttccagtgggtcgtgtggagactggtgtcctcaagcctggtatggttgtgacctttggacccagtggactgacaactgaagttaagtcggttgaaatgcatcacgaggcactccaggaggccctccctggtgacaatgttggtttcaatgttaagaatgttgctgtcaaggatcttaagagaggttttgttgcttcaaactccaaggacgatccagcaaaggaggcagccaacttcacatcccaagtcatcatcatgaaccatcctggtcagattggaaatggatatgctccagtgttggactgtcatacctcccacattgctgtgaagtttgctgagatcctaacgaagattgatcgtcgatccggtaaggagcttgagaaggagcccaaattcttgaagaatggtgatgctggtttcgtgaagatgattccaaccaagcccatggttgttgagaccttctccgagtaccctccattgggtcggtttgctgttagggacatgcgccaaactgttgcagtgggtgttatcaagagtgttgagaagaaggacccaagcggagctaaggtcaccaagtctgccgccaagaagggaggaaaatgagagttcaattattagctgttcttggaagggttttttaaatgtacattgtctagttgctacagccacatatttgccttgtataggcagtggacgtgtagtatttttgttgcaccattttgttttggatgtttgaggcatttttctagcgaggtttatgtatggttgagattgagaattacttatgtatgccaactgataatgagagaacaaagtctactgtttctagctttatccattttctttcagggtcgccgccgccaattagcttctgtacagcaaatcatccacattactgccttgtgtgagagaggaaagacaggtgctgctctggcttgcttggggaaaatggttgatgttggatgccattccttcacctttcacttttagctccttgtcggaatgggcattctgatttcatcaagtccttgattgatatcatgcaagattggggcatggttccacttattcagtaatggtaaatgaatactgtcaacaaaaggatcgcatttcttgttttggatcagatggaaaagaaacgactgaaacctaacttttgctgtctacgactccatcattagttgtccaagcagagaaaataaaatgttcgttca

SEQ ID NO: 758 - DNA, 1857 bp, Populus trichocarpa
ttttatgtattgcagctcaaaactaagatttcataatgggtaaagagaagactcacatcaacatcgtggtcattggccatgtggactctggaaagtcaaccaccactggccacttgatctacaagcttggaggtattgacaagcgtgtcattgagaggttcgagaaggaagctgctgagatgaacaagaggtcattcaagtatgcctgggtgctcgacaagctcaaggctgagcgtgagcgtggaattaccattgatattgccttgtggaagtttgagaccaccaagtactactgcactgtcattgatgcccctggacatcgtgactttatcaagaacatgattactggaacttcccaggctgactgtgccgtgcttatcattgattccaccactggtggtttcgaagctggtatctccaaggatggccagacccgtgagcacgctcttcttgcttttaccctcggtgtgaagcaaatgatatgctgttgtaacaagatggatgccaccactccaaaatactccaaggcaaggtatgatgaaattgtcaaggaagtgtcctcctacttgaagaaggtcggttacaatcctgacaagattccctttgtcccaatctctggatttgagggtgacaacatgattgagaggtccaccaaccttgactggtacaagggcccaacactcctggaagccctggaccagatccaggagcccaagaggccctcagacaagcccctccgtctcccacttcaggacgtgtacaagattggtggtatcggaactgtcccagtgggtcgtgttgaaactggtgtcatcaagcccggcatggttgtcacattcggtccaactggactgagtactgaagtcaagtctgttgagatgcaccacgaggctctcctagaggctcttcctggtgacaatgtcgggttcaatgttaagaatgtagctgttaaggatctgaagcgtggttttgtggcctcaaactccaaggacgatcctgcgagggaagctgccaacttcacctcccaggttatcatcatgaaccatcctggacagatcggaaacggttacgctccagtccttgactgccacacctgtcacattgctgtgaagtttgctgagatcctcaccaagattgacaggcggtctggtaaggaactggagaaggagcccaagttcctgaagaacggtgatgctggtatgatcaagatgattcccaccaagcccatggtggtggagactttctcagcgtatcctccacttggtcgttttgctgtgagggacatgcgccagaccgttgctgtgggagttatcaagagcgtggagaagaaggatccctctggtgctaaggtgaccaaatctgctgccaagaagggtgccaagtgaaccgtgcgggttggtgcactaagaagctttaataaaaatcaagagtgggttcttgttactggtccatttcttggatgtctatcagttcattatgagaactgtagtctgaagtcatcaccttcattgcaaggcttttgttcacagaactgggttcttgataggcggtggcgtggtttcggtcttgattttttttccgagtcattgttgtgtctcccatgttgagaattttaatctgtttttattttcacttgctctgctcaggagttaagtattttgctgttatgttaagtacccttgaatactttttaccattttacttgtctagtttttgttcgtctacttagtttctacgtatgcctttgtagaagagtgatattctgaatgttttttctattgcctgtctcttaaggtttgaactgcaatttagacgaaacctccacgaggattaagacgattgcctgttcccatttct

SEQ ID NO: 759 - DNA, 1824 bp, Panicum virgatum
gcttgggatgagttgcgctatataaacagagcctctccctccaacctcgacgcaaccgccgccctgccctcacctgttgacttgctccaattggccttgctcatcgtcatctccaccgaccttgagctcgagaggcctttctagccatgggtaaggagaaggttcacatcaacatcgtggtcatcggccatgttgactctggcaagtccacgaccaccggccacctcatctacaagctgggaggcatcgacaagcgcgtcatcgagaggttcgagaaggaggctgccgagatgaacaagaggtccttcaagtacgcctgggtcctcgacaagctcaaggccgagcgcgagaggggcatcaccatcgacattgccctgtggaagttcgagaccaccaagtactactgcaccgtgatcgacgcccctgggcaccgtgacttcatcaagaacatgatcaccgggacctcccaggccgattgcgccgtgctcatcatcgactccaccaccggtggctttgaggccggtatctccaaggacggccagacccgtgagcacgccctccttgccttcacgcttggtgtcaggcagatgatctgctgctgcaacaagatggacgccaccacccccaagtactccaagtctcggtacgacgagatcgtgaaggaagtggcgtcgtacctgaagaaggtggggtacaacccggacaagatccccttcgtgcccatctccgggtttgaaggtgacaacatgatcgagaggtcgacgaacctggactggtacaagggcccgaccctcctggaggcgctggaccagatcaacgagccgaagcggccgtcggacaagcccctccgccttcccctgcaggacgtgtacaagatcggcggcatcggcaccgtcccggtgggccgcgtggagacgggcgtcctgaagcccggcatggtggtcaccttcgcgcccaccggcctgacgacggaggtgaagtcggtggagatgcaccacgagtcgatgcaggaggcgctgccgggcgacaacgtggggttcaacgtgaagaacgtggcggtcaaggacctgaagcgcggctacgtggcgtccaactccaaggacgaccccgccaaggaggccgccagcttcacggcgcaggtgatcatcatgaaccacccggggcagatcggcaatggctacgccccggtgctggactgccacacgtcccacatcgccgtcaagttctcggagctgctgaccaagatcgacaggcgctccggcaaggagctcgagagcgcccccaagttcctcaagaacggcgacgctgggttcgtcaagatgatcccgaccaagcccatggtggtggagacgttctccgagtacccgccgctggggcggttcgctgtgcgcgacatgaggcagacggtggctgtcggcgtgatcaagagcgtggagaagaaggacccaacgggagccaaggtcaccaaggctgctgccaagaagaaataaacggtcgatccgtggatgttattatgacatcgcatagctagtggagttattttggctagaaaagtttgcattacagttattatattgtcggacaagtttggttgtttgggtctcgcagtgtttatttttacagtatgtgtcagtgtcagtttccagaatcaatatatctgttatgtttttttttgcttagtgtgtttagatcactttgcattttgcgtttttctgtttttggaagggaatcttcaatatttgaagtattaaatgtagactaatcacaaaattaattatagatctcgtctgtaaactacgagaggaatctaatgagcctaattaa

SEQ ID NO: 760 - DNA, 2717 bp, Amborella trichopoda
accgaagctttatagagccggcaccgtttccctcattctctttgatttttgctttctcccttggggaagagttgtagtcctgcgttttctctctctctagcatcggcatcgagcaggaacttacttgataaaagatgggtaaagagaagtttcacatcaacattgtggtcattggccatgtcgactctggcaagtccacgaccactggtcacctcatctacaagcttggaggtatcgacaagcgtgtgattgagaggtttgagaaggaggcggctgagatgaacaagaggtctttcaagtatgcttgggtgcttgacaagctcaaggctgagcgtgagcgtggtatcacaattgacattgccctgtggaaatttgagaccacaaagtattactgcactgtcattgatgcccctggtcatcgtgactttatcaaaaacatgattactgggacttctcaggctgactgtgctgtcctcattattgactccaccactggtggttttgaggccggtatttctaaggatggtcagacccgtgagcatgctttgctggccttcacccttggtgtcaaacagatgatctgttgctgcaacaagatggatgccactactcccaagtactccaagggcaggtacgaagaaattgtgaaggaagtgtcctcttacatcaagaaggttggatacaaccccgacaagatcccttttgtccccatctctgggttcgagggtgacaacatgattgagaggtctaccaaccttgattggtacaagggtcccacattgctcgaggccctagacctgatcgtggagcccaagaggccctctgacaagcccctccgtctcccacttcaggatgtctacaagattggaggaattggaactgttcctgtgggccgagtggagactggtcttcttaagcctggtatggtggtcacctttgccccaacagggctcaccactgaagttaagtctgtggagatgcaccacgaggcactccaggaggctctccctggtgacaatgtgggcttcaacgtgaagaatgttgcggtcaaggatcttaagcgtggttttgttgcctctaactccaaggatgaccctgctaaggaagctgcaaacttcacctctcaggttatcatcatgaaccatcctggccagattggaaatggctatgcccctgttcttgattgccacacctcccacattgccgtcaagtttgccgagatcctcaccaagatcgacaggcgttctggcaaagagctcgagaaagagcctaagttcttgaagaacggcgatgcaggttttgttaagatgattcccacaaagcccatggtggttgagaccttctctgaatacccacctctcggaaggtttgccgtgagggacatgaggcagacagtggctgttggtgtgatcaagagcgtcgagaagaaggatcctagtggtgccaaggtcaccaagtctgctgtcaagaagaagtgaatcgtgctggtcttaggactaccttttgttaatgttctggtttcatggtttcagactccgtctttttgtctctctgtctctttgtgttttggtttgttgtctgtttccggcgggcggacaatgcagaactggcggacaatgcagaactgggtgctcgacaggcggtggcatacccaagaggtgcaaggtttccttcttccctcctctttttcattggagtaggtgggtaaaaaaacctgtgcccttccctctcatttctttgttgtccgggacactcaatacatgagtctgttttgttagttttttatttcgtgaatagaagattcggattttgatgattttaagattcgaaaagagaatttggttcgtaaattgttggaatcccctgatttggattcaatcccaatagggatctcgatcgccaattcaaggtacacccccttgatcactgaccgactcaagaagtaatcgagtcagatcaggctaaaactgggttcattctgtgtcatgttcctggttttatgtatttaaataaatatggaactcgaatgtgtgcgatcgctcaattagtatatgtgggcttgacttaaccgcattctaacttctggccacgaccatccaacttggacggtggtgattgatttgtttgaaagtgttgtttcatgtccttcaagttgtgctaccgtttttgtgtgccaggaacctttgcaatggcgttaaacctattctgcctgccatgaaatttgaagctccactaatagtgcagattcagcacatgaaaatgaaacagttctgcctgccatgaaatttgaagctccactaatagtgcagattcagcacatgaaaatgaaacagtttagaaagggcgttacaatatacagcatttagggtttaaatcaaaatccatttctttagggtttgcaatccaaatccaattcacaaaagcattttttctgggtttgaaatccttgatacattttgttagtgtttgaaatttttttttaaagttgtaacttttcttgtagaaggtttgtacttagcaacattgttgtccatattatttacttatgtagatttaacattatttagatgccacttgtatatatgaaaaaagtttatacaaggttgtaattttaaaatgtaaaattaaagatgcgcctgaaaaattcataaagttttaatgttaaaaaaccctctaattgatcatctcgacatcgagatgtatgaatatggaaaaag

SEQ ID NO: 761 - DNA, 2336 bp, Malus domestica
atggacaagttaagcagcagaatgaagaggtcatcggtgtggcttgcttcgacaacgagagttggatgcctcagcttccagcgacaacgctctcgatctcctgattctgattctggtggagttggtggaggttattggcattggggtcgccggagaagaaagggattgagtggggtggcagcaaattatgtaagttcaagcaaacactcacaaccgtcagatcaaatcctcaatcatccaaaggcggagagtaaaaccctagccctacagaagccccatttccccctatttaaaattcacggggctcacacatttgctatcctctgctgttctcgctcttcacactctgaagtcggcgagagaaagctcctgaatcttcctgtcgctctcgtctgtttcttccagttatttttctgattatccaacatgggtaaggagaagttccacatcaacatcgtggtcattggccatgtcgactctgggaagtcgaccacgacaggtcacttgatctacaagcttggtggtattgacaagcgtgttattgagaggttcgagaaggaggcagctgagatgaacaagaggtcattcaagtatgcctgggtgttggacaagctcaaggctgagcgtgaacgtggtattaccattgacattgccctgtggaagttcgagaccaccaagtactactgcactgtcattgatgctcctggacatcgtgactttatcaagaacatgattactggaacctcacaggctgactgtgccattctcatcattgactctaccaccggaggttttgaagccggtatttccaaggatggtcagacccgtgagcatgctttgcttgcttttactcttggtgtcaggcaaatgatttgctgctgcaacaagatggatgccaccactcccaagtactcaagggcaaggtatgatgaaattgtgaaggaagtgtcgtcctatctcaagaaggttggctacaacccagataagatcccctttgtccccatttctgggttcgagggtgacaacatgattgagaggtccaccaaccttgactggtacaagggtcccacccttcttgaggctcttgaccagatcaatgagcccaagaggccctcagacaagcccctccggcttccacttcaggatgtgtacaagattggtggtatcggtactgttcctgttggacgtgttgagactggtgtcattaagcctggtatggtggtgacttttggcccaactggtctgactactgaggtcaagtctgttgagatgcaccacgaagctatgcaggaggcccttccaggtgataatgttggattcaacgttaagaatgttgctgtcaaggatctcaagcgtgggtacgttgcttccaactccaaggatgatcccgcaaaggaggctgccaactttatcgctcaggtcatcatcatgaaccaccccggccagattggacagggatatgctccagttctcgactgtcacacctcccacattgccgtcaagtttgctgagctcgttacaaagatcgacaggcgatctggcaaggagcttgagaaggagcccaagtttttgaagaatggtgatgctggatttgtgaagatgcttcccaccaagcccatggttgttgagaccttctctgagtacccaccgctcggacgttttgctgtgagggacatgcgccagactgttgcagttggtgtcatcaagagcgttgagaagaaggatccaactggagctaagatcaccaaggccgcagctaagaagaagtgaaccgcactggttcaacagatttccgcaggcgaaatcttctatcatctttataataatattagtcgtaaaaacttctctattagtatttctttggattgctggttgtgtattttcgtgtcggtgtcgtccttaggcattcattctcagaactgggtgcttgaccggcggtggcgctgctagtgttttccttttatgtcctctgttgagagtcaaggtgctctgggttcttcccggagcggctaaaagcttttgcgacctggttcttgctactctcgctataaaaacttagtttctgttaaatatctttttacttcgcatgttcgcttcttctagttggttttttatatgaatttgagtcagcttgtgttgtggtatacttgtatgatctctgatttccgaacttcaaaatctccggcaagctctgactgcggtggaagtggtcggtctacgatgtttttatgtggaaatgttatagaatgtctttgttctttgtttaagatcaatttacatggaacggttttgctgtggttgtgacggcttggtcaaaacacaactgtattattgga

SEQ ID NO: 762 - DNA, 1776 bp, Malus domestica
acgctttcatttctcactgcctcagccgctctcgcttgaaccaagagtttgagcttccagatctctgaggtaaattctagttacttaacatgggtaaagagaagtttcacatcaacatcgtggtcattggccatgtcgactccggcaagtcgaccaccactggtcatcttatctacaagcttggcggtattgacaagcgtgtgattgagaggttcgagaaggaagctgctgagatgaacaaaaggtcgttcaagtatgcctgggtgcttgacaagcttaaggctgagcgtgagcgtggtatcaccattgatatcgccttgtggaaatttgagaccacaaagtactactgcacggtcattgatgctccagggcatcgtgatttcattaagaacatgattactggaacttcacaggctgactgtgctgtcctcatcattgactccaccactggtggttttgaagctggtatttccaaggatggacagacccgtgagcacgcacttcttgctttcaccctcggtgtgaagcagatgatttgctgctgtaacaagatggatgccaccactcctaagtactccaaggcaaggtacgaagaaatcgtgaaggaagtttcatcctacctgaagaaggttgggtacaaccccgacaaaatcgcctttgttcccatctctgggtttgagggtgacaacatgattgagaggtccaccaaccttgactggtacaagggaccaacccttcttgaggctcttgacctgatcaacgagcccaagaggccctcagacaagcccctccgtcttccacttcaggatgtgtacaagatcggtggtattggaactgtgccagtgggacgtgtagagactggtatcgtcaagcctggtatggttgtgacttttgggccaactggtctgaccactgaagttaagtctgttgagatgcaccatgaggctcttcaggaggcactccccggtgacaatgtcgggttcaatgttaagaatgtagctgtgaaggatctcaagcgtggtttcgttgcatccaactccaaggatgaccctgccaaggaggctgccaacttcacatcccaggttatcatcatgaaccaccctggtcagatcggtaacggatatgccccagttctggattgccacacttcacacattgctgtgaagttcggtgagatccttaccaagattgacaggaggtctggaaaggagattgagaaggagccaaagttcttgaagaacggagatgcaggtatggtgaagatgcttcccaccaagcccatggttgtggagaccttctctgagtacccaccattgggtcgctttgctgttcgtgacatgcgccagactgttgctgttggtgttatcaagagcgttgagaagaaggatcccagcggtgccaaggtcaccaagtctgctgccaagaagaagtgaacaatggccagtactcaaattttcactgacgcaaacttatgcttttatgatacaaactcttatcttagttgtttggttttaagtggtttagtcggtttagtttgtagttgttttaattccggtctgatgtcttcattctcgagtgtcggcgcccagaattgggttctggacaggcggtggtgacccatcaagtttatgttgtgtcgattccgccttctgaaggaggatgtttttgagttgagactatttacttatcaagttttgttgcgtctgttgaatggataatttttgagcttatatatttgtgttgccttgtcttcatcttctattcgttttttaagta

SEQ ID NO: 763 - DNA, 1675 bp, Artemisia annua
cgacggggacgcttctggaatacatttgcaactgtttctagtttcattaatcaagcaagcagccaagtgttatcatgggtaaggaaaaaactcacattagccttgttgtgattggccatgtcgactctggaaagtcgaccactactgggcacttgatctacaagcttggaggtattgacaagcgtgtgattgagagattcgagaaggaagcagctgagatgaacaaacgttcattcaagtatgcatgggtgctcgacaagctcaaggctgagcgcgaacgtggtatcaccattgatatcgccttgtggaagtttgaaaccaccaaatactattgcactgtcattgatgctccaggacatcgtgactttatcaagaacatgattactggaacatctcaggctgattgtgctgttcttatcatcgactctactactggaggttttgaagctggtatttctaaagatggccagactcgtgagcatgctttgcttgcgtttacccttggtgtcaggcaaatgatttgttgttgcaacaaaatggatgctactactcccaaatactccaaggctaggtatgatgaaattgtgaaggaagtgtcgtcttacattaagaaagtaggatacaaccctgacaaagtcccatttgttccaatctcgggttttgaaggggacaacatgattgagagatcaagcaatcttgactggtacaagggtccaactcttcttgaagcacttgacaatatcagtgaaccaaagagaccatcagacaaacctctacgtctcccacttcaggacgtgtacaagattggtggcattggaactgtgccagttggtcgtgttgaaactggtgttatcaaacctggtatggtggttacttttggcccaactggtctcaccactgaagtgaagtcagttgaaatgcatcatgaatcccttcaggaggcactaccaggtgataatgtcgggttcaatgtcaagaatgttgctgtgaaggatcttaaacgtggttacgttgcttcaaattcaaaagatgatccagctaagggtgcagcaagcttcacatcacaggtcattatcatgaaccaccctggtcaaattggaaacggttatgcacctgtgcttgattgccacacttctcacattgctgttaagtttgctgagctaatgaccaagattgaccgaaggtctggtaaggagattgagaaggagcctaagtttctcaaaaatggtgatgctggaattgtgaaaatgattccaaccaaacccatggtggtcgagactttctctgagtatcctcctttgggacgctttgctgtaagggatatgcgccagacagttgctgttggtgtgatcaaaagcgtggacaaaaaggaccctactggtgccaagatcaccaaagctgcagccaagaaaaaatgaaccgctactgatctgaatcttatattcagattagactttattgttatcgtgctattatgtcttgttgagtcttattatgttttgtcttgtcgtccttgctgccatcttttaccatcattcttaggaattgtgattctgttgcgtttccgggttcatacctgggtgcttgacagacggtggcacaagctatggtatttattttcattttgattggagtcttttgtttacgaacttaaagaataaataaatctggattg

SEQ ID NO: 764 - DNA, 1943 bp, Musa acuminata
atgatccaacggcgcagatcctgccgatatctacatcattcggagccaaagcaacccggatccggatcaagtatcccattgttagcttataagtatccagccgctagggttcggacaccactctcatcgcgacatccgtggtcgaggaagccgccgccgatctctcctcttctcctcctactgtctctcggtctttgtgttaagaaacttgcaatgggaaaggagaaggttcacatcaacattgtggttattggccatgtcgattctggtaaatcgacaacaactggacatctgatttacaaactcggggggattgacaagcgtgttattgagaggtttgagaaggaagctgctgagatgaacaagaggtcattcaagtatgcgtgggtgcttgacaagctgaaggctgaacgtgaacgtggtatcactatcgatatcgctctgtggaagtttgagaccacaaagtactattgcactgtcattgatgctcctggacatcgtgatttcatcaagaacatgattactggaacctctcaggccgattgtgctgtcctcattattgattcgacaactggtggttttgaagctggaatttctaaggatgggcagactcgagagcatgcacttctcgctttcactcttggtgtcagacaaatgatttgctgctgtaacaagatggatgcgacaacccccaaatattccaaggcaaggtatgatgaaatcatcaaggaggtttcgtcctatcttaagaaggttggttacaatccggagaagattcctttcgtgccaatctctggttttgaaggcgataacatgattgagagatccaccaaccttgactggtacaaaggcccaactctactggaagcccttgacttgatccaagagcccaagcgacccttggacaagccccttcgtctccccctgcaggacgtgtacaagattggaggaattggaactgtgcctgtaggccgtgttgagactggaatcctgaagcctggtatggttgttacctttggtcctacaggtctcacaactgaagttaagtctgtggagatgcaccatgaggcccttcaggaggcctttcccggtgacaatgttggtttcaatgtcaagaatgttgctgtaaaggacctgaagcgtggtttcgttgcctcgaattccaaggatgacccagcaaaggaggctgccaacttcacctcgcaagtcatcattatgaatcatcccggtcaaattgggaatggctatgctcctgttcttgattgtcacacctctcacatagctgtcaagtttgcggagcttctgaccaagatcgacaggcgatccggcaaggagctggagaaggaacccaagttcctcaagaatggagatgcaggtttggtgaagatgattccgacaaagccgatggtggtcgagactttcgccgagtactcgccgctgggtaggtttgctgttagagacatgagacagacggttgccgtgggtgttatcaaaagcgtggagaagaaggatcccaccggagccaaggttaccaaagcagcccaaaagaaaaaatgaagggaggagaattctgcgttaatattatttggagtgatttgctgtcttagtatgtgtcctggtcgtctttgtcagtccataggcactgtatctggtgtctgggtgcagaactgggtgctcgacaggcggtggcagacataaggtctccctgttgtactggtgtgttgtttgcatttctcatgatagtttgagaatgtctatgttctgaactgtgatctgcagcgagttgcgatgtgtcccgtcaggtatatgcacgaatccatttcgtagtatgatctgatattttactaaataaatctgtcgggtgaagtcttctgtgctgttgttggtatgggacctttaaatcatgttgaggttgtgctatatacgagtctgtgtttggaccg

SEQ ID NO: 765 - DNA, 1722 bp, Musa acuminata
atgggatggatagcatcctgcctctgtcctcctgcgccggtcgctcgtctgttgtttctttgctctcggtgctccaatcttatcttctcgagagcattgtccggcaccatgggtaaggaaaaggtacacataagcattgttgtcattggtcatgtcgactctgggaagtcgaccaccactggccatcttatctacaagttgggtggcattgacaagcgtgtgatcgagaggtttgaaaaggaggctgcagaaatgaacaagaggtcattcaagtatgcttgggttcttgacaagcttaaggcggagcgtgaaagaggaattaccattgatattgctctttggaaatttgagaccaccaagtattattgcacggtcattgatgctcctggacaccgtgacttcatcaagaatatgattactggaacatcccaggctgactgtgctgttcttatcatcgactctaccactggtggttttgaagctggtatctccaaggacggtcagactcgtgagcatgcattgcttgcttttactcttggagtcaaacagatgatttgctgttgtaacaagatggatgcaacaacccccaaatattcaaaggctaggtatgatgaaattgtgaaggaagtttcttcttacctcaagaaggtaggctacaacccagagaagataccctttgttcccatctcagggtttgagggtgacaacatgattgagaggtctaccaacctggactggtacaagggcccgacccttctcgaggccctcgacatgattcaggagccaaagaggccctcggacaaacctcttcgtctccctctccaggatgtgtacaagattggaggcatcggcaccgtgccagttggacgagttgagactggtatcctcaaacctggtatggttgtttcctttggtcccactgggctgacgactgaggttaagtcggttgagatgcaccacgaagccctccaggaagccttgcctggtgacaatgtcggtttcaacgtcaagaatgttgccgtcaaggatctcaagagaggttttgttgcatccaattccaaggatgatcctgccaaggaggctgccaacttcacttctcaggtcattatcatgaatcaccctggtcagatcggcaatggctatgcccctgttctggactgccacacctcccatattgctgtcaaattcgccgagatcctcaccaagattgacaggaggtcaggaaaggaactcgagaaggagcccaagttcttgaagaatggcgatgctggttttgtcaagatgattccctccaagcccatggttgtggagacctttgctgcatatccaccgcttggtcgttttgccgtgagggacatgcggcaaacagtggccgtcggtgtcatcaagagcgtcgagaagaaggatcccacaggtgctaagatcaccaaggctgccgccaagaagaaatgagttttcacgacccttttctatcagagtgtaagagtgtactatgacttcccaatttgttgtttgcaagtgtgtttgatttaggaaccttattgttttgggacatatgttttccttgttatcatatatttattatcttgcagaacttcatcaccaaaatcgttgatctttgattcgatctcaaagcttatcatcaacaagtggtatctatcagaatgtaacatgttgtttgatgctgctttctgctaatattttaggatggggtgataagac

SEQ ID NO: 766 - DNA, 1804 bp, Musa acuminata
caactcatagcgatcgtcggatgttgcaatccgacggtcctatagaaaccctaccccggtctctaagaccgtgctccacaaggtcggcgggacggcgagctccgaaagcccattctccttctcttgactcttggcgcctccaatctttccttctcgaggcaccatgggtaaggagaaggtacacataagcattgtggtcattggccatgtcgactctggcaaatcgacaactactggtcatcttatttacaagcttggtggcattgacaagcgtgtgatcgagagatttgaaaaggaagctgctgagatgaacaaaagatcattcaaatatgcttgggttcttgacaagcttaaggctgagcgagagcgtggtatcaccattgacattgcgctatggaagtttgagaccacaaaatattactgcacagtcattgatgcccctgggcaccgagactttatcaagaatatgatcacaggaacctctcaagctgactgtgctgtgctcattatcgactccactactggtggatttgaggcaggtatttcaaaggacggtcagacccgggaacatgctcttcttgcatttacccttggtgtcaaacagatgatttgctgctgcaataagatggatgccactactccaaagtactccaaggctagatatgacgaaatcgtgaaggaggtctcttcttacctcaagaaagttggttataatcctgataagattccttttgttcccatttctggttttgagggtgataacatgattgagaggtccaccaacctggattggtacaagggtcccacccttctcgaggcccttgacttgatccaagagccaaagagaccctcagacaagcctcttcgccttcctctacaggatgtctacaagattggtggcattggaactgtccctgtgggtcgagtagagactggcatccttaagcctggtatggttgtcacttttggtccaactgggcttacaactgaaattaagtctgtggaaatgcaccacgaggcattgcaagaggccctccccggcgacaatgttgggttcaatgttaagaatgttgctgtcaaggatcttaagcgtggctttgttgcttctaactccaaggaagatcctgcaaaggaggcagctaacttcacttctcaggttatcatcatgaaccatcctggtcagatcggcaatggttatgcacctgtgcttgattgccacacctctcacattgctgtcaagtttgccgagattcttaccaagattgacaggcgatctgggaaggagctcgagaaggagccaaagttcttgaagaacggcgatgccggttttgtcaagatgattcctaccaagcccatggttgtcgagaccttttcccagtatccaccccttggtcgtttcgccgtgagggatatgaggcaaacagtggccgtgggtgtcatcaagagtgttgagaagaaggatccaaccggtgctaaaattacaaaggctgctgccaagaagaaatgagtcgcttgtcaaacaaactgccaataataatagtttgaggcctttttatgttttaggaactgactctattggattcaaccagataggtttttcgtttgatgatgaactcagacaaatttcatgttattcagtcaaatgttgcttatttatggggcttttagtgtcaaacatgggtgaactttgtagtgaccttcctgccataatggtattcatgatttgtttgcattgttcaactgtttgttccttgactgcttgcagtgctgtttcatgttaagtatgctaacaaggatgaatctg

SEQ ID NO: 767 - DNA, 1613 bp, Fagus grandifolia
aattcaaaatgggtaaggagaaggttcacatcaacattgtggtcattggccatgtcgactctgggaagtcgaccacaactggtcacttgatctacaagctaggaggtattgacaagcgtgtgatcgaaaagtttgagaaagaagcagctgagatgaacaagaggtcattcaagtacgcttgggtgctcgacaagctcaaggctgagcgtgagcgtggtatcactattgatattgccttgtggaagtttgagaccaccaaatactactgcacagtcattgatgcccctggacatcgtgactttatcaagaacatgattactggaacttcacaggctgattgtgctgtcctgattattgactccaccaccggtggttttgaagctggtatttccaaggatggacagacccgtgagcacgctctccttgctttcacccttggtgtcaggcaaatgatttgctgctgcaacaagatggacgccacaactcccaagtactcaaaggcaaggtatgatgaaattgtgaaggaagtctcttcctacttgaagaaggttgggtacaaccctgacaaaattcctttcgtccccatctccggatttgagggtgacaatatgattgagaggtccaccaaccttgactggtacaagggtccaacccttcttgacgcccttgactctatcagtgagcctaagaggccctcggacaagcccctccgtctcccacttcaggatgtctacaagattggaggcattggaactgtccctgtgggtcgtgttgagactggtgtcatcaagcctggtatggttgtgacttttggtcccactgggcttaccactgaagttaagtctgttgaaatgcaccacgaggctctcctagaggctcttcctggtgacaatgttggcttcaacgttaagaatgttgctgtcaaggatctcaagcgtggatttgttgcctccaactccaaggatgatcctgccaaggaggcagccaacttcacctcccaagttatcatcatgaaccaccctgggcagattggaaatggttatgctcccgtccttgactgccacacctcccatattgctgttaagttttctgagatcctgaccaagattgacaggcgatctggtaaggaacttgagaaggagcctaaatttttgaagaacggagatgcagggattgtgaagatgattcccactaagcccatggtggtggaaactttctctgagtatcccccacttggtcgttttgctgtcagggacatgcgtcaaactgttgctgtcggagtcgtcaagggtgtggagaagaaggatccatctggagccaaggtgaccaagtctgctgtcaagaagggcaagtgaattgtgcggtttggggtttctgcaagtgatggctatcataggtggtgttttaataaggaatgggttcttgctagtaagctatcagtcatgagtctaaggttttgttttgttggttatagcttcaagtctcatccgtcatcacgttggtgctgttcacagaactgggtgctagaccggcggtggcgaagctattgcccttgagtccttaagtgtctattgcttttattatggtgtcttgtgaaacttattatgattttt

SEQ ID NO: 768 - DNA, 1690 bp, Fagus grandifolia
gttaattcaaaatgggtaaggagaaggttcacatcaacattgtggtcattggccatgtcgactctgggaagtcgaccacaactggtcacttgatctacaagctaggaggtattgacaagcgtgtgatcgaaaagtttgagaaagaagcagctgagatgaacaagaggtcattcaagtacgcttgggtgctcgacaagctcaaggctgagcgtgagcgtggtatcactattgatattgccttgtggaagtttgagaccaccaaatactactgcacagtcattgatgcccctggacatcgtgactttatcaagaacatgattactggaacttcacaggctgattgtgctgtcctgattattgactccaccaccggtggttttgaagctggtatttccaaggatggacagacccgtgagcacgctctccttgctttcacccttggtgtcaggcaaatgatttgctgctgcaacaagatggacgccacaactcccaagtactcaaaggcaaggtatgatgaaattgtgaaggaagtctcttcctacttgaagaaggttgggtacaaccctgacaaaattcctttcgtccccatctccggatttgagggtgacaatatgattgagaggtccaccaaccttgactggtacaagggtccaacccttcttgacgcccttgactctatcagtgagcctaagaggccctcagacaagcccctccgtctcccacttcaggatgtctacaagattggaggcattggaactgtccctgtgggtcgtgttgagactggtgtcatcaagcctggtatggttgtgacttttggtcccactgggcttaccactgaagttaagtctgttgaaatgcaccatgaggctctcctagaggctcttcctggtgacaatgttggcttcaacgttaagaatgttgctgtcaaggatatcaagcgtggatttgttgcctccaactccaaggatgatcctgccaaggaggcagccaacttcacctcccaagttatcatcatgaaccaccctgggcagattggaaatggttatgctcccgtccttgactgccacacctcccatattgctgttaagttttctgagatcctgaccaagattgacaggcgatctggtaaggaacttgagaaggagcctaaatttttgaagaatggagatgcagggattgtgaagatgattcccactaagcccatggtggtggaaactttctctgagtatcccccacttggtcgttttgctgtcagggacatgcgtcaaactgttgctgtcggagttgtcaagagtgtggagaagaaggatccatctggagccaaggtgaccaagtctgctgccaagaagaagtgaattgtgcggtttggggtttctgcaagtgaagctcatcataggtggtgttttaataaggaatgggttcttgctagtaagttatcaatcatgagtctaaggctttgttttgttggttatagcttcaattttccgtcttcatcacgtaggtgctgttcacagaactgggtgcttgaccgacggtggcagggttattttcctcgagtccatagtgttttttgttttcttaaggtgtcttatgagacttatttattttcataagcagcaatggagttttaggtctgttcttatgctgccgggatgtttactatttacattttatatttatctagtttttg

SEQ ID NO: 769 - DNA, 1914 bp, Fagus grandifolia
ggctgagacgtcattttggtttgagccgttggatttaataatcagacggctggagataaaccctagtcgcaccaagaaccaaaaatactacttaaaccattaagaaaccaaataagtcttcctcttcctcttgctctatacgctctcgatctcttcgactgcgtgagagctcccacctaatccatttcaatttccttatttagcttaagattttacaatgggtaaagagaaggttcacataaacattgtggtcattggccatgtcgactctggaaagtcgaccaccactggacatttgatttacaagcttggaggcattgacaagcgtgtaattgagaggtttgagaaggaggctgctgagatgaacaaaaggtcattcaagtatgcatgggttttggacaagctaaaggctgagcgggagcgtggtatcaccatcgacattgcattgtggaagtttgagactactaaatattattgcactgtcattgatgcacctggacatcgggactttatcaagaacatgattacgggtacctcacaggctgattgtgctgtccttattattgattctactactggtggatttgaagcgggtatttccaaggatggtcagactcgtgagcatgctttgcttgccttcacccttggtgtcaagcaaatgatctgctgttgtaataagatggatgcaacaactccaaaatactctaaggcaaggtatgatgaaattgtaaaggaagtttcttcctatcttaagaaagtaggttataaccctgacaagatcccattcgtccctatttctgggtttgagggtgacaacatgattgagaggtcaaccaacctggactggtacaagggccctaccctacttgacgcccttgacttgattgtggagccaaagagacccacagacaagcctctccgactcccacttcaggatgtctacaagattggtgggattggaactgtccctgtggggcgtgttgaaactggtattatcaaaccaggtatggttgtaacttttggacctactggactgacaactgaagttaagtcggttgagatgcatcatgaggctctcctggaggccttgcctggtgacaatgttggtttcaatgtgaaaaatgttgctgtcaaggatctcaaacgtgggtttgttgcatccaactcaaaggatgatcctgcaagggaagctgctaacttcacatctcaagtcattatcatgaaccatcctggccaaattggcaatggttatgccccagtacttgactgccacacctcccacattgctgtgaaatttgctgaaattttgaccaagattgataggaggtctggcaaggagcttgagaaggagccaaaattcttgaagaatggagatgctgggtttgtcaagatgattccctccaagcccatggtggtggagactttctccgagtacccgccacttggacgatttgctgtgagggacatgcgtcaaactgtagctgttggtgttatcaagagtgtggagaagaaggatccaagtggtgcaaaggtcaccaagtctgctgttaaaaagaaatgagtgttttatttttggaaggcaatagcaaaagaaacagtctattttctttctttatttattgtcatttttttctagattggttttgtggcttttgttgttgcttccagcttcatttataggggactggtggtggtttaaagcacccaggccaccttaccttggtgcttgataggcggtagcaaaagcttggagccatctggttgatgctttttttagtaagtatcgattttcttagtttcatgtaagaacaaattggtatttgtttggcttctgaattgttggatttaaatctatttatatgtgaagcaagtttaatacaactgtaatgtcacccttaatatacaaaaaaaaaa

SEQ ID NO: 770 - DNA, 1760 bp, Beta vulgaris
gctctcctctcctcactgcggctagggtttttcctctactttgaagtttctcataagataccaacatgggtaaggaaaagattcatatcagtttggtggtcattggccacgtcgattctggaaagtcgaccaccactggtcacttgatctacaagcttggaggtattgacaagcgtgtgatcgagagatttgagaaggaagctgctgagatgaacaagaggtccttcaagtatgcctgggtgcttgacaaacttaaggcagagcgtgagcgtggtattaccattgatattgccttgtggaagtttgagactaacaagtactactgcacagtcattgatgcccccggacatcgtgactttatcaagaacatgattactggaacctcccaggctgattgtgctatcctcattattgactccaccactggaggttttgaggctggtatctccaaggatggtcaaacccgtgagcacgcacttcttgccttcacccttggtgtcaagcaaatgatttgctgctgtaacaagatggatgccaccacacccaagtactcaaaggctaggtatgaggaaatcgtgaaggaagtctcttcatacctcaagaaggttggttacaacccagacaaaatcccattcgttcccatttctgggttcgagggtgacaacatgattgagagatccaccaacctcgactggtacaagggaccaactcttcttgaggcccttgacttgatcaacgagccaaagaggccctcagacaagccccttcgtctcccactccaggatgtgtacaagattggaggtattggaacggtgcccgttggacgtgttgagactggtgttttgaagcctggtatgcttgttacttttggtcctactggactgaccactgaagttaagtcagtggagatgcaccacgagtctcttccagaggctctgcctggtgacaatgttggcttcaacgtcaagaatgttgctgtcaaggatctcaagcgtggttttgtggcttctgactcaaagaatgaccccgccaaggaagcagctaacttcattgctcaggtcatcatcatgaaccaccctggacagatcggaaatggttatgccccagtgcttgattgccacacctcccacattgctgttaagtttgctgagcttgtgaccaagattgacaggcgttcaggtaaggagattgagaaggagcccaagttcttgaagaatggtgatgctggtatggttaagatgattcccaccaaacctatggtggtggaaactttctcagagtacccaccccttggtcgttttgccgtcagagacatgaggcagactgttgctgttggtgtcatcaagaatgttgagaagaaggacccaaccggtgccaaggttaccaaggcagccctcaagaagaagtgaatggttttggctccgattgttgctgatattggtttccattacaagtattatacagacttgttttttattagtagtttttgtgtgttttatttgaacttttgttttctatgtcgtaaactcttgtcttcagcgtcttctggcacttattctcagaattgggtgctggatcgacggtggcatgattttggtctgcagtgctctgcttggtcctatgttggacgtgtcggtttagtattttgatgtcagataccctttgaggttgttttcatgatgtcaagttgcttttacctattatcgaactaaactttgtcaagtattgccgttccttgtttaatgttagtagattgtttc

SEQ ID NO: 771 - DNA, 1539 bp, Vaccinium corymbosum
cgcctccttcacgaagtgtcttcctgcgagcttgacttttgtggttgaaaatgggtaaggaaaaggttcatattaacattgttgtcattggccatgttgactctggcaagtcgaccacaactgggcatctcatttacaagcttggaggtattgacaaacgtgtgattgagaggttcgagaaggaagctgctgaaatgaacaagaggtcattcaagtacgcatgggtgttggacaagctcaaggctgagcgtgaacgtggtatcaccattgatattgctctgtggaaatttgagaccaccaagtactactgcacggtcattgacgctcctggtcatcgtgattttatcaagaacatgattactggaacgtcacaggctgactgtgctgttctcatcatcgattccaccactggtggttttgaagctggtatctctaaggatggccagacccgtgagcatgctcttcttgctttcacccttggtgtgaagcaaatgatttgctgttgtaacaagatggatgccaccactcccaagtactcaaaagcaaggtatgatgaaatcgtgaaggaagtgtcttcttacctgaagaaggtgggctacaaccctgaaaaaatccccttcgtcccaatctctgggtttgagggtgacaacatgattgagaggtcaaccaacctcgactggtacaagggccccaccctccttgaggccctcgacatgatctcagagcccaagaggccatcagacaagcccctccgccttccccttcaggacgtctacaagatcggtggcattggaactgtaccggttgggcgagttgagactggtgttgtcaagcccggaatggttgtcacctttgggcccacagggttgaccactgaagtcaagtccgtcgaaatgcaccacgaagctttgcaggaggccttacctggtgacaatgtagggttcaatgtgaagaatgttgctgtgaaggatctcaagcgtgggtttgttgcatcaaactctaaggatgatccagcaagagaggccgcaaatttcacgtctcaggttattatcatgaatcatccaggtcaaattggaaatgggtatgccccagttcttgactgccacacttcccacatcgctgtcaagtttgctgagatcttgaccaagattgaccgacgatctggcaaggagattgagaaggaacccaagttcttgaagaatggtgatgccggtatggtgaagatgattccgaccaagcctatggttgtggagacattctccgagtacccacctttgggaaggtttgctgtcagggacatgcgccagacagttgctgttggtgttatcaagagtgtggagaagaaggatccatccggtgctaaggtcacgaagtccgctgccaagaagaagtgaagcatggagtctggttggagttcggtcaattgctatcacaaaaaagacctggtttttgctgtttctattttaagttatttagttgatctagtttgtttctttttccgtgacagttttttggcgtcgcttcctggttgttgctccc

SEQ ID NO: 772 - DNA, 1602 bp, Vaccinium corymbosum
ctccgcctccttcacgaagtatcttcctgcgagcttgacttttgtggttgaaaatgggtaaggaaaagtttcatattaacattgttgtcattggccatgtcgactctggcaagtcgaccacaactgggcatctcatttacaagcttggaggtattgacaagcgtgtgattgagaggttcgagaaggaagctgctgaaatgaacaagaggtcattcaagtacgcatgggtgttggacaagctcaaggctgagcgtgaacgtggtatcaccattgatattgctctgtggaaatttgagaccaccaagtactactgcacggtcattgatgctcctggccatcgtgactttatcaagaacatgattactggaacgtcacaggctgactgtgctattctcatcattgattccaccactggtggttttgaagctggtatctctaaggatggccagacccgtgagcatgctcttcttgctttcacccttggtgtgaagcaaatgatttgctgctgtaacaagatggatgccaccactcccaagtactcaaaagcaaggtatgatgaaatcgtgaaggaagtgtcttcttacctgaagaaggtgggctacaaccctgaaaaaatcccctttgtcccaatctctgggtttgagggtgacaacatgattgagaggtcaaccaaccttgactggtacaagggccccaccctccttgaggccctcgacatgatctcagagcccaagaggccatcagacaagcccctccgccttccccttcaggacgtctacaagattggtggcattggaactgtcccggtcgggcgggttgagactggtgttatcaagcccggaatggttgtcacctttgggcccacagggttgaccactgaagtcaagtccgtcgaaatgcaccacgaagctttgcaggaggccttacctggtgacaatgtagggttcaatgtgaagaatgttgctgtgaaggatctcaagcgtgggttcgttgcatcaaactctaaggatgatccagcaagagaggcagcaaatttcacgtctcaggttattatcatgaatcatccaggtcaaattggaaatgggtatgccccagttcttgactgccacacttcccacatcgctgtcaagtttgctgagatcttgaccaagattgatcgacgatctggcaaggagattgagaaggaacccaagttcttgaagaatggagatgccggtatggtgaagatgattccgactaagcctatggttgtggagacattctctgagtacccacctttgggaaggtttgctgttagggacatgcgccagacagttgctgttggagttatcaagagtgtggagaagaaggacccatcaggtgctaaggtcacaaagtctgctgccaagaagaagtgaagcatggagtctggttggagttcgatcaattgctatcacagaaaagacctggtttttgctgtttctattctaagttatttagttgatctagtttgtttcttttttcgtgacagctttttgtcgtcgcttcctggttgctgctcccgtaattgggtgctggaccggcggtggcaacaatgacatttatgcttggaattctaagttt

SEQ ID NO: 773 - DNA, 1703 bp, Vaccinium corymbosum
ctctctctcttcactctagcgtctctctgagcagctaaggttctctccgcctccttcacgaagtatcttcctgcgagcttgacttttgtggttgaaaatgggtaaggaaaagtttcatattaacattgttgtcattggccatgtcgactctggcaagtcgaccacaactgggcatctcatttacaagcttggaggtattgacaagcgtgtgattgagaggttcgagaaggaagctgctgaaatgaacaagaggtcattcaagtacgcatgggtgttggacaagctcaaggctgagcgtgaacgtggtatcaccattgatattgctctgtggaaatttgagaccaccaagtactactgcacggtcattgacgctcctggtcatcgtgactttatcaagaacatgattactggaacgtcacaggctgactgtgctgttctcatcattgattccaccactggtggttttgaagctggtatctctaaggatggccagacccgtgagcatgctcttcttgctttcacccttggtgtgaagcaaatgatttgctgctgtaacaagatggatgccaccactcccaagtactcaaaagcaaggtatgatgaaatcgtgaaggaagtgtcttcttacctgaagaaggtgggttacaaccctgacaaaatcccctttgtcccaatctctgggtttgagggtgacaacatgattgagaggtcaaccaacctcgactggtacaagggccccaccctccttgaggccctcgacttgatctcagagcccaagaggccatcagacaagcccctccgccttccccttcaggacgtctacaagatcggtggcattggaactgtcccggtcgggcgggttgagactggtgttgtcaagcccggaatggttgtcacctttgggcccacagggttgaccactgaagtcaagtccgtcgaaatgcaccacgaagctttgcaggaggccttacctggtgacaatgtagggttcaatgtgaagaatgttgctgtgaaggatctcaagcgtgggttcgttgcatcaaactctaaggatgatccagcaagagaggcagcaaatttcacgtctcaggttattatcatgaatcatccaggtcaaattggaaatgggtatgccccagttcttgactgccacacttcccacatcgctgtcaagttttctgagatcttgaccaagattgaccgacgatctggcaaggagattgagaaggaacccaagttcttgaagaatggagatgccggtatggtgaagatgattccgaccaagcctatggttgtggagacattctccgagtacccacctttgggaaggtttgctgttagggacatgcgccagacagttgctgttggtgttatcaagagtgtggagaagaaggatccatcaggtgctaaggtcacgaagtccgctgccaagaagaagtgaagcatggagtctggttggagttcggtcaattgctatcacaaaaaagacctggtttttgctgtttctattctaagttatttagttgatctagtttgtttctttttccgtgacagttttttggcgtcgcttcctggttgttgctcccataattgggtgctggaccggcggtggcgacaatgaagttttatgcttggaattctaagttttgaattttttattttgcgaggagttaaagacaatttctatttatcgaggattttgc

SEQ ID NO: 774 - DNA, 2244 bp, Theobroma cacao
aaccgttggatgaaaatccgacggtccaacatcactagggttttgcgaagtgaacggtagagtttgaagacagtctggcaaacgtaatgggtagcatggtaattttgcactcaggtcatgttggactccacgtggcggaattttaaccgtagattgaaatttggaagaatctaatctaacggcagaacgagaaaccctaatctccactagggttttatatataatacacttcctcagtgctttctctcattactcaactctttctctcgcctgccgattgataaagcttgggaaattcaagttttatctgctaaaaagtcgctatgggtaaggaaaaggttcacattaacattgtggtcattggccatgtcgactctggaaagtcaaccaccaccggtcacctgatctacaagcttggaggtattgacaagcgtgtgattgaaaggttcgagaaggaggctgctgagatgaacaagaggtcattcaagtatgcctgggtgcttgacaagttgaaggctgagcgtgagcgtggtattaccattgatattgccttgtggaaatttgagaccaccaagtactactgcactgttattgatgcccctggacatcgtgactttatcaagaacatgattactggtacctctcaggctgactgtgctgtccttatcattgactccaccactggaggtttcgaagctggtatttccaaggatggacagacccgtgagcatgctcttcttgccttcactcttggtgtgaagcaaatgatttgctgctgcaacaagatggatgccacaacccccaaatactcaaaggcaaggtatgatgaaatcgtgaaggaagtgtcttcatacttgaagaaggttggatacaaccctgacaagattcccttcgtccccatttctggttttgagggtgacaacatgattgagaggtccaccaaccttgactggtacaagggtccaacacttcttgaggctcttgaccagattaacgagcccaagagaccctctgacaagcccctccgtctcccacttcaggatgtgtacaagattggaggtattggaactgttccagtgggtcgtgttgaaaccggtgtcctcaagcctggtatggttgttacattcgggccctccggattgaccactgaagttaagtctgttgaaatgcaccatgaggctcttcaggaggctcttcctggtgacaatgttgggttcaatgtgaagaatgttgctgtcaaggatctcaagcgtggttttgttgcctcaaactcaaaggatgatcctgccaaggaggcagccaacttcacctcccaagtcatcatcatgaaccaccctgggcagattggaaacggttatgccccagttcttgattgccacacctgccacattgctgtcaagtttgcggagctcttgaccaagattgacaggcgttccggtaaggagcttgagaaggagcccaagttcttgaagaatggtgatgctggtatggttaagatggttcccaccaagccaatggttgtggaaaccttctccgcgtaccccccacttgggcgttttgctgtgagggacatgagacagactgttgctgttggtgtcatcaagaatgtggagaagaaggacccaagtggagccaaggtgaccaagtctgctgccaagaagggtggcaagtgaaacttgcttctgtctgtttttgcttgtggattgtgcgattttattctcatagttgcgaggttggttatgttgagcatccagatgcaaacctgggtgcttgacagacggtggcgagatcttttattatttttatatgtttttcttaaggttttgtaacttcatcccggacttgataattttgtgtttttaattttatttgagttgagacttaagactaatttattatttcatagtttttatcttgtttgcctctttaagtttatttgcaactgttatgttgatctcttctgggcaggttgcaaatcattctgggggaatttccaagtctccaaaattagattgcaaaagttgatgttctgaattaacgcagtatatactaattgttgttagcttaaaattaaaaactttgtcctgctattttcattgcgaaccaagttctttctaatttttcaatactattaccgggcctttctatttgggcctaccttcggaccctccaaaaccgtacagccctatataggaacttgatctgcaatttaaaattgtaatataaaaaatcaatttctttttt

SEQ ID NO: 775 - DNA, 1951 bp, Cannabis sativa
ttttattttaatttttaccttcactacttttatatatgatgttctcattatattctttagattaatataaatttatggttgtttaaaattgtttgatttttaactgggtttttaatgtttattatgatttgggtttttgaatttgtagtttgcaatttgattcgaaatgggaaaggaaaagatccacatcaacatcgtggtcatcggccatgtcgactccggcaagtcgaccaccactggtcaccttatctataagcttggaggaattgacaagcgtgtgattgagaggtttgagaaggaagctgctgagatgaacaagaggtctttcaagtatgcttgggttcttgacaagcttaaggctgagcgtgagcgtggtatcaccattgacattgccctgtggaagtttgagaccaccaagtactactgcacagtcattgatgctcctggccatcgtgactttatcaagaacatgattactggtacttcacaggctgattgtgctgttctcatcattgattccaccactggtggttttgaagctggtatctctaaggatggacagacccgtgagcatgctcttcttgctttcacccttggtgtcaggcagatgatctgttgttgtaacaagatggatgccaccacacccaaatactccaaggccaggtatgaggaaatcgtgaaggaagtctcttcctacttgaagaaggttgggtacaaccctgacaaaatcccattcgttcccatctctggtttcgaaggagacaacatgattgagaggtctaccaaccttgactggtacaagggtccaactcttcttgaagctcttgacaatctctctgagcccaagagaccctcagacaagccactccgtcttccacttcaggatgtctacaagattggtggtattggaactgtgccagtgggtcgtgttgagactggtgtcatcaagcctggtatggttgtcacctttgctcccaccggtctgaccactgaggtcaagtcagttgagatgcaccacgaggctcttctcgaggctcttcccggtgacaatgttgggttcaatgttaagaatgtggcagttaaggatctcaagcgtggttacgttgcatccaactccaaggatgatcctgccaaggaggcagccaacttcactgctcaggtcattatcatgaaccaccctggtcaaattggcaacggctatgccccagttctcgactgccacacctcccacattgctgtcaagttttctgaaatcctaaccaagattgaccgtaggtctggtaaggagctcgagaaggagccaaagttcttgaagaacggtgatgcaggtatggttaagatggttccaaccaagcccatggtggttgaaaccttcgctgagtacccaccactcggacgttttgctgtccgtgacatgcgtcaaaccgttgctgttggtgtcatcaagagtgtggagaagaaggacccatcaggagctaaggtgaccaagtctgctgccaagaagaagtgacttttgcaaatggaaattgcactggatggtgtttggaagaactatttatctgtttatcgaaataagttgtcattttatttttactgtgttgttttgaactatctattcggttttgtttgggatcgtcttgtttgtctgtgctcgctttccagtcgttgcactcagaattgggtgctcgaccggcggtggtagcattccgtttgagtttgttttgttttgcacttagttgtgcttgaacagtattatttatcagttttacaatatcctactttttattttgttacattgtgtttttctggttttttctatctgttatgtctttttatatgcatcttttgatttttaaagggaatggtcaatcgatattactggatacatcatgagctgttgaactaagtacagtacatagaaataataaagttatgatcttcactaaaaaaa

SEQ ID NO: 776 - DNA, 2754 bp, Ricinus communis
ctactcctactcctatccctattcagtattccttatccaaatcctgttaaataagtatgtcggataaaatactagttcatgttttcctattcctagtattactcggtcacacgttaatcatttcctacttccgaaagaattaacccactaaatttttataaagcaccactgccatcatcaaacaatcccacctcaaagataatattaagattacatttaatatcttaattcctcctccttcaaatttcaggcgactgacgagtaagatgatgaattctaaaagtctctttgaaagtgacaaggacaacgactcattcaagaaagatttgaagaacaaaaaatgttacaaggaagcttttattttctgtaacagaattaaagatcacttgagtgatcatgacaagtattggcaattcctaaggtgtttgtatttgtacaaccagggagtgattgcggatacgaacttgagaaacaaggttgctgatttgatcggaaacgatttcaagcttttacaagatttcgatgaatttttgactcaacgcgacgtcgacttcaccaaaacctagcagcctattcggtggtttgacttttagaaggttccttcactgttgcgtctgggcaagttcgtcgttgtgtttttttgtcgagggtatttatgtaaataaacttacagtgcctgctcagaaaaccctagcctgtgttttcactataaaagtgatcgtttctgcttgatttgcctacaattggccctgtttttgctccgtttcgttcggcagggcttttgttagagtttctctacttcaatttcttaagttttaggcatcaataatgggtaaggagaaggttcacatcaacattgtggtcattggccatgtcgactctggaaagtcaactactactggccatctcatctataagttgggaggtattgacaagcgggttattgagagattcgagaaggaagctgctgagatgaacaagaggtcattcaagtatgcttgggtgcttgacaagcttaaggccgagcgtgagcgtggtatcaccattgatattgccttgtggaagtttgagaccaccaagtactactgcaccgtcattgatgcacctggacatcgtgactttatcaagaatatgattaccggtacctcacaggctgactgtgctgttctgattattgattccaccactggtggttttgaagctggtatttccaaggatggtcagacccgtgagcatgctctccttgctttcaccctcggtgtcaagcaaatgatttgctgctgcaacaagatggatgctactactcccaagtactccaaggccaggtatgatgaaattgtcaaggaggtttcctcttacctgaagaaggtcggatacaaccccgataaaattcctttcgttcccatctctggcttcgaaggtgacaacatgatcgagaggtccaccaaccttgactggtacaagggaccaaccctacttgaagctcttgaccagatcaatgagccaaagaggcccacagacaagcctcttcgtctcccacttcaagacgtttacaagattggtggtattggaacagttccagtgggtcgtgtggagactggtgtcctcaagcctggtatggttgtgacctttggacccagtggactgacaactgaagttaagtcggttgaaatgcatcacgaggcactccaggaggccctccctggtgacaatgttggtttcaatgttaagaatgttgctgtcaaggatcttaagagaggttttgttgcttcaaactccaaggacgatccagcaaaggaggcagccaacttcacatcccaagtcatcatcatgaaccatcctggtcagattggaaatggatatgctccagtgttggactgtcatacctcccacattgctgtgaagtttgctgagatcctaacgaagattgatcgtcgatccggtaaggagcttgagaaggagcccaaattcttgaagaatggtgatgctggtttcgtgaagatgattccaaccaagcccatggttgttgagaccttctccgagtaccctccattgggtcggtttgctgttagggacatgcgccaaactgttgcagtgggtgttatcaagagtgttgagaagaaggacccaagcggagctaaggtcaccaagtctgccgccaagaagggaggaaaatgagagttcaattattagctgttcttggaagggttttttaaatgtacattgtctagttgctacagccacatatttgccttgtataggcagtggacgtgtagtatttttgttgcaccattttgttttggatgtttgaggcatttttctagcgaggtttatgtatggttgagattgagaattacttatgtatgccaactgataatgagagaacaaagtctactgtttctagctttatccattttctttcagggtcgccgccgccaattagcttctgtacagcaaatcatccacattactgccttgtgtgagagaggaaagacaggtgctgctctggcttgcttggggaaaatggttgatgttggatgccattccttcacctttcacttttagctccttgtcggaatgggcattctgatttcatcaagtccttgattgatatcatgcaagattggggcatggttccacttattcagtaatggtaaatgaatactgtcaacaaaaggatcgcatttcttgttttggatcagatggaaaagaaacgactgaaacctaacttttgctgtctacgactccatcatt

SEQ ID NO: 777 - DNA, 1710 bp, Cirsium arvense
ttttgctgctcttctccgtttctcaacctcgatcatctgagaaagctaagctcgatttcatcatgggtaaggaaaaggttcacatcaacattgttgtcattggtcatgtcgactctggaaagtcaaccactactggtcacttgatctacaagcttggaggtattgacaagcgtgtgattgagcgtttcgagaaagaagctgctgagatgaacaaacgttctttcaagtatgcctgggtgttggacaaacttaaggccgagcgtgaacgtggtatcaccattgatatcgccttgtggaagtttgagaccaacaagtactactgcactgtcattgatgcccctggccatcgggactttatcaagaacatgattaccggaacctctcaggctgattgtgctgtcttgattatcgattccaccactggtggtttcgaagctggtatttcaaaggatgggcagacccgtgagcatgctttacttgccttcacccttggcgttaggcaaatgatctgttgttgcaacaagatggatgcaactactcctaagtactcaaaggctaggtatgatgaaatcattaaggaagtgtcatcttacctcaagaaagttggatacaatcctgacaaaatcccattcgttccaatctctggttttgagggagataacatgattgagaggtcaatcaatctcgactggtacaagggtccaacccttcttgaagcgcttgaccagcttaacgaaccaaagaggccatcagacaagccacttcgtctcccactccaggatgtttacaagattggtgggattggaactgtgcctgttggccgtgttgaaactggggttatcaagcctggtatggtcgttacttttggcccaaccggtctgaccactgaagttaagtctgttgaaatgcatcatgaagcacttcttgaggcgttgcctggtgacaacgttggtttcaatgtgaagaatgttgctgtgaaagatcttaagcgtggctatgttgcttcaaactccaaggacgatccagcaaagggtgcggctagcttcactgctcaggtcattatcatgaatcaccctggccaaatcggaaatggatacgcacctgttcttgattgccacacttcgcacattgcggttaagtttgctgagctgttgaccaagattgacagaaggtcgggtaaggagctggagaaggagccgaagtttttgaagaatggtgatgctggtatggtgaagatgattccgaccaagcctatggtggtggagacgttttctgaataccctcctcttggacgttttgcggtgagggatatgcgtcaaactgttgctgttggtgtgattaagagtgtggataagaaggacccgactggtgcaaagataacaaaggctgctatcaagaagaagtgaaccggcccttttattagtttgaaacttttggagttattatttgttttgttatgtcttttgaacatttctgattgtgtgttttgtggtgttttctgctgccatcttctaccaccatttcttggaatggtggttctgttgcgtttccgggttcatacttgggtgcttgacagacggtggcagaagatatggttgttggtttgagtatttggttcttgtcaaaaacttatatgaagattatggatttatgtgtcttgaattttcattcaaggtcttttttacaaaaaagaagaaagtaccgactgcg

SEQ ID NO: 778 - DNA, 1652 bp, Gossypium hirsutum
atctgtttcctctaagatcctagctaacagtgcataatgggtaaggagaaggttcacatcaacattgttgttataggacatgtcgactctggaaagtcgaccaccactggtcacttgatctacaagcttggtggtatcgacaagcgtgtgatcgaaaggtttgagaaggaagctgctgagatgaacaagaggtcattcaagtatgcttgggtgcttgacaagttgaaagcagaacgtgagcgtggtattaccattgatattgccttgtggaagtttgagaccaccaaatactattgcactgtcattgatgctcccggacatcgtgactttatcaaaaacatgatcactggtacctctcaggctgactgtgctgtccttatcattgactccaccactggaggtttcgaggctggtatttcaaaggatgggcagacacgtgaacatgctttgcttgcctttactcttggtgtgaagcaaatgatttgttgttgcaacaagatggatgccacaactcccaaatactcaaaggcaaggtacgatgaaatcgtgaaggaggtttcttcatacttgaagaaggttggttacaaccctgagaagattccattcgtccctatctctggttttgagggtgacaacatgattgagagatcgaccaaccttgattggtacaagggtccaactctgctcgaggctcttgaccagatcaatgagcccaagcgaccctctgacaagccccttcgtctcccacttcaggatgtctacaagattggtggtattggaactgtcccagtgggtcgtgttgaaactggtatcctcaagccaggtatggttgttactttcggtccttcgggattaaccactgaagttaaatccgttgaaatgcaccatgaggctctttccgaggctcttcctggtgacaatgtcggtttcaatgttaagaatgttgctgtcaaggatctcaagcgaggattcgttgcttctaactcaaaggatgatccagcgaaggaggcagccaacttcacctcccaagtcatcatcatgaaccatcctggccagattggaaacggatatgctcctgtccttgattgccacacctcccacattgctgtcaagttttcagaaatcttgaccaaaatcgatagacgatccggtaaggagcttgaaaaggagcccaagttcttgaagaacggcgatgctggattgattaagatggttcccaccaagcccatggttgtggaaaccttttccgagtatcccccactcggtcgtttcgctgtgagagacatgaggcagacagttgctgtcggtgtcatcaagaatgtggagaagaaggatccaactggagccaaggtaaccaagtccgctgccaagaagaagtgaaccgaacaaattttgggtgattcaaaaaacctctattgtagtgactacaatagaactttagttgtgtccttaatccgaactatagttacatgttttgatggttatcgttttaagttgtcaccgtcttctggaggatcttcttcacagaactgggttcttgatagacggtggtgaggcttaaatgatgtcttttatgtgctcttattttccattatatcattctcgaaactttttagctcatttcctggattcttcttgaatggtttaatcaa

SEQ ID NO: 779 - DNA, 1841 bp, Gossypium hirsutum
agaggcttgctcgaaaacctatactctctgattatctctcttcttcgagccgctaggtcgtactgttttagcttcaagtctctcttttttgaaagttcctagttaatactggataatgggtaaggagaaggttcacatcaacattgttgtcattggccatgttgactctggaaagtcaaccacaacgggtcacttgatatacaagcttggaggtattgacaagcgtgtgatcgagaggttcgagaaggaagctgctgagatgaacaaaaggtcattcaagtatgcctgggtgctcgacaagttgaaggctgagcgtgagcgtggtatcaccattgatattgccttgtggaagtttgagacaaccaagtactactgcactgtcattgatgctcctggacatcgcgactttattaagaatatgattacgggtacttctcaagctgactgtgctgtccttatcattgactccacaactggaggttttgaagctggtatttccaaggatgggcagacccgtgagcatgctctccttgccttcacccttggtgtcaagcaaatgatttgctgctgcaacaagatggatgccacaacccccaagtactcaaaggcaaggtatgatgaaattgttaaggaagtttcttcttacctgaagaaggttggttacaaccctgagaagattccattcgtccccatctctggttttgagggtgacaacatgattgagaggtccaccaacctcgattggtacaagggtccaaccctccttgaggctcttgaccagatcaatgagcccaagagaccctctgacaagcccctccgtctcccacttcaggatgtctacaagattggtggtattggaactgtcccagtgggtcgtgttgaaactggaatcctcaagcctggaatggttgttacattcggaccttctggattgaccactgaagttaagtctgttgagatgcatcatgaagctcttcaagaggctcttcctggtgacaatgttgggttcaatgtgaagaatgttgctgtcaaggatctcaagcgtggatttgttgcctccaactccaaggatgatcctgccaaggaggcagccaacttcacctcccaagttatcatcatgaaccacccaggacagattggaaatggctatgcaccggtcctcgattgccacacctcccatattgctgtcaagtttgcagagctcttgaccaagattgacaggcgatctggtaaggagcttgagaaggagcctaagttcttgaagaatggtgatgctggtatgattaagatggttccgaccaagcccatggttgtggaaactttctccgagtaccctccacttggacgttttgccgttagggacatgagacagactgttgctgttggtgtgatcaagagtgtggagaagaaggacccaactggagccaaggtgacgaagtctgctgccaagaagggcaagtgaacctcaggggattttgttgattcaacaacagtttatcatggttactacaataaaactttggttcatgttagtaggtccatcactggacgtttagttacatgttttaatggttcaccgtcatctcttggatattggtcccagaactgggttcttgataggcggtggtgaggtttatctttggagttcatagtgtgtcatcattaatgttattatgccttatcgagctataaacttcttgatattttttgttcccatttttccaccaaagtggtcctggagctttaggtctgttcctgggctccgttccttcactcaatgttctatctaaacgttttatattatacaactctaaaacttgtttctgttttatttttgccga

SEQ ID NO: 780 - DNA, 1778 bp, Gossypium hirsutum
ccttcctccgagccgttaggttgtactgttttagcttcaagtctctcttttttgaaagttaatactacacaatgggtaaggagaaggttcacatcaacattgttgtcattggccatgttgactctgggaagtcaaccacaacgggtcacttgatctacaagcttggaggtattgacaagcgtgtgattgagaggtttgagaaggaagctgctgagatgaacaaaaggtcattcaagtatgcctgggtgctcgacaagttgaaggctgagcgtgagcgtggtatcaccattgatattgccttgtggaagtttgagacaaccaagtactactgcactgtcattgatgctcctggacatcgtgacttcattaagaatatgattacgggtacttctcaagctgactgtgctgtccttatcattgactccacaactggaggttttgaagctggtatttccaaggatgggcagacccgtgagcatgctctccttgccttcactcttggtgtcaagcaaatgatttgctgctgcaacaagatggatgccacaacccccaagtactcaaaagcaaggtatgatgaaattgttaaggaagtttcttcctacctgaagaaggttggttacaaccctgagaagattccattcgtccccatatctggttttgagggtgacaacatgattgagaggtccaccaacctcgattggtacaagggtccaaccctccttgaggctcttgaccagatcaatgagcccaagagaccctctgacaagcccctccgtctcccacttcaggatgtctacaagatcgggggtattggaactgtcccggtgggtcgtgttgaaaccggtacccttaagcctggaatggttgttacattcggaccttctggattgaccactgaagttaagtctgttgagatgcatcatgaagctcttcaagaggctcttcctggtgacaatgttgggttcaatgtgaagaatgttgctgtcaaggatctcaagcgtggatttgttgcctccaactccaaggatgatcctgccaaggaggctgccaacttcacctcccaagttatcatcatgaaccacccaggccagattggaaatggctatgcaccggtcctcgattgccacacctcccacattgctgtcaagtttgcagagctcttgaccaagattgacaggcgatctggtaaggagcttgagaaggagcctaagttcttgaagaatggtgatgctggtatgattaagatggttccgaccaagcccatggttgtggaaaccttctccgcgtaccctccacttggacgttttgccgttagggacatgagacagactgttgctgttggtgtaatcaagagtgtggagaagaaggacccaactggagccaaggtgaccaagtctgctgccaagaagggcaagtgaacctcaggggattttgttgattcaacaaaagtttatcatggttactacaataaaattttggttcatgttagtaggtccatcactggacgtttagttacatgttttaatggttcaccgtcatctcctggatattgttcccagaactgggttcttgataggcggtggtgaggtttatctttggagtccatagtgtgtcatcattaatattattatgccttattgagctataaacttgatattttttgttcccatttttcgaccaaagtggtcctggagttttacctcttttcctgggctcctttccttcactcaatgttctatctaaaccttttatattatccaagtctataacctgtttct

SEQ ID NO: 781 - DNA, 1783 bp, Gossypium hirsutum
tctcactctctcttctctgccgatttctccgttcttcaaaatttaagttttttctgctaaaaagttgctatgggtaaggagaaggttcacatcaacattgttgtcattggccatgtcgactctgggaagtcaaccacaacgggtcacttgatctacaagcttggaggtattgacaagcgtgtgattgagaggttcgagaaggaagctgctgagatgaacaaaaggtcattcaagtatgcctgggtgcttgataagttgaaggctgagcgtgagcgtggtatcaccattgatattgccttgtggaagtttgagacaaccaagtactactgcactgtcattgatgctcctggacatcgcgacttcattaagaatatgattacgggtacttctcaagctgactgtgctgtccttatcattgactccacaactggaggttttgaagctggtatttccaaggatgggcagacccgtgagcatgctctccttgccttcactcttggtgtcaagcaaatgatttgctgctgcaacaagatggatgccacaacccccaagtactcaaaggcaaggtatgatgaaattgttaaggaagtttcttcctacctgaagaaggttggttacaaccctgagaagattccattcgtccccatctctggttttgagggtgacaacatgattgagaggtccaccaacctcgattggtacaagggtccaaccctccttgaggctcttgaccagatcaatgagcccaagagaccctctgacaagcccctccgtctcccacttcaggatgtctacaagatcggtggtattggaactgtcccggtgggtcgtgttgaaaccggtacccttaagcctggaatggttgttacattcggaccttctggattgaccactgaagttaagtctgttgagatgcatcatgaagctcttcaagaggctcttcctggtgacaatgttgggttcaacgtgaagaatgttgctgtcaaggatctcaagcgtggatttgttgcctccaactccaaggatgatcctgccaaggaggcagccaacttcacctcccaagttatcatcatgaaccacccagggcagattggaaatggctatgcaccggtcctagattgccacacctcccatattgctgtcaagtttgcagagctcttgaccaagattgacaggcgatctggtaaggagcttgagaaggagcctaagttcttgaagaatggtgatgctggtatgattaagatggttccgaccaagcccatggttgtagaaaccttctccgcgtaccctccacttggacgttttgccgttagggacatgagacagactgttgctgttggtgtgatcaagagtgtggagaagaaggacccaactggagccaaggtgaccaagtctgctgccaagaagggcaagtgaacctcgggggaatttgttgattcaacaaaagtttatcatggttactacaataaaattttggttcatgttagtaggtccatcactggacgtttggttacatgttttaatggttcaccgtcatctcctggatattgttcccagacctgggttcttgataggcggtggtgaggcttatctttggagtccatagtgtgtcatcattaatgttattatgccttaatgagctataaacttgatgatattttttgttcccttttttccatctaagtggtcctggagttttacctctcttcgtgggctgctttccttcactcaatgttctatctaaaccttatattatccaagtctatagcctgcttctgtttta

SEQ ID NO: 782 - DNA, 2387 bp, Eucalyptus grandis
gcaggagcaaaccctcttcactcgctcccagccactctctctcttcgtccttctccttctcgagcctcgtcgttcgcagcttagatatctcatcatgggtaaggagaaggttcacatcaacattgtggtcattggccatgtcgactctgggaaatcgactacaactggtcacttgatctacaagctaggaggtattgacaagcgtgtcattgagaggttcgagaaggaggcagctgaaatgaacaagaggtcattcaagtatgcctgggtccttgacaagctcaaggcggagcgtgagcgtggtatcaccattgatattgccttgtggaagtttgagaccaccaagtattactgcacagtcattgatgctcctggacatcgtgacttcatcaagaacatgattactggaacttcccaggctgactgtgctgtcctcatcatcgactccaccactggtggttttgaggctggtatttccaaggatggccagacccgtgagcatgctcttcttgccttcactcttggtgtgaagcagatgatttgctgctgcaacaagatggatgccaccacacccaagtactccaaggcccgttatgatgaaattgtgaaggaagtctcttcatacttgaagaaagttgggtacaatcctgacaagattccttttgtccccatctctggttttgagggtgacaacatgattgagaggtccaccaaccttgactggtacaagggccccaccctcctcgacgctctcgaccagatctcggagccaaagaggcctacagacaagcctctccgtctcccacttcaggatgtgtacaagattggtggtattggaactgtccctgtcggtcgtgttgagactggtgtcttgaagccgggtatggttgtcacttttggacccactggattgaccactgaagttaagtctgttgagatgcatcacgaggctctccaggaggccctccctggtgacaatgttgggttcaatgtcaagaacgttgccgtgaaggatctcaagcgtggttttgttgcttccaactccaaggatgatcctgccagggaggctgctagcttcgcttcccaggtcatcatcatgaaccaccccgggcagattggcaacggctatgctcctgtccttgattgtcacacttcccacattgctgtgaagttttctgagttgctgaccaagattgacagacggtctggtaaggagcttgagaaggagcccaagttcttgaagaacggtgatgctggaatggtgaagatgatccccaccaagcctatggtcgtcgagactttctcggagtaccctcctcttggtcgttttgctgtcagggacatgcgtcagaccgtggccgtcggtgtcatcaagagtgtggagaagaaggacccaaccggtgccaaggtcacaaagtccgctgtcaagaagaagtgaggctgctgtcgattgcaggattgcggagctctatcattttaagtgtctcatacatgtctttatttgaagggcctcggattttaggttttgcggaggggtttgctcattctaaagtcatttagtcttagtaactctgaggagacattttagtttgccttaaattttgcttttactagactcgtatggattttggtgacgtttatatttttacttgggcctactgcactgttttgtcagatgatctgtagttccttctgtctgacactcctattttgtatgtgcttaattctagtgcgtgtgcttgctcatggaaagtgtagccctggctatgctaccttcgccaaaaaggtccgactgataatttgatcttcgtgttaacctctttgagtcgcgtgattgaatggatggctaagatgaaggagggaacgaaaccttgggcgagtgaaggaactgcattgattgatgctcgatgtcttcattgatgcgaggaaattattggagaacttccgactgaggagttaaaaggcggtcgagcgtttttccatcctccgggtggtggctcttaacgcaacctacggattggagatgatggggctaaatttattcttcatgtatagaaccagctcgccggcgcactgcaggattaactatgggcgaatttggcgattcgtgagtcattgctgcgatgcgaacggtgaaaatcgggcgatgagtgatgattcccctattcgacttatgaaaccacagacgacgactgcgagattttcccacgctacatcaccgctggaaaattcattgaggcggaacaaaaccgtccaaagtgctacgttctgataatgtgggcagattgtgtccggtacaaatttcttctaggaactcctgtccaggatgtgctcgtattttggttgtgaaagggaaatgaagtgtaaataaatctaatgaatactag

SEQ ID NO: 783 - DNA, 2278 bp, Eucalyptus grandis
gccacttcgctctccatttccacacccaccttcctcgtcttctccattcgcttcgccagcgctcgagcggccgaagggtttttggttttggtggccgaggcatcaggagaatcaagccttataattcaagatgggtaaggaaaaggttcacatcagcattgtggtcattggccatgtcgactctggtaaatcaactaccactggccacttgatttacaagcttggaggaatcgacaagcgtgtgattgagagattcgagaaggaagctgctgagatgaacaagagatcattcaagtacgcctgggtgcttgacaagctcaaggccgagcgtgagcgtggaatcaccattgatattgccttgtggaagttcgagaccaccaagtactactgcaccgtcattgatgctccgggacatcgtgatttcattaagaacatgattactggaacctcccaggctgactgtgctgtccttatcatcgattccacaactggtggttttgaagctggtatctccaaggatggccaaacccgcgagcatgctctccttgccttcaccctcggtgtcaagcaaatgatctgctgctgtaacaagatggatgccaccacccccaagtactccaaggctaggtatgatgaaattgttaaggaagtctcttcttacctgaagaaggtgggatataaccctgacaagattccatttgtccccatctccggattcgagggagacaacatgattgagaggtctaccaaccttgactggtacaagggtccaacattgctcgacgccctcgaccagattaatgagcccaagagaccatctgacaagcccctccgtctcccacttcaggacgtgtacaagattggtggtatcggaactgtccctgtcggccgtgttgagactggtgtcattaagcctgggatggttgtcacttttggtccctctgggttgaccactgaagttaagtccgtggagatgcaccatgaggctctccaggaggctcttccaggtgacaacgttgggtttaacgtgaagaatgttgctgtcaaggatctcaagcgtggctacgttgcatccaactcgaaggacgatcccgccaaggaagcagccaactttacctcccaagttattatcatgaatcaccctggccagattggaaatggatatgcccctgttcttgactgtcacacctcccatattgcagtcaagttttctgagctggtgaccaagatcgacaggcgatcaggtaaggagattgagaaggagcccaagttcttgaagaacggtgatgctggaatggtcaagatgattcccaccaagcccatggttgtcgagaccttctctgagtatcctcccctcggtcgttttgctgtgagggacatgcgccagaccgtcgccgttggtgtcatcaagagtgtcgagaagaaggatcctagtggtgccaaggtcaccaagtctgctgccaagaagggcaagtgaatcgtgcggttgagattcgacatcgtatcacatgggagtcattgcaataaggcgttggtcattgtcagctgtctgtctatcggtcatttaggggtttggtgcgctggttatcaccatctcatgttcctgtcctcatcgagcacgtggttgcagaactgggtgctcgataggcggtggcagattggggtcgccagctcgagtcaattttgagtcttgcgtttgtgcactggcatttgtactgtctttgctttctttccgtaccagctgagagtctactattggtcatttttcaatgcagttcaggccttcgtattatgccccctttgcatggtatattatcaattggtcttgctgttagaaaaagcaataaggcacgtcctgatcgcgcgtagcataacaagagcagctgaaccatgtataatcatcgtcgatgacgatcgattttcaagattactgtggtaatgatgagaattaattggttctccactgcataaaactcagtacttttttacctattaagaaaatatttggtataacactattgtggactagcttataaactcgaaaggagttaccgacgaaatgtcagttcccgaaattcttgattgaggccgccgacaatgagtgaaaatgatcgtattcttaaatcgaattggacaagagacgacgaaatgtcagttcccgaaattcttgaatgaggccaccgacaaggagttaaaaatgatcgtattcttaaatcgaattggactagagatttttggctacaggacctggtagtccttagatcaaaatgccccgcgt

SEQ ID NO: 784 - DNA, 2022 bp, Eucalyptus grandis
agtggtatcaacgcagagtggtcattacggcacggtgccacccgcgcattcatttccccgtcgtctctttcgctggttgattcactggttttcgagattctcggcggccgagattttccgagctttaagccccatatctcgaaatgggtaaggagaaggttcacatcaacattgtggtcattggccatgtcgactctggcaagtcaactaccactggccacttgatttacaagcttggaggtatcgacaagcgtgtgattgagagattcgagaaggaagctgctgagatgaacaagagatcgttcaagtacgcttgggtgcttgacaagctcaaggccgagcgcgagcgtggtattaccattgatattgccttgtggaagttcgagaccaccaagtactactgcaccgtcattgatgctcctggacatcgtgactttattaagaatatgattactggaacctcccaggccgactgtgctgtccttatcattgattccaccactggtggttttgaagctggtatttccaaggatggccagacccgtgaacatgctctccttgctttcaccctcggtgtcaggcaaatgatttgctgctgtaacaagatggatgccaccacccccaagtactccaaggctaggtatgatgaaattgttaaggaagtctcttcttacctgaagaaggtgggatataaccctgacaagattccatttgtccccatctccggattcgagggagacaacatgattgagaggtctaccaaccttgactggtacaagggtccaacattgctcgaggccctcgaccagattaatgagcccaagagaccatctgacaagcccctccgtctcccacttcaggacgtgtacaagattggtggtatcggaactgtccctgtcggccgtgttgagactggtttaattaagcctgggatggttgtcacttttggtccctctggattgaccactgaagttaagtccgtggagatgcaccatgaggctctccaggaggcccttccaggtgacaacgttgggtttaacgtgaagaatgttgctgtcaaggatctcaagcgtggttatgttgcttccaactcaaaggacgatcccgccaaggaagcagccaacttcacctcccaagttatcatcatgaaccaccccggacaaatcggaaatggttatgcccctgttcttgactgccacacctcccacattgctgtcaagtttgctgagctggtgaccaagattgacaggcgatctggtaaggagcttgagaaggaacccaagttcttgaagaatggtgactctgggatggtgaagatgatccccaccaagcccatggtcgttgagactttctctgagtatcctcccctcggtcgttttgccgtgagggacatgcgtcagaccgtcgccgtcggcgtcatcaagaatgtggagaagaaggatcctagtggtgccaaggtcacaaagtctgctgccaagaagggtggcaagtgaattgcgtggttcattgtcggcacttcaacatttgagcatcgtctcctcaggtggagtaataaatctttggcagttgttggctatgtccatgttggtcgggtgggcaaatggtttgctggttgtggcctcgcgttcctatcctcatcgagttgctggttgcagaactgggtgcttgacaggcggtggcggcgcttttttacttctatgagtctgttttgagtctttcttttacttgtattctgtgtctttcggggccaaacaggtgtgtttctgagtctgctttgttttctggatattggtatagatattctgttgaagtgccgtgcaggagagtggtgagctcctgcgctctattatatggatttgcatgcttttactgatatttagtgtttattatgtgtgtgtctgtgattagggtcgtcaatgggtcaggtcgggttttggcgttacctgacccgacccaaaatgcataatacctgaagcaataattcggtccggtccaggttgggttctgggtctacattttttt

SEQ ID NO: 785 - DNA, 1558 bp, Flaveria ramosissima
agattattccccaagtttttttgatatctcagaatgggtaaggaaaagactcacatcagcattgtggtcattggacatgtcgactccggcaagtcaacgaccactggccatttgatttacaagcttggaggaattgacaagcgtgttatcgagaggtttgagaaggaagctgctgaaatgaacaagaggtcattcaagtacgcctgggttcttgacaaactgaaagctgagagagaacgtggaattaccattgatattgctttgtggaagtttgagactaccaagtactattgcactgttattgatgcacccggacacagagatttcatcaagaatatgattactggtacatcccaggctgattgtgctgtcttgattattgactcgactactggtggttttgaagctggtatctccaaagatggtcagacccgagagcatgctctgcttgcttttactcttggtgtgaagcaaatgatctgctgttgtaacaagatggatgccaccactcctaaatactccaaatcaagatatgaagaaattgttaaggaagtttcttcatacctgaagaaggttggttacaacccagacaaaatcccatttgtacccatctccggttttgagggtgacaacatgattgagaggtctacaaaccttgactggtacaagggtccaacactccttgaagctcttgaccagatcaacgagccaaaaagaccttctgacaaaccacttcgtctaccccttcaagacgtgtacaagattggaggtattggaactgtgcccgttggtcgtgtcgaaactggtgtaatcaaacctggtatggttgtcactttcggtccatctgggttgaccactgaagtcaagtcagttgaaatgcaccacgaggccctaaccgaagctctccctggtgacaacgtcgggttcaatgtcaagaacgttgcagtcaaggatctgaaacgtggttacgttgcttccaactccaaggatgaccccgccaagggtgcagccagtttcacctcacaggtcatcatcatgaaccaccctggtcagatcggaaacggatatgccccagtcctggattgccacacttctcacattgcagtcaagttctccgagcttttgaccaagattgaccgtcggtccggtaaagaacttgagaaagagcccaagtttttgaagaacggtgatgctggtatggttaagatgcttccaaccaagcccatggtcgttgaaacctttgcagagtacccaccacttggcaggtttgcagttcgtgacatgaggcagacggttgctgttggtgtgatcaagagtgtcgataagaaggacccgactggagccaaggtgaccaaggctgcagccaagaagggagccaagtgatggtgcgggtgtgtgtcgtttgggaccgatggacttgttttattcatgtttttggactattttaattatgtttattttggtatttggtcttgttgcttgcattattgtactctagcctcagttgtgaggatgggtggaggtattgagcaacttgttgcttgatgacaatgctgca

SEQ ID NO: 786 - DNA, 1417 bp, Flaveria ramosissima
tggggatcactctccacaaatcggctagcagattattccccaagtttttttgatatctcagaatgggtaaggaaaagactcacatcagcatcgtggtcattggacatgttgactctggcaagtcaacaaccactggtcatttgatttacaagcttggaggaattgacaagcgtgttatcgagaggtttgagaaagaagctgctgaaatgaacaagaggtcattcaagtatgcctgggttcttgacaaactgaaagctgaacgagaacgtggaattaccattgatattgctttgtggaagttcgagactaccaagtactattgcactgttattgatgcacccggacacagagatttcatcaagaatatgattactggtacatcccaggctgattgtgctgtcttgattatcgactcgactactggtggttttgaagctggtatctctaaagatggtcagacccgagagcatgctctgcttgcttttactcttggtgtgaagcaaatgatctgctgttgtaacaagatggatgccaccactcctaaatactccaaatcaagatatgaagaaattgttaaggaagtttcttcatacttgaagaaggttggttacaaccccgacaaaatcccatttgtacccatctccggtttcgagggtgacaacatgattgagaggtctacaaaccttgactggtacaagggtccaacacttcttgaagctcttgaccagatcaacgagccaaaaagaccctctgacaaaccacttcgtctgccccttcaagacgtgtacaagattggaggtattggaactgtgcccgtcggtcgtgtcgaaactggtgtaatcaaacccggtatggttgtcacttttggtccatctgggttgaccactgaagtcaagtcagtcgaaatgcaccacgaggccctaaccgaagctcttcctggtgacaatgttggattcaacgtcaagaacgttgcagtcaaggatctgaaacgtgggtacgttgcttccaactccaaggacgacccggccaagggggcagccagtttcacctcacaggtcatcatcatgaaccaccctggtcagatcggaaacggatatgccccagtcctggattgccacacttctcacattgcagtcaagttctccgagcttttgaccaagattgaccgtcggtccggtaaagaacttgagaaagagcccaagtttttgaagaacggtgatgctggtatggttaagatgcttccaaccaagcccatggtcgttgaaacctttgcagagtacccaccacttggcaggtttgcagttcgtgacatgaggcagacggttgctgttggtgtgatcaagagtgtcgataagaaggacccgactggagccaaggtgaccaaggctgcagccaagaagggagccaagtgatggtg

SEQ ID NO: 787 - DNA, 1505 bp, Flaveria ramosissima
cttcttcgtcttcctccatccaccgcacaagtcgtctgcatatcaatcgttaaggatgggtaaagaaaagactcacatcagtattgttgtcattggacatgtcgactccggcaagtctacaacaactggacacttgatctataagcttggaggaattgacaagagagtcatcgaaagattcgagaaggaggctgctgagatgaacaaaaggtcattcaaatacgcctgggttcttgacaagctcaaggccgagcgtgaaagaggtatcaccatcgatattgcattgtggaagtttgagacaaccaagtactactgcacagtcattgatgctcctggacatcgtgactttatcaaaaacatgattactggtacttcccaggccgactgtgcggtgcttatcattgattccaccactggtggttttgaagctggaatttccaaggatggtcagacccgtgagcacgctcttcttgctttcactcttggtgtcaagcaaatgatttgctgctgtaacaagatggatgccacaacaccaaagtactccaagtcaaggtatgaggaaattgtgaaggaagtttcatcttacctgaagaaggttggatacaaccctgacaaaatcccatttgttccaatctctggttttgagggagacaacatgattgagaggtcaaccaaccttgactggtacaagggtccaacccttcttgaagctcttgaccaaatcaatgagcccaagagaccatcagacaagccccttcgtcttccacttcaggacgtgtacaagattggtggtattggaactgtgccagtgggacgtgttgagactggtgtgatcaagcctggtatggttgtcacttttggaccatctggattgaccactgaagtcaagtctgttgagatgcaccatgaagccttgactgaggctcttcctggtgacaatgtggggttcaatgttaagaacgttgctgtcaaggatctcaaacgtggttatgtagcatcaaactccaaggatgacccggctaagggtgctgctagcttcacctcccaggttatcatcatgaaccaccctggtcaaatcggtaacggttatgcacctgttcttgattgccacacctcccacattgctgtcaagttctctgagcttttgaccaagatcgacagacgatctggtaaggaacttgagaaagagcctaaattcttgaagaacggtgatgctggtatggtaaagatgcttcccaccaagcctatggttgttgagactttttcagagtacccaccacttggtaggtttgctgtgagagacatgcgtcaaacggttgctgtgggtgtgatcaagagtgttgagaagaaggacccaacaggagccaaggttaccaaggccgcagtgaagaagggagctaagtgaggtggtgtgttttggtttaatggtgtatttttattttcaatgatgtttcatttactagttttggacttaattttcttaagagttttgttatttgatcctt

SEQ ID NO: 788 - DNA, 1718 bp, Flaveria ramosissima
acaattcacaagcagattattccccaagtttttttgatctctcagaatgggtaaggaaaagactcacatcagcattgtggtcattggacatgtcgactccggcaagtcaacgaccactggtcatttgatttataagcttggaggaattgacaagcgtgttattgagaggtttgagaaagaagctgctgaaatgaacaagaggtcattcaagtatgcgtgggttcttgacaagttgaaagctgaacgtgaacgtggaattactattgatattgctttgtggaaatttgagactaccaagtattattgcactgttattgatgcacctggacacagagatttcatcaagaatatgattactggtacgtcccaggctgattgcgctgtcttgattatcgactctaccactggtggtttcgaagctggtatctctaaagatggtcagacccgagagcacgctctgcttgcttttacccttggtgtgaagcaaatgatttgctgttgtaacaagatggatgccaccactcctaaatactccaagtcaagatatgaagaaattgttaaggaagtttcttcatacctgaagaaggttggttacaacccagacaaaatcccatttgtacccatctccggttttgagggagacaacatgattgagaggtcaacaaaccttgattggtacaagggtccaacactccttgaagctcttgaccagatcaacgagccaaaaagaccttctgacaaaccacttcgtctaccccttcaagatgtttacaagattggaggtattggaactgtgcccgtcggtcgtgttgaaactggtgtaatcaaacctggtatggttgtcacttttggtccatctgggttgaccactgaagtcaagtcagttgaaatgcaccatgaagccctaaccgaagctctccctggtgacaacgtcgggttcaacgtcaagaacgtcgcagtcaaggatctgaaacgtggttacgttgcatccaactccaaggatgacccagccaagggtgctgccagtttcacctcacaggtcatcatcatgaaccaccctggtcagatcggaaacggatatgccccagttctggactgccacacttctcacatcgcagtcaagttctccgagcttttgaccaagattgaccgtcgttccggtaaagaactcgagaaggagcccaagtttttgaagaatggtgatgctggtatggttaagatgcttccaaccaagcccatggtggttgagacgtttgcagagtacccaccacttggcaggtttgcagttcgtgacatgaggcagacggttgctgttggtgtgatcaagagtgttgataagaaggacccgactggagccaaggtgaccaaggctgcagccaagaagggagccaagtgatggtgtgggtgtgtgtcgtttgggaccgatggacctgttttaatcatgttttgaactattttaattatgtttattttggtatttggtcttgtggcttgcattattgtactctagcctcagttgtgaggatgggtggaggtattgagcaacttgttgcttgatgacaatggtgcaagatttacaggaaccagattttggtcaaattgtgctgctactttttgcaactttaattgtggttcaacttataagtttttcaaattgttttgttatttatggttacttctagttttactacttttagactagttcaaatgtattttaa

SEQ ID NO: 789 - DNA, 1437 bp, Flaveria ramosissima
ttcttcgtcttcctccatccaccacacaagtcgtctgcagatcaatcgttaaggatgggtaaagaaaagactcatatcagtattgttgtcattggacatgtcgactccggcaagtccacaacaactggacatttgatctacaagcttggaggaattgacaagagagtcatcgaaagattcgagaaggaggctgctgagatgaacaaaagatccttcaaatacgcctgggttcttgacaaacttaaggccgagcgtgaaagaggtatcactattgatattgccttgtggaagttcgagacaaccaagtactactgcactgtcattgatgctcctggacatcgtgatttcatcaagaacatgattaccggtacctcccaagctgactgtgcagtgcttatcattgattccaccactggtggttttgaagctggtatttccaaggatggtcagacccgtgagcatgcgcttcttgctttcactcttggtgtcaagcaaatgatttgctgctgtaacaagatggatgccacaacaccaaagtactccaagtcaaggtatgaggaaattgtgaaggaagtgtcatcttacttgaagaaggtgggatacaaccctgacaaaatcccattcgttccaatctctgggttcgaaggagacaacatgattgagagatcaaccaaccttgactggtacaagggtccaactcttcttgaagcacttgaccagatcaatgagcccaagagaccatcagacaagcccctccgtcttccacctcaggacgtgtacaagatcggtggtattggaactgtgccagtgggacgtgtcgagactggtgtgatcaagcctggtatggttgtcacttttggaccatctggattgaccactgaagttaagtctgttgagatgcaccatgaagctttgactgaggctcttcctggtgacaatgttgggttcaacgttaagaatgttgctgtcaaggatctcaagcgtggttatgttgcgtccaactccaaggatgacccagctaagggtgctgctagcttcacctcccaggttatcatcatgaaccaccctggtcaaatcggtaacggttatgcacctgttcttgattgccacacctctcacattgctgtcaagttctctgaactgttgaccaagatcgacagacgatctggtaaggaacttgagaaggagcctaaattcttaaagaatggtgatgctggtatggttaagatgcttcccaccaagcctatggttgtcgagactttcgcagagtatccaccacttggtaggtttgccgtcagagacatgcgtcaaacggttgctgtgggtgtgatcaagagcgttgagaagaaggacccaacaggagccaaggttaccaaggctgcagtgaagaagggagccaagtgaggtggttttgtgttttggtttatggtgtatttt

SEQ ID NO: 790 - DNA, 1775 bp, Gossypium raimondii
gccgctggggttttagcttcaactctctctctctctctctctctctgtttcctctaagatcctagctaacagtgcataatgggtaaggagaaggttcacatcaacattgttgttataggacatgtcgactctggaaagtcgaccaccactggtcacttgatctacaagcttggtggtatcgacaagcgtgtgatcgaaaggtttgagaaggaagctgctgagatgaacaagaggtcattcaagtatgcttgggtgcttgacaagttgaaagcagaacgtgagcgtggtattaccattgatattgccttgtggaagtttgagaccaccaaatactattgcactgtcattgatgctcccggacatcgtgactttatcaaaaacatgatcactggtacctctcaggctgactgtgctgtccttatcattgactccaccactggaggtttcgaggctggtatttcaaaggatgggcagacacgtgaacatgctttgcttgcctttactcttggtgtgaagcaaatgatttgttgttgcaacaagatggatgccacaactcccaaatactcaaaggcaaggtacgatgaaatcgtgaaggaggtttcttcatacttgaagaaggttggttacaaccctgagaagattccattcgtccctatctctggttttgagggtgacaacatgattgagagatcgaccaaccttgattggtacaagggtccaactctgctcgaggctcttgaccagatcaatgagcccaagcgaccctctgacaagccccttcgtctcccacttcaggatgtctacaagattggtggtattggaactgtcccagtgggtcgtgttgaaactggtatcctcaagccaggtatggttgttactttcggtccttcgggattaaccactgaagttaaatccgttgaaatgcaccatgaggctctttccgaggctcttcctggtgacaatgtcggtttcaatgttaagaatgttgctgtcaaggatctcaagcgaggattcgttgcttctaactcaaaggatgatccagcaaaggaggcagccaacttcacctcccaagtcatcatcatgaaccatcctggccagattggaaacggatatgctcctgtccttgattgccacacctcccacattgctgtcaagttttcagaaatcttgaccaaaatcgatagacgatccggtaaggagcttgaaaaggagcccaagttcttgaagaacggcgatgctggattgattaagatggttcccaccaagcccatggttgtggaaaccttttccgagtatcccccactcggtcgtttcgctgtgagagacatgaggcagacagttgctgtcggtgtcatcaagaatgtggagaagaaggatccaactggagccaaggtaaccaagtccgctgccaagaagaagtgaaccgaacaaattttgggtgattcaaaaaacctctattatagtgactacaatagaactttagttgtgtccttaatccgaactatagttacatgttttgattgttatcgttttgagttgtcaccgtcttctggaggatcttgttcacagaactgggttcttgatagacggtggtgaggcttaaatgatgtcttttatgtgctcttattttccattattacattcgcaaaactttgtaggtcatttcctggattcttcttgaatggtttaatcaatattttatatcattttaaattgtttttcatttgtattatctccatgatcctttttatgatttttattaatcttttctatca

SEQ ID NO: 791 - DNA, 2282 bp, Gossypium raimondii
ctgtttaaatcacgtgatacttcaagcacgtgtacatgaagaatatatttgtcaaaacaaatctcctgaggggtattttagaaaagataaagtaggcaaacctgagtacaaaatagaacaagaggcttgctcgaaaacctatactctctgattatctctcttcttcgagccgctaggtcgtactgttttagcttcaagtctctcttttttgaaagttcctagttaatactgcataatgggtaaggagaaggttcacatcaacattgttgtcattggccatgttgactctggaaagtcaaccacaacgggtcacttgatatacaagcttggaggtattgacaagcgtgtgatcgagaggttcgagaaggaagctgctgagatgaacaaaaggtcattcaagtatgcctgggtgctcgacaagttgaaggctgagcgtgagcgtggtatcaccattgatattgccttgtggaagtttgagacaaccaagtactactgcactgtcattgatgctcctggacatcgcgacttcattaagaatatgattacgggtacttctcaagctgactgtgctgtccttatcattgactccacaactggaggttttgaagctggtatttccaaggatgggcagacccgtgagcatgctctccttgccttcactcttggtgtcaagcaaatgatttgctgctgcaacaagatggatgccacaacccccaagtactcaaaggcaaggtatgatgaaattgttaaggaagtttcttcctacctgaagaaggttggttacaaccctgagaagattccattcgtccccatctctggttttgagggtgacaacatgattgagaggtccaccaacctcgattggtacaagggtccaaccctccttgaggctcttgaccagatcaatgagcccaagagaccctctgacaagcccctccgtctcccacttcaggatgtctacaagatcggtggtattggaactgtcccggtgggtcgtgttgaaaccggtacccttaagcctggaatggttgttacattcggaccttctggattgaccactgaagttaagtctgttgagatgcatcatgaagctcttcaagaggctcttcctggtgacaatgttgggttcaatgtgaagaatgttgctgtcaaggatctcaagcgtggatttgttgcctccaactccaaggatgatcctgccaaggaggcagccaacttcacctcccaagttatcatcatgaaccacccaggacagattggaaatggctatgcaccggtcctcgattgccacacctcccatattgctgtcaagtttgcagagctcttgaccaagattgacaggcgatctggtaaggagcttgagaaggagcctaagttcttgaagaatggtgatgctggtatgattaagatggttccgaccaagcccatggttgtggaaactttctccgagtaccctccacttggacgttttgccgttagggacatgagacagactgttgctgttggtgtgatcaagagtgtggagaagaaggacccaactggagccaaggtgacgaagtctgctgccaagaagggcaagtgaacctcaggggattttgttgattcaacaaaagtttatcatggttactacaataaaactttggttcatgttagtaggtccatcactggacgtttagttacatgttttaatggttcaccgtcatctcttggatattgttcccagaactgggttcttgataggcggtggtgaggtttatatttggagtccatagtgtgtcatcattaatattattatgccttatcgagctataaacttcttgatattttttgttcccatttttccaccaaagtggtcctggagctttaggtctgttcctgggctcctttccttcactcaatgttctatctacacgttttatattatccaactctaaaacttgtttctgttttatttttgccgatgtttatgatctcatctagctctactatcagtttttatcgctgttttagcacttaattgtatcacctttcagaatcacatctatattattagaattcatgaatgtaatgacgggctaatgatcctaggatatgctaggaggcagtgataacgtactaggtgcttttcagttttaaggtgtaatcttataatctcatcttatattaggtaatggtgaacggtgtgaattctcttctaatgaaacgcgtgggttttaaaaaaaaaagttattcaatttaattttagagaaaaacaaaaattagtaataaaataggtaaagtac

SEQ ID NO: 792 - DNA, 2035 bp, Vitis vinifera
ggtaattctaaatatgaaaaagggtgtttttagtcaaataggaaaagcagagtctgttctatataaagttcccagtagagaatttcctcaggtgcgactagggttttagcaactccgttgttctctctgcgcagtctcttgctttcaagttcctagcaaagaattcataatgggtaaggagaaggtccacattaacattgtggtcattggccatgttgattctggtaagtcaaccacaactggccatctgatctacaagcttggaggaattgacaagcgtgtcattgagcgatttgaaaaggaggctgctgagatgaataagcggtcattcaagtatgcctgggtgcttgacaagctcaaggctgagcgggagcgtggtatcactattgacattgcattgtggaagtttgagaccaccaaatactactgcacagtcattgatgctcctggacatcgtgacttcatcaagaatatgattactggaacctcccaagctgactgtgctgtccttatcatcgactctactactggaggctttgaagctggcatttccaaggatgggcagactcgtgagcatgctctccttgctttcacccttggtgtcaggcagatgatctgctgctgcaacaagatggatgctacaacccctaagtactcaaaggcgagatatgatgaaattgttaaggaagtctcttcctacttgaagaaggttggctacaaccccgacaagattccttttgttcccatctctggtttcgaaggagacaacatgatagagaggtcaaccaaccttgactggtacaagggccccacccttcttgaggcccttgacatggttcaagagccaaagagaccctcagacaagcccctccgactcccacttcaggatgtctacaagattggtggcattggcactgtcccagtgggacgggttgagactggtatcctcaagcctggtatggttgtgacttttggtcccactggactgaccactgaagtaaagtcagtggagatgcaccatgagtctctcgtggaggctctccccggtgacaatgttgggttcaatgtgaagaatgtggctgtcaaggatctcaagcgtggctttgttgcatcaaactccaaggatgatcctgccaaggaggcagcaaacttcatatcccaggttattatcatgaaccaccctggccagattggcaatggctatgcccctgttctggattgccacacatcccatattgctgtcaagtttgctgagatcatgaccaagattgacagacggtctggtaaggaacttgagaaggagcccaagttcttgaagaatggtgatgcaggtttggttaagatgattcccaccaagcccatggtggttgagaccttctctgagtatccccctctagggcgtttcgctgtgagggacatgcgtcagacagtggctgtaggagtcatcaagaacgtggaaaagaaggatccttcgggagccaaggtcacaaagtctgctgccaagaagaagtgaaccgcacagttatgcatatcttcaattgaaattgaagagtacaagtacaatgataataaagactggtttctcgtgtgtatttgtatgggatgcagaggtggtgtttttgctggttataggtttacgtggtcaccttcatcgtgtggctgttcccagagctgggtgcttgaccggcgatggcagggctattatggagtctagcgtgctttccatgtgtgtttttcattttcaatgtgttggatcaactgttatacttgtttaactttttaagcgctcaggattgtttctgagcttactaattatagccttggcctattatgtgattggtttggttatatgtgagttttagatcatcagctcatcatcttgaatattcctgcaaccttgaaagtggagcggtttcggttgggaacccacgaatacaacgtggaagtgaggtttgatctaaatatatctacccccttcattggtttgctagggctatgtttagttgagggaagaaaaaacatgttaaaaaggaag

SEQ ID NO: 793 - DNA, 1716 bp, Humulus lupulus
cgctgagctgctgcagagaaataatttttcattcttcgcggccacttcgagctcttctgagtttacaattttgattcgtaatgggtaaggaaaagatccatatcaacatcgtcgtcatcggccatgtcgactccggcaagtcgaccacaactggtcaccttatctataagcttggaggaattgacaagcgtgtgattgagaggttcgagaaggaagctgctgaaatgaacaagaggtcattcaagtatgcttgggttcttgacaagcttaaggctgagcgtgagcgtggtatcactattgacattgccctgtggaagtttgagaccaccaagtactactgcacagtcatcgatgctcccggacatcgtgactttatcaagaacatgattactgggacttcacaggctgactgtgctgttctcatcattgattccaccactggtggttttgaagctggtatctccaaggatggacagacccgtgagcatgctcttcttgccttcacccttggtgtcaggcagatgatctgttgctgtaacaagatggatgccaccacgcccaaatactccaaggccaggtatgaggaaattgtgaaggaagtctcttcctacttgaagaaggttgggtacaaccctgacaaaatcccattcgttcccatctctggtttcgaaggagacaacatgattgagaggtctaccaaccttgactggtacaagggtcccactcttcttgaagctcttgacaacctctctgagcccaagagaccctcagacaagcccctccgtcttccacttcaggatgtctacaagattggtggtattggaactgtaccagtgggtcgtgttgagactggtgtcatcaagcctggtatggttgtcacttttgctcccactggtctgaccactgaagttaagtctgttgagatgcaccacgaggctcttctggaggctcttcctggtgacaatgtcggcttcaatgttaagaatgtcgcagttaaggatctcaagcgtggttatgttgcatccaactctaaggatgatcctgccaaggaggctgccaacttcactgcccaagtcattatcatgaaccaccctggtcaaattggcaatggctatgccccagttctcgactgccacacctgccacattgctgtcaagtttgctgaaatcctgaccaagattgaccgtaggtctggtaaggagcttgagaaggagcccaagttcttgaagaacggtgatgccggtatggttaagatggttccaaccaagcccatggtggtcgaaaccttcgctgagtacccaccccttggccgttttgctgtccgtgacatgcgtcagaccgttgctgttggtgttatcaagaatgtggagaagaaggacccatcaggagccaaggtcaccaagtctgctgccaagaagaagtgacttgtgcaaatggaaattgctgtggatggtgtttcgaagtactatttatctatctatcgtaataagttgttttatttttactgtgtggttttgaactatttattgagttttgtttggggtctttttagtttgtgctcgcttaccagtcgttgcactcagaattgggtgcttgacaggcggtggtcacttttcgtttgagtttgttttgcactatgttgtttcctgaaaagtattatattattagctttacaatgtcgaatttttgtcttgcactgttaaactcttttgcctt

SEQ ID NO: 794 - DNA, 1818 bp, Lactuca sativa
atttcccaattccctttcttctctgcacgctgagtttttctgctcttcggtggttctctatttcttcatcggagaaaatcaagcaacaaactcagtttcaccatgggtaaagagaaggttcacatcaacatcgttgtcatcggccatgtcgactccggaaaatcaaccaccaccggccacttaatctacaagctaggaggcatcgacaagcgtgtgatcgaaagattcgagaaagaagctgctgagatgaacaaacgttccttcaaatacgcatgggtcctcgacaaactcaaagctgaacgcgaacgtggtatcaccattgacatcgctttatggaaattcgaaaccaacaagtactactgcacagtcatcgacgcccctggccaccgtgacttcatcaagaacatgatcaccggaacttctcaagccgattgcgctgtcctcatcatcgactccaccaccggtgggtttgaagctggtatttccaaagatggtcaaacccgtgaacacgcccttttagctttcacactcggtgtcaggcaaatgatctgctgttgcaacaagatggatgctactactccgaaatactccaaagctagatacgatgaaatcgttaaagaagtttcttcatacttgaagaaagtcgggtacaacccggagaagattccattcgttccaatctccggtttcgaaggcgacaacatgatcgaaaggtcaacaaatcttgactggtacaagggccccactctcctcgaagcactcgaccaactcaacgaaccaaaacgcccatccgacaaacccctccgtctccctcttcaagacgtttacaaaatcggcggaatcggaactgttccagtgggtcgggtcgaaaccggtgttatcaaaccgggtatggtagtcaccttcggtccaaccgggctcacaactgaagtcaaatctgttgagatgcaccacgaggcgcttgtggaagctttacccggtgataatgtcgggttcaatgtgaaaaacgtggctgtgaaggatttgaaacgtgggtatgttgcttcgaattcgaaagatgacccggctaagggtgcggctaattttactgctcaggttattattatgaaccacccgggtcagattggaaacgggtatgcaccggttcttgattgtcatacttctcatattgctgtgaagtttgctgagctgttgactaagattgaccggaggtctggtaaggagctcgagaaggaacctaagtttttgaaaaatggtgatgcggggatggtgaagatgattccgactaagccgatggtggtggagactttctcggagtatcctccgttgggtcggtttgcggttagggatatgaggcagacggtggctgttggtgtgattaagagtgtggacaagaaggatccgaccggggctaagattaccaaggcggcggctaagaagaaatgaaccgccggttcgtttatggatttggatttgagagtgagttttggttttttgattttgagtttgtttatgattttggattttgtgtttcccttttgtggttggtgtcatcttttaccgctgtttcttggaacggtggttctgttacgtttccgggttgatacttgggtgcttgacagacggtggcacaggttatggtggttggtttggttgtgatgaagtgttttattttcatattttgattttgatgaacaatatatttgtgtgggttgtttagtgacaataataattggttgtttttaatagtttgttgcctgtttgatgtattttttcttttttaccacttaatttttgctaaatgatattgtggtccct

SEQ ID NO: 795 - DNA, 1733 bp, Lotus japonicus
atcactctgctagttagtttcctctttcgctcagtctctgtctctgcggctgaggattctgaacaagcaaccttcgatcctcctcagtttgagacgtcatgggtaaggagaagtttcacatcaacattgttgtcattggacatgtcgactctgggaagtcaactaccactggtcacttgatctacaagcttggaggtattgacaagcgtgttattgagaggtttgagaaggaagctgctgagatgaacaagaggtcattcaagtatgcctgggtgcttgacaagctcaaggcggagcgtgagagagggattaccattgatattgctttgtggaaattcgaaaccaacaagtactactgcacagtcattgatgcacctggacatcgtgatttcatcaagaacatgatcacaggaacatcccaggccgactgtgccgttcttattattgattccacaactggtggttttgaagctggtatttccaaggatggacagactcgtgagcacgctctccttgcattcactctaggagtcaaacagatgatctgttgctgtaataagatggatgccactacccccaagtattccaaggctaggtatgatgaaattgtgaaggaagtctcttcctacttgaagaaggttggttacaacccggacaagattccctttgttcccatctctggtttcgagggtgacaacatgattgagaggtccaccaaccttgactggtacaagggtccaactcttcttgaggctcttgaccagatcaacgagccaaagagacccacagacaagcctctaaggcttccattgcaggatgtctacaagattggtggtattggtactgtgcctgttggacgtgttgagaccggtgtcttgaaacctggtgtgttggtgacttttggccccactggactgacaactgaagtcaagtccgtggagatgcaccatgaggctttgcaagaggcccttccaggtgacaatgtgggattcaatgtgaagaatgttgcagtcaaggatctcaagcgtggtttcgtcgcctccaactctaaggatgaccctgccaaggaagctgctaacttcacatcccaagtcatcatcatgaaccatcccggccagattggaaacggatatgcaccggtgctcgactgccacacatctcacattgctgtgaagttttctgagatcctgaccaagattgacagacgatctggcaaggagattgagaaagagcctaaatttttgaagaatggtgatgcaggttttgttaagatgattcctaccaagcccatggtggttgaaactttctctgagtatcctccccttggtcgttttgctgtgagggacatgcgacaaacggtggccgtgggagtcatcaagagtgtggagaagaaggacccctctggagccaaggtaaccaaggctgcactgaagaagaagtgattgcattgtggcatcatttctgtttgtttatgtgaatcataatcatcatgtttccagaaaactgttgtttctctactgtagtttttctgttgagagtcctaggtttttgttttacccttatatttttcattccagtttgtttattactgttttttttttacttttaagaagagtctgaactgataatttcaattttcagaagcagctataggcttttatcagttcctttgctgctgagggatgatttaattgcatttaatttataagaaagttttgtccaatctttttctt

SEQ ID NO: 796 - DNA, 1783 bp, Momordica charantia
tccgcttccttactcgctcgtaaccctcgtttcttgattcggcttatcgatctctcttcgtcttcttgaggttactacaatttaaaaatgggtaaggagaaggttcacattaacattgtggtcattggccacgtcgactctgggaagtccaccaccaccggacacttgatctacaagcttggtggtattgacaagcgtgtcattgaaaggttcgagaaggaagctgctgagatgaacaagaggtcattcaaatatgcctgggtgttggacaagctcaaggcagagcgtgaacgtggtattaccattgatattgccttgtggaagtttgagaccaccaaatactactgcactgtcatcgatgcccctggacatcgtgatttcattaagaacatgattactggtacttcacaggccgattgtgctgtcctcattattgactccaccactggtggttttgaagccggtatctctaaggatggtcaaactcgtgagcatgccttgcttgcgtttactcttggtgtcaagcagatgatctgctgctgcaacaagatggatgcaaccacccccaagtactccaaggcaaggtatgatgaaattgtcaaggaagtttcctcctacctcaagaaggtgggttacaaccctgacaaaatcccattcgtccccatctctggttttgaaggagacaatatgatcgagaggtcaaccaaccttgactggtacaagggtccaaccctccttgaggctcttgacttaatctcggagcccaagaggccctcagacaagccactccgtcttccacttcaggacgtttacaagattggtggaattggaactgtacctgtgggacgtgttgagactggtatcctcaagccgggaatggtggtgacttttggccccactgggttgaccactgaagttaagtctgtggagatgcaccatgaagctctccaggaggcccttccaggtgacaatgttggcttcaacgtgaagaatgttgctgtgaaggatctgaagcgtggttttgttgcgtccaactctaaggatgaccctgccaaggaggctgccaacttcacttctcaggtcatcatcatgaaccacccgggacagattggcaatggttacgccccagtgcttgattgccacacctctcacattgccgtgaagttttctgagatcctgaccaagattgacaggcgttctggtaaggaacttgagaaagagcccaagttcttgaagaatggtgatgccggtatggttaagatggttcccaccaaacccatggtggttgagactttctccgagtacccacctctcggacgatttgccgtgagggacatgagacagactgtcgcagttggtgttatcaagaatgtcgagaagaaggatccatctggtgccaaggtcaccaagtctgcggccaagaagaagtgaaccgtgcttgctcaacctcagacagctccgtctgaggtttacaagtataaatgtcagaataaagaccttgttattcttggtgctgctttgtcgtcgagtcttttaaattgctttggtgatcatagttgttgcggctggttgtcaggtacccagtctcagaattgggtgcttgatagacggtggcacagctatatcttgtagtctctttttgtgctggtccgtttggtggcctctttgcttctgtgtcctgtttgagttcgaggtgctttggctcttccagagcggctcaaaagttttcgatttctatgtttctttggagatactacatactgcaaaactaatgccgtttctt

SEQ ID NO: 797 - DNA, 1779 bp, Lippia dulcis
ctttcttctctcgttcttctagctgagaattctctctcttgcatcggcggcagacacttctctcagttatcgtttccaagtgttctattaagagttcaacatgggtaaggagaagattcacattaacattgtcgttatcggacatgtcgactctgggaaatcgaccaccactggtcacttgatctacaagcttggtggtattgacaagcgtgtcattgagaggttcgagaaggaggctgctgagatgaacaaaaggtcattcaagtatgcctgggtgcttgacaagctcaaggcagagcgtgagcgtggtatcaccattgatattgccttgtggaagtttgagaccaccaagtactactgtaccgtcattgatgctcctggacatcgtgactttatcaagaacatgattactggaacctcacaggccgactgtgccgtcctgatcattgactccaccactggtggttttgaagctggtatttccaaggacggtcagacccgtgagcatgcattgcttgctttcactcttggtgtcaagcagatgatctgttgttgcaacaagatggatgctaccacaccaaaatactccaaggctaggtacgatgaaattgttaaggaagtgtcttcttacctgaagaaggtcggatacaacccggacaaaattccattcgtaccgatttctggatttgagggagacaacatgattgagagatcaaccaaccttgattggtacaagggaccaaccctccttgaggctcttgatcagatctctgagcccaagaggccctcagacaagcctctccgtctcccacttcaggatgtgtacaagattggtggtattggtaccgtacctgttggtcgtgttgagactggtgtcatcaaacctggtatggttgtgaccttcggtccctctggtctgaccactgaagttaagtctgttgagatgcaccacgaagccatgcaggaagctcttcccggtgacaatgtcgggttcaatgttaaaaatgttgccgtgaaggatctcaagcgtggttacgttgcctccaactccaaggatgaccccgccaaggaagcagccaacttcacctcccaggtcatcatcatgaaccaccctggtcagattggtaacggttatgccccagtgctggactgccacacatcccacattgccgtcaagttccaagaactgttgaccaagatcgacagacgatctggtaaggagctggagaaggaacccaagttcttgaagaatggtgatgccggtatggttaagatggttccaaccaagcccatggtggtggagactttctctgaatacccaccccttggtcgttttgctgttcgtgacatgcgtcaaacggttgctgttggcgttatcaagagtgttgagaagaaggacccaaccggagctaaggtcaccaaggctgctgcaaagaagggtgccaagtgaatggtgcaggataccagatgtggctttgccaaggaagtttctctttatagtatttgtcgtgtgaactttattttaatgattactgctctattgtgtcgagtatttttctgtttctgtattgtgccttgtatgttgggtcgtagatctcagcactgggtgctggacaggcggtggcagaatttactcagttgagtcgtgtcttaaattttgaatttgcttttcgtgtatcatgtgttttgaggtactcatgtttcatttgaagtcattattactgaagtgtttatccagttgagcctcaagtggtgtggttcttgctgttcgccttgttg

SEQ ID NO: 798 - DNA, 1595 bp, Lippia dulcis
gctacagacttctctgctctaacgaattttctcttcaagtaatttcaatttaaaaggtcatcatgggtaaggagaagattcacattaacattgtggttattggacatgtcgactctgggaagtcgaccaccactggacacttgatctacaagcttggtggtatcgacaagcgtgtcattgaaaggttcgagaaggaggctgctgagatgaacaagaggtcattcaagtatgcctgggtgcttgacaagctcaaggccgagcgtgagcgtggtatcaccattgatattgccttgtggaagtttgagaccaccaagtactactgcactgtcattgatgctcccggacatcgtgactttatcaagaacatgattactggaacctcacaggctgactgtgccgtcctgatcattgactccaccactggtggttttgaagctggtatttccaaggatggtcaaacccgtgagcatgcattgcttgccttcacccttggtgtcaagcagatgatctgttgctgcaacaagatggatgctaccacaccaaaatactccaaggctaggtacgatgaaattgttaaggaagtatcttcctacctcaagaaggttggatacaaccctgacaaaatcccatttgtgcccatttctggatttgagggagacaacatgattgagagatcaaccaaccttgattggtacaagggaccaaccctccttgaggctcttgatcagatatctgagcccaagaggccctcagacaagcctctccgtctcccacttcaggatgtgtacaagattggtggtattggtaccgtccctgttggtcgtgttgagactggtgtcatcaaacctggtatggttgtgaccttcggtccctctggtctgaccactgaagttaagtctgttgagatgcaccatgaagctatgcaggaagctcttcccggggacaatgtcgggttcaatgttaagaatgttgccgtgaaggatctcaagcgtggttacgttgcctccaactccaaggatgaccccgccaaggaagcagccaacttcacctcccaggtcatcatcatgaaccaccctggtcagattggtaatggttatgccccagtgctggactgccacacatcccacattgctgttaagttccaggaactgttgaccaagatcgacagacgatctggtaaggagctcgagaaggaacccaagttcttgaagaatggtgatgccggtatggttaagatggttccaaccaagcccatggtggttgagactttctccgagtacccacctctgggtcgttttgctgttcgtgacatgcgtcagacagttgctgttggtgtcatcaagagtgtggagaagaaggacccaacaggtgccaaggtcaccaaggcagctgcaaagaagggtgccaagtgaaaacagtttttgaaggacaaccctgtattggttttggttaatttacgtcatatttttgttttctcttttttattgtgttttcttaaacagatactttaagttctagcctctttttctcgaggaccgaagagtattgagcattgttgttttagtacttgttgcataattcctatgttgaatgcg

SEQ ID NO: 799 - DNA, 1615 bp, Lippia dulcis
tcacagtcgtctctcgcgcgagtcttctctcagtattcaatttaaaagttcatcatgggtaaggagaagattcacattaacattgttgttatcggacatgtcgactctgggaagtcgaccaccactggtcacttgatctacaagcttggtggtatcgacaagcgtgtcattgaaaggttcgagaaggaggctgctgagatgaacaagaggtcattcaagtatgcctgggtgcttgacaagctcaaggccgagcgtgagcgtggtatcaccatcgatattgccttgtggaagtttgagaccaccaagtattactgcactgtcattgatgctcccggacatcgtgactttatcaagaacatgattactggaacctcacaggctgactgtgccgtcctgatcattgactccaccactggtggttttgaagctggtatttccaaggatggtcagacccgtgagcatgcgttgcttgctttcacacttggtgtcaagcagatgatctgttgttgcaacaagatggatgctaccacaccaaaatactccaaggctaggtacgatgaaattgttaaggaagtgtcttcttacctgaagaaggtcggatacaacccggacaaaattccattcgtcccgatttctggatttgagggagacaacatgattgagagatcaaccaaccttgattggtacaagggaccaaccctccttgaggctcttgatcagatctctgagcccaagaggccctcagacaagcctctccgtctcccacttcaggatgtgtacaagattggtggtattggtaccgtccctgttggtcgtgttgagactggtgtcatcaaacctggtatggttgtgaccttcggtccctctggtctgaccactgaagttaagtctgttgagatgcaccacgaagccatgcaggaggctcttcccggtgacaatgtcgggttcaatgttaagaatgttgccgtgaaggatctcaagcgtggttacgttgcctccaactccaaggatgaccccgccaaggaagcagccaacttcacctcccaggtcatcatcatgaaccaccctggtcagattggtaacggttatgccccagtgctggactgccacacatcccacattgccgtcaagttccaagaactgttgaccaagatcgacagacgatctggtaaggagctggagaaggaacccaagttcttgaagaatggtgatgccggtatggttaagatggttccaaccaagcccatggtggtggagaccttctctgaatacccaccccttggtcgttttgctgttcgtgacatgcgtcaaaccgttgcagttggtgttatcaagagtgtggagaagaaggacccaactggtgccaaggtcaccaaggctgcagcaaagaagggtgccaagtgagcttaattatggtttgatatatctgtattgattttggttacatgatgtgttaaatttttgttagtctttttgcgaacagctttttggcatttttgttatcgtgagatgtagactttgtcacgcgaaacttgttttttatgtcatgttttaactctaaactcttgcattttagtatcttattattgcagttaagttgttcccttcacaaaaa

SEQ ID NO: 800 - DNA, 1836 bp, Lippia dulcis
acgggggaccattcttcttcttctctaaattacactgcggctagggtttccagcggagtctctctgtctcattgctgctcgttgttgaagctattaaacatcaaccatgggtaaggagaagattcacattaacattgtcgttatcggacatgtcgactctgggaaatcgaccaccactggtcacttgatctacaagcttggtggtattgacaagcgtgtcattgagaggttcgagaaggaggctgctgagatgaacaaaaggtcattcaagtatgcctgggtgcttgacaagctcaaggccgagcgtgagcgtggtatcaccatcgatattgccttgtggaagtttgagaccaccaagtactactgcactgtcattgatgctcccggacatcgtgactttatcaagaacatgattactggaacctcacaggccgactgtgctgtcctgatcattgactccaccactggtggttttgaggctggtatttccaaggatggccagacccgtgagcatgcattgcttgccttcacccttggtgtcaagcagatgatttgttgttgcaacaagatggatgctaccacaccaaaatactccaaggctaggtacgatgaaattgttaaggaagtgtcttcttacctgaagaaggtcggatacaacccggacaaaattccattcgtcccgatttctggatttgagggagacaacatgattgagagatcaaccaaccttgattggtacaagggaccaaccctccttgaggctcttgatcagatctctgagcccaagagaccctcagacaagcctctccgtctcccacttcaggatgtgtacaagattggtggtattggtaccgtccctgttggtcgtgttgagactggtgtcatcaaacctggtatggttgtgaccttcggtccctctggtctgaccactgaagttaagtctgttgagatgcaccacgaagccatgcaggaagctcttcccggtgacaatgtcgggttcaatgttaagaatgttgccgtaaaggatctcaagcgtggttacgttgcctccaactccaaggacgaccctgccaaggaagcagccaacttcacctcccaggtcatcatcatgaaccaccctggtcagattggtaacggttatgccccagtgctggactgccacacatcccacattgctgttaagttccaggaactgttgaccaagatcgacagacgatctggtaaggagctggagaaggaacccaagttcttgaagaatggtgatgccggtatggttaagatggttccaaccaagcccatggttgtggagactttctctgaatacccaccccttggtcgttttgctgttcgtgacatgcgtcaaacggttgctgttggcgttatcaagagtgttgagaagaaggacccaaccggggctaaggtcaccaaggctgcagctaagaagggtgccaagtgaatccaattatgggccttgcatcaattttgcttatattgtttactttttataatttatcttttcttggacaagcttttgatatttgtggtaaacagattgttttttcactgtcatctagcctccttaacgaggatactggtgtgttgagcaatatggtttcaaccttgttgctcaacgggcagtggtgaaatgtctgttcatcacactaaaaatctatttatgttttagagtttaaaatgagtcgtgagatgtaggcctcggtcacaaactctttcaacttttgtttaaaatttttcgttatttcaatttgtgtttgctaaggtcgtgcttaatttgaaaatggtgatgggtattgcggaattttgtttttcttgctggag

SEQ ID NO: 801 - DNA, 1785 bp, Cajanus cajan
acaggactttattggtttaagttgttggaggcctaatgggtaaggagaaggttcacattaacattgttgtcattgggcatgttgactctggcaagtcaactaccaccggccacctcatctacaagcttggaggtatcgacaagcgtgttattgagagatttgaaaaagaagctgctgagatgaacaagaggtctttcaagtatgcttgggtgctggacaagctcaaggctgagcgtgaaagagggataaccattgatattgctctgtggaagtttgagaccactaagtactactgcacagtcattgatgctcctggacacagggatttcatcaagaacatgattactgggacatcccaggctgattgtgctgttcttattattgattccaccacgggtggttttgaagctggtatttccaaagatggacagactcgtgaacatgctctccttgctttcactcttggtgtgaggcaaatgatttgctgctgtaacaagatggatgccactacaccaaggtactccaaggcaagatacgatgaaattgtgaaggaggtttcttcctacatgaagaaggttggatataaccctgacaagatcccttttgttcccatctctggttttgagggagataacatgattgagaggtccacaaaccttgactggtacaagggtccaacccttctggaggcccttgatcagatcaacgagcccaagagaccatcagacaagcccctcagattaccccttcaggatgtctacaagattggaggaataggaactgtgcctgttggacgagttgaaactggtatcatgaaacctggaatggtggttacttttgcaccaactggactcacaactgaagttaagtctgtggagatgcaccatgaagcactcaccgaggcccttcctggtgataatgtggggttcaatgttaagaatgttgctgttaaggatctcaagcgtggtttcgttgcctcaaactctaaggatgaccctgccaaggaggcagctaactttacctcccaagttatcatcatgaatcaccctggacagattggaaatggctatgcacctgttcttgattgccacacctcccacattgctgtcaagtttgccgaacttgtgaccaagattgataggcgttccggtaaagagcttgagaaggagcccaagttcctgaagaatggagatgctggttttgtgaagatgattccctccaagcccatggtggttgaaaccttctctgagtatcctccacttggtcgttttgctgtgagagacatgcgtcagactgtggccgtgggagtcatcaaaagcgtggagaagaaggacccaactggagctaaggtcaccaaggctgcacagaagaagagtggcaaatgactcgtgcagcatggtttatcaagagaagtctatcattactactacaataaatggcttcttgttcctagtactactatttttatgttaaggaacttgtttgtcggattttgtgtctggtctgcgccctcatctcgcgacttttgttcccagaactgggttcttgatcgacggtggcaatgctatttctttttccatttttatgctttgtttttattgtaatgtgtttctgtgaaaactgttacattattgtaatataatatgctgcagatttggtttttgagtgttaatgttaagttgtcaactctgttttgtgttcttattttaaatttttggtgattcattcttgtggcagtacgagatattttgcagctaggatgtagcaagcatttcgaaactgatt

SEQ ID NO: 802 - DNA, 1841 bp, Podocarpus macrophillus
gcgagccccttcattattctgctatcctgcgtggttgtttcagatctcttcgatttaagcttgattttgttgaagcaaccatggggaaagaaaagacccatatcaacattgtggtcattggacatgtcgactctggcaagtccaccaccaccggccaccttatctacaaacttggaggtatcgacaagcgtgtgatcgagcgctttgagaaggaagccgctgaaatgaacaaaaggtcattcaagtatgcctgggtacttgacaaactcaaggctgagcgtgaacgtggtattactattgatattgcactctggaagtttgagaccacgaagtactactgcactgttattgatgcccctggtcatcgtgacttcatcaaaaacatgatcaccggaacatctcaggctgactgtgcagttctgatcattgattcaactactggaggttttgaagctggtatctcaaaggatggacagaccagagagcatgctcttctggccttcaccttgggagtcaaacaaatgatctgttgttgtaacaagatggacgccactacccccaagtattccaaggcccgctatgatgaaattgtgaaggaagtgtcttcatacttgaaaaaggtgggttacaaccctgataaaatcccctttgtgcccatctctggattcgaaggagataacatgatcgagagatcaacaaatctcgattggtacaagggacctaccctccttgatgctctggacatgatcaatgagcccaagaggccctctgacaagccgctccgcctaccccttcaggatgtctacaagatcggtggcattggcaccgtccctgttggacgagttgaaaccggtgtcctgaagcccggtacggtggtgacatttggccccactggactgacaactgaagtcaagtccgttgaaatgcatcacgaatccttgccggaggctttgcctggagacaacgttggcttcaatgtcaagaacgttgcggtcaaggatctgaagcgtgggtttgtggcctcagactccaaaaacgaccctgccaaggaggctgctagctttacctcgcaagtgatcatcatgaaccaccctggtcagataggcaacggttatgctcctgtgctcgactgccacaccagccacattgccgtgaagtttgctgagattcttaccaaggtagacaggcgttctggtaaggagcttgagaaggagcccaagttcctcaagaatggtgacgctgggtttgttaagatgattcccacgaaacccatggtggtggagacattctcagagtatcctccattgggtcgttttgctgtcagggacatgcgtcaaacggttgctgtgggtgtgattaagagtgtggagaaaaaggagcccagtggtgcgaaggtcactaaggctgctgccaagaagaaatgaactgtgcgaaattgtgcgaaggagttggggcatgtgtgccatggtgggtgtctacttccctcctctgtacttgatgggtctgtgaggtgtttggtggctcggagtaagcaaacctgggttcttgataggcggtggctgaataaattttttatagtctttgttgttagggatatagtatatttgggagaggagtgttatatgcatattctaaactttttgaacattatgtctgcaactattgagagttgcagaaacattttatacttgtttctgacctttagaatttatttagaagcgggtcttgtcaaatttgattttaaatacaacactttattcatcatatggtcacgaggattcattgtttcgtcttcatattagagcaatagttctcatgattgtcttttggttggttttatt

SEQ ID NO: 803 - DNA, 2034 bp, Papaver somniferum
ggtttataagcgtaaggagcctaacatttcctcactctcctccttctacacgctgcgggaacttcaagctaggcgatattatttttcttcaatttaagtttcttgctaataactcgatatgggaaaggagaaggttcacatcaatattgttgtcattggacatgttgactctgggaaatcaaccaccaccggtcacttgatctacaagcttggaggtattgacaagcgtgtgattgagaggttcgagaaagaggctgctgagatgaacaagaggtcattcaagtacgcatgggttcttgacaagcttaaggctgaacgtgagcgtggtattactattgatattgccttgtggaagtttgagaccaccaagtactactgcacagttattgatgctcctggacatcgtgattttattaagaacatgattactggtacctctcaagccgattgtgctgtgctcattattgactccaccactggaggtttcgaggctggtatatccaaggatggccagactcgtgagcacgcccttcttgctttcacgcttggtgtcaagcagatgatctgctgctgtaacaagatggatgccaccactcccaagtactcgaaggctagatacgatgaaattgtgaaggaggtctcatcttacttgaagaaggttgggtacaacccagacaaaattgcctttgttcccatctccggatttgagggagacaacatgattgagaggtccaccaacctcgactggtacaagggaccaactcttcttgaggctcttgacaatatctctgagccaaagaggccctcagacaagcccctccgactcccacttcaggatgtttacaagattggaggtattggaactgtgccagtgggacgtgttgaaactggtttcatcaagcctggaatggttgtcacttttggacccactgggttgactactgaagttaagtccgtggagatgcaccacgaggctctccaagaagctcttccaggtgacaatgtcgggttcaacgttaagaatgttgctgttaaggatctcaagcgtggtttcgtggcttccaactccaaggatgaccctgccagggaagcagccaacttcacctcccaggtcatcatcatgaaccaccccggtcaaattggtaatggttatgccccagttcttgactgtcacacttctcacattgctgttaagtttgccgaaatcctcaccaagatcgataggcgatctggaaaggagcttgagaaggagcctaagttcttgaagaatggtgatgctggtattattaagatgcttccaaccaagcccatggttgtggagaccttctctcagtacccacctcttggacgattcgctgtgagggacatgcggcagacagttgctgttggtgttattaaggaagttgagaagaaagacccatcaggtgccaaggtcaccaagtctgctgccaagaagaaatgaagtgtgcgcttgggtagaggggtgagagcagtcggagggaggaacggtcttgttttcattagtagggatatgtttttatataatcgtgttttgtggtctgctttgatctgttgtcattgcagtcttctctcttgttttgtcttcattttgacaggcattcaattgcaaacttgggtgcttgacaggcggtggcaagatgtttagggtttcagttcaagtgtcttttagaacatattatggtttggggcttctgattttaaagttaaatgttttgacttcttctatcccttttttcgttctaatgaaacagttctattaatttacatagtttttggctgatttaatacgtctagttttactttgtattggtatacatacgaggatagtttcacttgtagtgcagactctcgaatttcatgtatatctgaattaatgctggtatttctaaggtttatatgaaagtactggccagttggaaagactttttgtaagtctggtttgtttgtttcgttgttgtttgttgtttgagagggagggagtttgaaacgaatttcattgttttatacagtaaa

SEQ ID NO: 804 - DNA, 1827 bp, Papaver somniferum
gcagcaaacaacaaggcaaaactagattagcacctagaatcctcaatgaagttcaaaatccttgaaatacaaaacatgaaaaatgataaagcctatgacacatgtagaagcatcataacaaatttgttaagctctattcggagctttcaatctcgatttcaaatctcagtcaatttctaagaattcaatatgggtaaagagaaagttcatatcaacattgtcgtcattggacatgtcgactctggaaaatcgaccaccactggtcacttgatctacaagctaggaggtatcgacaagcgtgtgatcgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagtcattgatgctccaggacatcgtgatttcatcaagaacatgattactggtacctctcaggctgattgtgccgtccttatcattgactccaccactggaggttttgaggccggtatctccaaggatggacagactcgtgagcacgctcttcttgctttcacccttggtgtcaagcagatgatctgttgctgtaacaagatggatgccaccacccccaagtactcaaagggtaggtacgaagaaattgtaaaggaagtctcttcatacttgaagaaggttggatacaacccagacaaaattgccttcgtccccatctctggtttcgagggagacaacatgattgagaggtccaccaaccttgactggtacaagggaccaactcttctcgaggctcttgacaacatctctgagcctaagagacccacagacaagccccttcgtcttccccttcaagatgtttacaagattggaggtattggaactgtgccagtgggacgtgttgaaactggtttcatcaagcctggtatggttatcacttttggacccactgggttgactactgaagttaagtctgttgagatgcaccatgaggctctcctagaagctcttccaggtgacaatgttggattcaatgtcaagaatgttgctgtgaaggatctcaagcgtggtttcgtagcttcaaactccaaggatgaccctgctaaggaagcagccaacttcacctcccaggtcatcatcatgaaccatcctggccagatcggtaacggttatgcccctgtccttgactgtcacacatctcacattgctgttaagttctctgaaatcctcaccaagatcgataggcgatctggaaaggagctcgagaaggagcccaagttcttgaagaatggtgatgctggtattattaagatgcttccaaccaagccaatggttgtggagaccttctctgagtacccacctcttggtcgttttgctgtcagagacatgaggcagactgttgctgttggtgttatcaaggctgttgagaagaaagacccaacgggggctaaggtcaccaagtctgctgttaagaagaaatagatgtgttactggagatttgagttggcaacagcagggtttttcagtatgctcaattttgttatgatgcttctacatgtgtcataggcttttatcatttttcatgttttgtatttcaaggattttgaacttcattgaggattctaggtgctaatctagttttgccttgttgtttgctgcaagatgattggttcttgtttgatgaaccaagttttactttggtatatccaactctgatttaaaatttgaaggataatagatcttagtcgtgacctgctttaaattaaaaaaaaaaaa

SEQ ID NO: 805 - DNA, 1637 bp, Papaver somniferum
ctcattttggagggtttataagctgagacgcctcctatttttcagtctctacaaatttgttaagctctactcggagctttcaatctcgatttcaaatctcagtcaatttctaagaattcaatatgggtaaagagaaagttcatatcaacattgtcgtcattggacatgtcgactctggaaaatcgaccaccactggtcacttgatctacaagctaggaggtattgacaagcgtgtgatcgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagtcattgatgccccaggacatcgtgatttcatcaagaacatgattactggtacctctcaggctgattgtgccgtccttatcattgactccaccactggaggttttgaggccggtatctctaaggatggacagactcgtgagcacgctcttcttgctttcacccttggtgtcaagcagatgatctgttgttgtaacaagatggatgccaccacccccaagtactcaaagggtaggtacgaagaaattgtaaaggaagtctcttcatacttgaagaaggttggatacaacccagacaaaattgccttcgtccccatctctggtttcgagggagacaacatgattgagaggtccaccaaccttgactggtacaagggaccaactcttctcgaggctcttgacaacatctctgagcctaagagacccacagacaagccccttcgtcttccccttcaagatgtttacaagattggaggtattggaactgtgccagtgggacgtgttgaaactggtttcatcaagcctggtatggttatcacttttggacccactgggttgactactgaagttaagtctgtggagatgcaccacgaggctctcctagaagctcttccaggtgacaatgttgggttcaatgtcaagaatgttgctgtgaaggatctgaagcgtggtttcgtcgcttcaaactccaaggatgaccctgctaaggaagcagccaacttcacctcccaggtcatcatcatgaaccatcctggacagatcggcaacggttatgccccagtcctcgactgtcacacatctcacattgctgttaagttctctgaaatcctcaccaagatcgacaggcgatctggaaaggagctcgagaaggagcccaagttcttgaagaacggtgatgctggtattattaagatgcttccaaccaagccaatggttgtggagaccttctctgagtacccacctcttggacgttttgctgtcagagacatgaggcagactgttgctgttggtgttatcaaggctgttgagaagaaggacccaactggagccaaggtcaccaagtctgctgttaagaagaaatagatgtgttactggagatttgagttagcaacagcagggtttttcagtattctcaattttgttatgatgcttctacacgtgtcataggcttttatcatttttcatgttttgtatttcaaggattttgaacttcatcgaggattctaggtgctaatctagtttttccttgtttgg

SEQ ID NO: 806 - DNA, 1613 bp, Papaver somniferum
gagacgcctcttatttttcagtctctacaaatttgttaagctcgactcggagctttcaatctcgatttcaaatatcagtcaatttctaagaattcaatatgggtaaagagaaagttcatatcaacattgtcgtcattggacatgtcgactctggaaaatcgaccaccactggtcacttgatctacaagcttggaggtattgacaagcgtgtgatcgaaagattcgagaaggaggctgctgagatgaacaagaggtcattcaaatatgcatgggttcttgacaagcttaaggctgaacgcgagcgtggtattaccattgatattgccttgtggaagtttgagaccaccaagtactactgcacagtcattgatgccccaggacatcgtgatttcatcaagaacatgattactggtacctctcaggctgattgtgccgtccttatcattgactccaccactggaggttttgaggccggcatctctaaggatggacagactcgtgagcacgctcttcttgctttcacccttggtgtcaagcagatgatctgttgttgtaacaagatggatgccaccacccccaagtactcaaagggtaggtacgaagaaattgtaaaggaagtctcttcatacttgaagaaggttggatacaacccagacaaaattgccttcgtccccatctctggtttcgagggagacaacatgattgagaggtccaccaaccttgactggtacaagggaccaactcttcttgaggctcttgacaacatctctgagcctaagagacccacagacaagccccttcgtcttccccttcaagatgtttacaagattggaggtattggaactgtgccagtgggacgtgttgaaactggtttcatcaagcctggtatggttatcacttttggacccactgggttgactactgaagttaagtctgtggagatgcaccacgaggctctcctagaagctcttccaggtgacaatgttgggttcaatgtcaagaatgtagctgtgaaggatctcaagcgtggtttcgtcgcttcaaactccaaggatgaccctgctaaggaagcagccaacttcacctcccaggtcatcatcatgaaccatcctggacagatcggtaacggttatgccccagtccttgactgtcacacatctcacattgctgttaagttctctgaaatcctcaccaagatcgacaggcgatctggaaaagagctcgagaaggagcccaagttcttgaagaatggtgatgctggtattattaagatgcttccaaccaagccaatggttgtggagaccttctctgagtacccacctcttggacgttttgctgtcagagacatgaggcaaactgttgctgttggtgttatcaaggctgttgagaagaaagacccaactggagccaaggtcaccaagtccgctgttaagaagaaatagatgtgttactggaggtttgagttagcaacagcagggtttttcagtatgctcaattttgttatgatgcttctacatgtgtcataggcttttatcatttttcatgttttgtatttcaaggattttgaacttcattgaggattctaggtgctaatctagttttgccttgtctgg

SEQ ID NO: 807 - DNA, 1631 bp, Papaver somniferum
agtttattgctaataactcaatatgggtaaggagaaggttcacatcaacattgttgtcattggacatgtcgactctggtaaatcaaccaccactggtcacttgatctacaagcttggaggtattgacaagcgtgtgatcgagaggttcgagaaagaggctgctgagatgaacaagaggtcattcaagtacgcatgggttcttgacaagcttaaggctgaacgtgagcgtggtattaccattgatattgccttgtggaagtttgagaccacaaagtactactgcacagttattgatgctcctggacatcgtgattttattaagaacatgattactggtacctctcaggccgattgtgccgtgcttattattgactccaccactggaggttttgaggctggtatctccaaggatggccagactcgtgagcacgcccttcttgctttcacgcttggtgtcaagcagatgatctgctgctgtaacaagatggatgccaccacccccaagtactcgaaggctagatatgatgaaattgtgaaggaggtctcatcttacttgaagaaggttgggtacaatccagacaaaattgccttcgttcccatctctggatttgagggagacaacatgattgagaggtccaccaaccttgactggtacaagggaccaactcttcttgaggctcttgacaatatctctgagccaaagaggccctcagacaagcccctccgtctcccacttcaggatgtttacaagattggaggtattggaactgtgccagtgggacgtgttgaaactggtttcatcaagcctggaatggttgtcacttttggacccactgggttgactactgaagttaagtctgtggagatgcaccacgaggctctccaagaagctcttccaggtgacaatgtcgggttcaacgttaagaatgttgctgttaaggatctcaagcgtggttttgtggcttccaactccaaggatgaccctgccagggaagcggccaacttcacctcccaggtcatcatcatgaaccaccccggtcagattggtaatggttatgccccagtccttgactgtcacacttctcacattgctgttaagtttgccgaaatcctcaccaagatcgataggcggtctggaaaggagcttgagaaagagcctaagttcttgaagaatggtgatgctggtattattaagatgcttccaaccaagcccatggttgtggagaccttctctcagtacccacctcttggacgattcgctgtcagggacatgaggcagacagttgctgttggtgttatcaaggaagttgagaagaaagacccatcaggtgccaaggtcaccaagtctgctgccaagaagaaatgaagtgtgcgcttgggtagaggggtgatgttgagagcagtcagaggaaggaactgtcttgttctcattagtagggatatgtttttatataatcatgttttgtggtctgctttgatccgttgtcattgcagtcttcttgcttgttttttcttcattttgtcaggcattcagttgcaaacttggggtgcttgacaggcggtggcaagatgtttagggtttcagttcaagtgtctttttagaacataatatggtttgggcttctgatttt

SEQ ID NO: 808 - DNA, 1649 bp, Papaver somniferum
aaaaagctctgttgcagcggagcttatctaattcggcgtttcagttaatttctaagaattcagtatgggtaaagagaaggttcacatcaacattgtcgtcattggacatgtcgactctggaaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatatcgccttgtggaagtttgagaccaccaagtactactgcacagttattgatgctcctggacatcgtgactttatcaaaaacatgattactggtacttctcaggctgattgtgccgtcctcattatcgattctaccactggaggttttgaggctggtatctcaaaggatggtcagactcgtgagcacgctcttcttgctttcacccttggtgtcaagcagatgatctgttgttgtaacaagatggatgccaccacccccaagtactcaaaggctaggtatgatgaaattgtaaaggaggtctcatcttacttgaagaaggttggatacaacccagacaaaattgcctttgttcctatctctggattcgagggagacaacatgattgagaggtccaccaaccttgactggtacaagggaccaactcttctcgatgcccttgacaatatctctgagccaaagagaccctcagacaagccccttcgtcttccccttcaggatgtttacaagattggaggtattggaactgtgccagtgggacgtgttgaaactggattcatcaagcctggtatggttgttacctttggacccactgggttgaccactgaagttaagtctgtggagatgcaccacgaagcccttcaagaagctcttccaggagacaatgttgggttcaatgtcaagaatgttgcagtgaaggatctcaagcgtggttttgtcgcctccaactccaaggatgaccctgccagggaagctgctaacttcacctcccaggttatcatcatgaaccatcctggtcagatcggtaacggttatgctccagtcctcgactgtcacacatctcacatcgctgttaagttcgctgagatcctcaccaagattgataggcgatctggaaaggagcttgagaaggagcccaagttcttgaagaatggtgatgctggtattatcaagatgcttccaaccaagcccatggttgtggagaccttctctcagtaccctcctcttggacgttttgcagtcagggacatgaggcagacagttgctgttggtgtcatcaaggaagttgagaagaaggacccaacaggagccaaggttaccaagtctgctgtcaagaagaagtaaagtactccagtaagtacagggatggtgctaagagggtctgcagaagggttttgtcttgtttacttcaatattagtcatttttgcttttggtttgctttggttggctatcattgcagtgttatatcttttgttgcctttgttttgttgagcatccagatgcaaacctgggttcttgataggcggtggcaacgtatgggctgttcagttaattgaaaacttgttgtggattttggtttgtaag

SEQ ID NO: 809 - DNA, 1639 bp, Papaver somniferum
ctgtgctgcggagcttttctaatcgccgtttcagttaatttctaagaattcaatatgggtaaagagaaggttcacatcaacattgtcgtcattggacatgttgactctggtaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgccgtcctcattatcgattctaccactggaggttttgaggctggtatctcaaaggatggtcagactcgtgagcatgctcttcttgctttcacccttggtgtcaagcagatgatctgttgttgtaacaagatggatgccaccacccccaagtactcaaaggctaggtacgatgaaatcgtcaaggaggtctcatcttacttgaagaaggttggatacaacccagacaaaattgcctttgttcccatctctggattcgagggagacaacatgattgagaggtccaccaaccttgactggtacaagggaccaactcttctcgatgctcttgacaatatctctgagccaaagagaccctcagacaagccccttcgtcttccccttcaggatgtttacaagattggaggtattggaactgtgccagtgggacgtgttgaaactggattcatcaagcctggtatggttgttacctttggacccactgggttgaccactgaagttaagtctgtggagatgcaccacgaagcccttcaagaagctcttccaggagacaatgttgggttcaatgtcaagaatgttgcagtgaaggatctcaagcgtggtttcgtcgcctccaactccaaggacgaccctgccagggaagctgccaacttcacctcccaggtcatcatcatgaaccatcctggtcagattggtaacggttatgccccagtcctcgactgtcacacatctcacattgctgttaagtttgctgagatcctcaccaagattgataggcgatctggaaaggagcttgagaaggagcccaagttcttgaagaatggtgatgctggtattatcaagatgcttccaaccaagcccatggttgtggagaccttctctcagtaccctcctcttggacgttttgctgttagggacatgaggcagacagttgctgttggtgtcatcaaggaagttgagaagaaggacccaacaggagccaaggttaccaagtctgctgtcaagaagaagtaaagtactccagtaagtacagggatggtgctaagaggttctgcagaagggttttgtcttgtttacttcagtagtcatttttgtttttggtttgctttggttagctatcatcatcgcagtgttatatcttttgttgcctttgttttgttgagcatccagatgcaaacctgggttcttgataggcggtggcaacatgagtatgggctgttcagttgaaaacttgttatggattttggtttgtaag

SEQ ID NO: 810 - DNA, 1619 bp, Papaver somniferum
attcggcgattcagttaatttctaagaattcaatatgggtaaagagaaggttcacatcaacattgtcgtcattggacatgtcgactctggtaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgccgtcctcattatcgattctaccactggaggttttgaggctggaatctcaaaggatggtcagactcgtgagcacgctcttcttgctttcactcttggtgtcaagcagatgatctgctgttgtaacaagatggatgccaccacccccaagtactcaaaggctaggtacgatgaaattgtaaaggaggtctcatcttacttgaagaaggttggatacaacccagacaaaattgcctttgttcccatctctggatttgagggagacaacatgattgagaggtccaccaaccttgactggtacaagggaccaactcttctcgaggctcttgacaatatctctgagccaaagagaccctcagacaagccccttcgtcttccccttcaggatgtttacaagattggaggtattggaactgtgccagtgggacgtgttgaaactggattcatcaagcctggtatggttgttacctttggacccactgggttgaccactgaagttaagtctgtggagatgcaccacgaagcccttcaagaagctcttccaggagacaatgttgggttcaatgtcaagaatgttgcagtgaaggatctcaagcgtggttttgtcgcctccaactccaaggacgaccctgccagggaagctgccaacttcacttcccaggttatcatcatgaaccatcctggtcagatcggcaacggttatgctccagtcctcgactgtcacacatctcacatcgctgttaagttcgctgggatcctcaccaagattgataggcgatctggaaaggagcttgagaaggagcctaagttcttgaagaatggtgatgctggtattatcaagatgcttccaaccaagcctatggttgtggagaccttctctcagtaccctcctcttggacgttttgcagtcagggacatgaggcagacagttgctgttggtgtcatcaaggaagttgagaagaaggacccaacaggagccaaggttaccaagtctgctgtcaagaagaagtaaagtactccagtaagtacagggatggtgctaagagggtctgcagaagggttttgtcttgtttacttcaatattagtcatttttgcttttggtttgctttggttggctatcattgcagtgttatatcttttgttgcctttgttttgttgagcatccagatgcaaacctgggttcttgataggcggtggcaacgtaagggctgttcagttaattgaaaacttgttgtggattttggtttgtaag

SEQ ID NO: 811 - DNA, 1707 bp, Papaver somniferum
agctctgtgctgcggagcttttctaatcgccgtttcagttaatttctaagaattcaacatgggtaaagagaaggttcacatcaacattgtcgtcattggacatgtcgactctggtaaatcgaccactactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcacagttattgatgctcctggacatcgtgactttatcaaaaacatgattactggtacttctcaggctgattgtgccgttctcattatcgattccaccactggaggttttgaggctggtatctcaaaggatggtcagactcgtgagcatgctcttcttgctttcactcttggtgtcaagcagatgatctgttgttgtaacaagatggatgccaccacccctaagtactcaaaggctaggtacgatgaaattgtcaaggaagtctcatcttacttgaagaaggttggatacaacccagacaaaattgcctttgttcctatctctggattcgagggagacaacatgattgagaggtccaccaaccttgactggtacaagggaccaactcttctcgatgctcttgacaatatctctgagccaaagagaccctcagacaagccccttcgtcttccacttcaggatgtttacaagattggaggtattggaactgtgccagtgggacgtgttgaaactggattcatcaagcctggtatggttgttacctttggacccactgggttgaccactgaagttaagtctgtggagatgcaccacgaagcccttcaagaagctcttccaggagacaatgttgggttcaatgtcaagaatgttgcagtgaaggacctcaagcgaggtttcgtcgcctccaactccaaggacgaccctgccagggaagctgccaacttcacctcccaggtcatcatcatgaaccatcctggtcagattggaaacggttatgccccagtcctcgactgtcacacatctcacattgctgttaagtttgctgagatcctcaccaagattgataggcgatctggaaaggagcttgagaaggagcccaagttcttgaagaatggtgatgctggtatcatcaagatgcttccaaccaagcccatggttgtggagaccttctctcagtaccctcctcttggacgttttgctgttagggacatgaggcaaactgttgctgttggtgtcatcaaggaagttgaaaagaaggacccaacaggagccaaggttaccaagtctgctgtcaagaagaagtaaagtactccagtaagtacagggatggtgctaagagggtctgcagaagggttttgtcttgtttacttcaatagtagtcattttcgcatttggtttgctttggttagctatcattgcagtgttatatcttttgttgcctttggtttgttgagcatccagatgcaaacctgggttctggataggcggtggcaacgtgagtatgggctgttcagttgattgaaaacttgttgtggattttggtttgtaagttgctgttaacaactttatatttgcgcatctctttcccggttaaatgaaagactgtgttc

SEQ ID NO: 812 - DNA, 1603 bp, Papaver somniferum
cggagcttatctaattcggcgtttcagttaatttctaagaattcagtatgggtaaagagaaggttcacatcaacattgtcgtcattggacatgtcgactctggaaaatcgaccaccactggtcacttgatctacaagcttggaggtattgacaagcgtgttattgaaagattcgagaaggaggctgctgagatgaacaagaggtcattcaagtacgcatgggttcttgacaagcttaaagctgaacgtgagcgtggtattaccattgatattgccttgtggaagtttgagaccaccaagtactactgcacagttattgatgctccaggacatcgtgactttattaagaacatgattactggtacctctcaggccgattgtgctgtcctcattatcgattctaccactggaggttttgaggctggtatctcaaaggatggtcagactcgtgagcacgctcttcttgctttcacccttggtgtcaagcagatgatctgttgttgtaacaagatggatgccaccacccccaagtactcaaaggctaggtacgatgaaattgtcaaggaagtctcatcttacttgaagaaggttggatacaacccagacaaaattgcctttgttcctatctctggatttgagggagacaacatgattgagaggtccaccaaccttgactggtacaagggaccaactcttctcgatgctcttgacaatatctctgagccaaagagaccctcagacaagccccttcgtcttccccttcaggatgtttacaagattggtggtattggaactgtgccagtgggacgtgttgaaactggattcatcaagcctggtatggttgttacctttggacccactgggttgaccactgaagttaagtctgtggagatgcaccacgaagcccttcaagaagctcttccaggagacaatgttgggttcaatgtcaagaatgttgcagtgaaggatctcaagcgtggtttcgtcgcctccaactccaaggatgaccccgccagggaagctgccaacttcacctcccaggttatcatcatgaaccatcctggtcagatcggtaacggttatgctccagtcctcgattgtcacacatctcacattgctgttaagtttgctgagatcctcaccaagattgataggcgatctggaaaggagcttgagaaggagcccaagttcttgaagaatggtgatgctggtatcattaagatgcttccaacaaagcccatggttgtagagaccttctctcagtaccctcctcttggacgttttgctgttagggacatgaggcagacagttgctgttggtgttatcaaggaagttgagaagaaggacccaacaggagccaaggttaccaagtctgctgtcaagaagaaatgaagtgtgctgccaaggttaactagagggagagggatggtgctaagaggatctacaggagggacttgtttctttactattagtcagttttgttttttgttttcgtgcattaggtatcaatgtggtcttttgttttgtttcaccttcgttttgttgcgcattcagttgcaaacctgggtgcttgacaggcggtggcaacaaggtgttgggctgtt

SEQ ID NO: 813 - DNA, 1705 bp, Primula obconica
agccctaattcagggttggggttacacagtagataagcagctaaagtagctcaaatttttttcctctttctctctctacctctgcgagagagcttctaccgaacccatttttctctcttccatcaaggtataatcatgggtaaagagaaaattcacattagcattgtggtcattggccatgtggactctgggaagtcaaccaccaccggccacttaatctacaagcttggtggcatcgacaagcgtgtcatcgagaggtttgagaaagaagctgctgagatgaacaaacgttcgttcaagtacgcttgggtgttggacaagctcaaggctgagcgtgagcgtggtatcaccattgatattgctttgtggaagtttgagacaactaaatactactgcacagttatagatgctcctggtcatcgtgactttatcaagaatatgattactggtacatcgcaagctgactgtgctgtacttatcattgattccactactggtgggtttgaagctggtatttccaaggatggtcagacccgtgagcatgctttgcttgcctttaccctcggtgtcaagcaaatgatctgttgttgcaacaagatggacgctactaccccaaagtactcaaaggcaaggtacgaagaaatcgttaaggaagtatcatcgtatctgaagaaggtgggttacaaccccgacaaagttccttttgtccccatctctggtttcgaaggtgacaacatgatcgaaaggtcaacaaatctcgactggtacaagggccccactctccttgatgccctcgatttgatcagtgagcccaagaggccctcagacaaaccccttcgtttgccactacaagacatttacaagataggtggcattggaactgtccctgtgggtcgtgtcgaaactggtgttattaaacccggtatggtcgtcactttcggcccaagtggtcttaccactgaggtcaaatccgttgaaatgcaccacgagtctttactagaggctcacccaggggataacgttgggttcaatgttaaaaatgttgctgttaaggaccttaaacgtggttatgtggcgtctaactcaaaggacgatcctgctaaagaagctgccaatttcactgcacaggtcatcatcatgaaccatcctggtcaaattggaaatggctatgcaccagttctagattgtcacacctgccatattgcagttaaattttccgagattttaaccaaaatcgataggaggtctgggaaggagctcgaaaaagaacctaagtttttgaaaaatggcgatgctggttttgttaagatgattccgactaagcctatggttgttgagacattctcagcgtacccaccacttggacgttttgctgtgagagacatgcgccagacagtggcggttggtgttatcaagagcgtggagaaaaaagacccaagtggagctaaggttacaaaggctgcccagaagaaaaagtgaaaaacaaggagaacggaagaggtcgctatctgtatttcttttggtaattattctcgcgattgttcgtttaagtaccctgaagattgtttcttaaatttccttttgttttcctttcttatttgaatgttgaaatcggattttaatccttcgtatcaatagtttgtttgagaattgaaaatgttgcccgtcgtatatgaatcctctgttattttttgaaatggtgaaa

SEQ ID NO: 814 - DNA, 1652 bp, Pteridium aquilinum
ctcttcctcctcaccacgttacgtccattgttggtgcgtagctcctccgcagctgctcctcttcagccatgggtaaggagaaaacccacatcaacattgtcgtcattggacatgtcgactctgggaagtccaccaccaccggtcatctcatttacaagcttgggggtattgacaagcgtgtgattgagaggtttgagaaggaagctgctgaaatgaacaagaggtcgttcaagtatgcttgggtgcttgacaagcttaaagcggagcgcgagcgtggcatcaccattgatattgctctctggaagtttgagacaaccaagtactactgtacagttattgatgctcctggtcaccgtgattttatcaagaacatgattactggaacttcacaggccgattgtgctgttctgattattgattcgacaactggaggttttgaagctggtatctctaaggatggtcaaactcgtgagcatgctttattggcgttcactcttggtgtgaaacaaatgatttgctgctgtaacaagatggatgctaccactcccaagtattctaaggctcgttatgatgaaattatgaaggaggtgtctgcctacttgaagaaggtgggatataaccctgataaaattccctttgtgcccatttctggctttgaaggggacaacatgattgagagatccagcaacctggactggtacaagggccccaccttgctcgatgccttggacatgatcctggaacctaagaggccctctgacaaacctctcaggttgcctctgcaagatgtttacaaaattggtggcattgggactgtgcctgtcggacgtgtggagactggtgttatcaagcctggaatggttgtcacctttgccccaactggactcactactgaagtcaagtctgttgagatgcaccatgaagctcttctcgaggccttgcctggtgacaatgttggctttaatgttaagaatgtggctgtcaaggatctcaagcgtggatttgttgcttctgactccaagaatgatcctgcaaaggaagccgctaatttcacttctcaggtcattattatgaatcatcctggacagataggcaatggctatgcacctgtgcttgattgccatacttctcacattgctgtgaagtttgctgaaattcttaccaagattgacagacgctcaggcaaggagcttgagaaggagcccaagtttttgaagaatggtgatgctggttttgtgaagatgattcccaccaagccgatgactgtggagacctttgctgagtaccctcctcttgggcgttttgctgttcgtgacatgaggcagactgtcgcggtcggggttatcaaggctgttgagaagaaggaacctactggtgcgaaggttaccaaggctgctgccaaaaagaaatgaaccgcggtgtgcttggctgtgttcatggaggtggaatttctgtgctactttctttttagttcagtacatgtctggatagtacgtatgctggtatctagagtgttacaaacttgggttttggacagacggtggcagaatttctcaggctgccctgctctgtagactatatatgagtgttttatgtaccgttttgtatttggatttgaatatgaggttttgtcttttattctcaaaaaagaa

SEQ ID NO: 815 - DNA, 1803 bp, Solanum phureja
cccaaaaagccctaatggagcatttgcttcctcggctataaagtatcagtctctgcatttgtaaaaccctaacgcttcgcttatttgtttttgcgcagccaccggtttagcgaagctctctcttttcttcatcttcaaaagattctaaagcatcatgggtaaggagaagattcacatcagcattgtggtcattggccacgtcgactctggaaagtcgactaccactggtcacttgatctacaagcttggtggtattgacaagcgtgttattgagaggtttgagaaggaagctgctgagatgaacaagaggtcattcaagtatgcctgggtgcttgacaaacttaaggccgaacgtgagcgtggtatcaccattgatattgctttgtggaagtttgagaccactaagtactactgcactgtgattgatgcccctggtcacagggacttcatcaagaatatgatcactggtacctcccaggctgactgtgctgtcctcattatcgactccaccactggtggttttgaagctggtatctctaaagatggtcagacccgtgaacatgcattgcttgctttcacccttggtgtcaaacaaatgatatgctgctgtaacaagatggatgctaccaccccgaagtactccaaggctaggtatgatgaaatcgtgaaggaagtttcttcgtaccttaagaaggttggttacaaccctgacaaaattccctttgtccctatctctggttttgaaggagataacatgattgagaggtctaccaaccttgactggtacaagggcccaaccctccttgatgctctcgaccagattaatgagcccaagaggccaacagacaaaccccttcgtcttccacttcaggatgtttacaagattggtggtattggaactgtcccagttggtcgtgttgagactggtgtgatcaagcctggtatggttgtgacctttggccctactggtttgacaactgaagtcaagtctgtagagatgcaccacgaagcgctcctggaggcactccctggtgacaatgttgggttcaatgttaagaatgttgctgttaaggatctgaagcgtggttttgttgcctcaaactccaaggatgacccagccaagggggcagccagcttcactgcccaggtcatcatcatgaaccatcctggccagattggaaatggatatgctccagtgctcgactgtcacacttcccacattgctgtcaagtttgctgagatcttgaccaagattgacaggcgttcaggtaaggaacttgagaaggagcctaagttcttgaagaacggtgatgctggtatggttaagatgattcccaccaagcccatggttgttgagacctttgctgaatacccaccattgggtcgttttgctgtgagggacatgaggcaaactgttgctgtgggtgttgtcaagaatgttgacaagaaggacccaactggtgccaaggtgaccaaggctgcccagaagaagggaaagtgaacagagcagtttgatgctggtgaggaggtgcatttgatgagcatggatgaactagttttgtttatttgcacaagttttttacaattttgttttgggcaacattttaccagttttgggtatggctacaagaagcttttgtcatggttctctagcctcttatgtggacagtggagtaattgagcaatttggtcctgtccaagttgcttgataggcaatgacaataggccctctggtggttatttctttacctggttttattttatgatgaactttagtcagtcactaccaaacatatttatttt

SEQ ID NO: 816 - DNA, 1783 bp, Solanum phureja
cctaacgcttcgcttatttgttttgcgcagccaaggtttagcgaagctttctctcttccacttccgaagaatctaaggcattatgggtaaggaaaagattcacatcagtattgtggtcattggccatgtcgactctggaaagtccactaccactggtcacttgatctacaagcttggtggtattgacaagcgtgttattgagaggtttgagaaggaagctgctgagatgaacaagaggtcattcaagtatgcctgggtgcttgacaaacttaaggctgaacgtgagcgtggtatcactattgatattgctttgtggaagtttgaaaccactaagtactactgcactgtgattgatgcccccggacacagggactttatcaagaacatgatcactggtacctcccaggctgactgtgctgtcctcattattgactccaccactggtggttttgaagctggtatctctaaagatggtcagacacgtgaacatgcattgcttgcttttacccttggtgtcaaacaaatgatttgctgctgtaacaagatggatgctaccacccccaagtactccaaggctaggtatgatgaaatcgtgaaggaagtttcttcctatctcaagaaggtcggttacaaccctgacaaaatcccatttgtccccatctccggttttgaaggagataacatgattgagaggtctaccaaccttgactggtacaagggcccaaccctccttgatgctctcgaccagattaatgagcccaagaggccaacagacaaaccccttcgtcttccacttcaggatgtttacaagattggtggtattggaactgtcccagttggtcgtgttgagactggtgtgatcaagcctggtatggttgtgacctttggccctactggtttgacaactgaagtcaagtctgttgagatgcaccacgaagctcttctggaggcactccctggtgacaatgttgggttcaatgttaagaatgttgctgttaaggatctgaagcgtggttttgttgcctcaaactccaaggatgacccagctaagggggcagccagcttcactgcccaggtcatcatcatgaaccatcctggccagattggaaatggatatgcaccagtgctcgactgccacacttcccacattgctgtcaagtttgctgagatcttgaccaagattgacaggcgttcaggtaaggaacttgagaaggagcctaagttcttgaagaatggtgatgcaggtatggttaagatgattcccaccaagcctatggttgttgagacctttgctgagtacccaccattaggtcgttttgctgtgagggacatgaggcaaactgttgctgttggtgttgtcaagaacgttgacaagaaggacccaactggtgccaaggtcaccaaggctgcccagaagaagggaaaatgaagagtgcatttgatgagcacggatgaagtagttttgtttatttgcatcagttttttccaattttgttttggacagcattttaccagttttggatatggctacagaaggtattgtcatggttctctagcctctttttgaggatagtggagtaattgagcaatttggtcctgaccaaattacttgatgggcaatgacatatagctctggtggttgttcctttacctggttttatatcactttatagccttggtcactgcttaacttatttaacttgctgaaattttgagtatattttcttctcagatcttgttccattttcatggtaattaaatatttcatcatccacttttagct

SEQ ID NO: 817 - DNA, 1972 bp, Solanum phureja
cttcatcacttttgctgtgattcttcttcagctgtgccgcatatcgcctaatttctcttctctaagtttcttagtctctcaagatgggtaaagagaagattcacatcagcattgtggtcattggccacgtcgactctggaaagtcgactaccactggtcacttgatctacaagcttggtggaattgacaagcgtgttattgagaggtttgagaaggaagctgctgagatgaacaagaggtcattcaagtatgcctgggtgcttgacaaacttaaggccgaacgtgagcgtggtatcaccattgatattgctttgtggaagtttgagaccactaagtactactgcactgtgattgatgcccctggtcacagggacttcatcaagaacatgatcactggtacctcccaggctgactgtgctgtcctcattattgactccaccactggtggttttgaagctggtatctctaaagatggtcagacccgtgaacatgcattgcttgctttcacccttggtgtcaaacaaatgatatgctgctgtaacaagatggatgctaccaccccgaagtactccaaggctaggtatgatgaaatcgtgaaggaagtttcttcgtaccttaagaaggttggttacaaccctgacaaaattccctttgtccctatctctggttttgaaggagataacatgattgagaggtctaccaaccttgactggtacaagggaccaaccctccttgatgctctcgaccagattaatgagcccaagaggccaacagacaaaccccttcgtcttccacttcaggatgtttacaagattggtggtattggaactgtcccagttggtcgtgttgagactggtgtgatcaagcctggtatggttgtgacctttggccctactggtttgacaactgaagtcaagtctgtagagatgcaccacgaagctctcctggaggcactccctggtgacaatgttgggttcaatgttaagaatgttgctgttaaggatcttaagcgtggttttgttgcctcaaactccaaggatgacccagccaagggggcagccagcttcactgcccaggtcatcatcatgaaccatcctggccagattggaaatggatatgctccagtgctcgactgtcacacttcccacattgctgtcaagtttgctgagatcttgaccaagattgacaggcgttcaggtaaggaacttgagaaggagcctaagttcttgaagaacggtgatgctggtatggttaagatgattcccaccaagcccatggttgttgagacctttgctgaatacccaccattgggtcgttttgctgtgagggacatgaggcaaactgttgctgtgggtgttgtcaagaatgttgacaagaaggacccaactggtgccaaggtgaccaaggctgcccagaagaagggaaagtgaacagtgcagtgtgatgctggtgtttccaatgctatttattttcatcgagtgtgctatctagactctgttttatttagttctgctttagtttggtctttgatttgcttattaggttctagttctctgccttgtatgtcaagtactcattctcagaactgggtacttgataggcggtggcaagcatgattttgagcctgttttcttttgcttttgttgaggtgccttggtttgttttctatggtggctcaggatttttgttgttggtgtttgcctaaatttgagatcaagttttctactcattgccttttttgcatcattttatacttcacttttgctaaaggtggtaatttgattttaatagcgcagttctataaaggtgggatcaagttcagccttaaggatttgtataggtgagtgattttgtacatggtaattcgaaatggtgaattgaggtgaggtgtagagtagattgaacttgcaccaatagcggcactttggcgctgtagattgattgaaaaggcagccagtttaatgtgtatcat

SEQ ID NO: 818 - DNA, 1914 bp, Fragaria vesca
cttcctctctatctcattctgtctcgctctttcctctctcaagtcggcgagagagaaccaaccccctcctagcttcgcagatttagctaattcatcatgggtaaggaaaagtttcacatcaacattgtggtcattggccacgttgactctggaaagtcgaccaccactggtcacttgatctacaagcttggtggtattgacaagcgtgtgattgagagattcgagaaggaggctgctgagatgaacaaaaggtcattcaagtatgcctgggtgttggacaagctcaaggctgagcgtgagcgtggtattaccattgatattgccttgtggaagtttgagaccaccaagtactactgcaccgtcattgatgctcctggacatcgtgatttcatcaagaacatgattactggaacctctcaggctgattgtgccgtcctcattattgactccaccactggaggttttgaggctggtatctccaaggatgggcagacccgtgagcacgcactgcttgccttcactctcggtgtcaggcagatgatttgctgctgtaacaagatggatgccaccactcccaagtactcaaaggcaaggtacgatgaaattgtgaaggaagtctcttcctacctgaagaaggttggatacaacccagacaaaattgcctttgtccccatctctggatttgagggtgacaacatgattgagaggtccaccaaccttgactggtacaagggtcctaccctccttgaggctcttgaccagatcaacgagccaaagaggccctcagacaagcccctccgtctaccacttcaggatgtatacaagatcggtggtattggaactgtgccagtgggacgtgtggagactggtatcatcaagcctggtatggttgtgacttttggtcctactggtctaaccactgaggttaagtctgtggagatgcaccatgaggctctccttgaggctcttcctggtgacaatgttgggttcaatgtcaagaatgtcgctgtcaaggatctcaagcgtggttttgttgcatccaactccaaggatgaccctgccaaggaagctgctaacttcacctcacaggtcatcatcatgaaccaccctggtcagattggaaatggatatgctccagttcttgactgccacacctcccacattgctgttaagtttggtgagattttgaccaagatcgacagacgatctggtaaggaaattgagaaggagcccaagttcttgaagaatggtgattctggtatggttaagatgcttcccaccaagcccatggttgttgagaccttctctgagtacccacctcttggtcgttttgctgtgagggacatgcgtcagactgttgctgttggagtcatcaagaatgttgagaagaaggatccatctggtgccaaggtgaccaagtctgcagccaagaagaagtgagatgtgcctatgcaatcagtcctacttttagctagcctagttttgctgaactttcaatttcaatatttgtgttattctgaagttttgtggacacatatgaaacctttgcttcacagtcctctagccttggttggaggagctgagcacctagatgtatttctgggtgcttggcgagctgtgttgccgtctcccttttaaatttcgtgttttttcggttatacattgaggtgagttgtgtagttgcttgatgaacagctttcttaatgttgtaactttttatatctatgactatcattttataatcttgtgttttcttacatcttttcatttagctttacactgttctgttcttggatctcattggctttgaactcttccattgcttcattttaggttgagtatttgaagtctatagtatctctgtataaggtctcaagttgcatcttatattgcgatttcagtcttttattccaa

SEQ ID NO: 819 - DNA, 1791 bp, Solanum lycopersicum
ccaaaccctaacgcttcgcttatttgttttgcgcagccaaggtttagcgaagctttctctctttctcttccacctccaaagattctaaggcaatatgggtaaggaaaagattcacatcagtattgtggtcattggtcatgtcgactctggaaagtctactaccactggtcacttgatctacaagcttggtggtattgacaagcgtgtgatcgagaggtttgagaaagaagcagctgagatgaacaagaggtcattcaagtatgcatgggtgcttgacaagcttaaggctgagcgtgaacgtggtattaccattgatattgccttgtggaagtttgagaccacaaagtactactgcactgtgattgatgctcctggacacagagatttcatcaagaacatgattactggtacctctcaggctgactgtgctgtcctcatcattgactccacaactggtggtttcgaagctggtatttcaaaggatggacagacccgtgagcacgcattgcttgctttcacccttggtgtcaagcaaatgatttgctgctgtaacaagatggatgctaccacccccaagtactcaaaggctaggtatgatgaaatcgtgaaggaagtttcttcctacctcaagaaggttggttacaaccctgacaaaatcccatttgttcccatctctggttttgaaggagataatatgattgagaggtctaccaacctcgactggtacaagggaccaaccctccttgaggctctcgaccagattaatgagcccaagaggccatcagacaaaccactccgtctcccacttcaggatgtttacaagattggtggtattggaactgtcccagttggtcgtgtagagactggcgtaatcaagcctggtatggttgtgacctttggccctactggtttgacaactgaagtcaagtctgttgagatgcaccacgaagctctccaggaggcgctccctggagacaatgttgggttcaatgttaagaatgttgctgttaaggatcttaagcgtggttatgttgcctcaaactccaaggatgacccagcgaagggtgctgccagcttcactgcccaagttatcatcatgaaccaccctggtcagattggaaacggatatgccccagtgctcgactgccacacctcccacattgctgtcaagtttgctgagatcttgaccaagattgacagacgttctggtaaggaacttgagaaggagcccaagtttttgaagaatggtgatgccggtatggttaagatgattcccaccaagcccatggttgttgagacctttgctgagtacccaccattgggacgttttgccgtgagggacatgcgtcagactgttgctgttggagttgtcaagaacgtcgacaagaaagaccctactggtgctaaagtcaccaaggctgcccaaaagaagggaaagtagagtgcatttgatgagcacggatgaaatagttttgtttatttgcatcagtttttttcatttttgttttggacagcattttgccagttttggatatggctacagaaggtattgtcatggttctctagcctctttttgaggatagtggagtaattgagcaattatgtcgggaccaaattacttgatgggcaatgacatatagctctgttggttgttcctttacctgggttaaatcactttacacacagtcttggtcactgctcaacttatttaagtttatgaaattttgagtatatttccttctaagatcttgttcctgtttcatggtattagatttttcttttggttcgtga

SEQ ID NO: 820 - DNA, 1891 bp, Solanum lycopersicum
gtctcttcattacttttgctgtgatttctcctcagctgtgccgcatatcgcctaatttttcttctctaagtttcttagtgtctcaagatgggtaaagagaagattcacatcagcattgtggtcattggtcatgttgactctggaaagtcgactaccactggtcacttgatctacaagcttggtggtattgacaagcgtgttattgagaggttcgagaaggaagctgctgagatgaacaagaggtcattcaagtatgcctgggtgcttgacaaacttaaggcagaacgtgagcgtggtatcaccattgatattgctttgtggaagtttgagaccactaagtactactgcactgttattgatgcccccggccacagggatttcatcaagaacatgatcactggtacctctcaggctgactgtgctgttctcattattgactccactactggtggttttgaagctggtatttccaaagatggtcagacccgtgagcacgcattgcttgctttcacccttggtgtcaagcaaatgatttgctgctgtaacaagatggatgctaccacccccaagtactccaaggctaggtacgatgaaattgtcaaggaagtttcttcctacctcaagaaagtaggatacaaccctgacaaaatcccctttgtccccatctctggttttgaaggagacaacatgattgagcgatcaaccaaccttgactggtacaagggcccaaccctacttgaggctcttgaccagattaatgagcccaagaggccctcagacaagcccctccgtcttccacttcaggatgtctacaagattggtggtattggaactgtacctgtcggtcgtgttgaaactggtgtgattaagcctggtatggttgtcacttttggtccaactggtctgaccactgaggttaaatctgtggagatgcaccacgaggctcttcaggaggcacttcctggtgacaatgttgggttcaatgtcaagaacgttgcagttaaggatcttaagagaggttacgttgcctccaactccaaagatgacccagccaagggtgctgccagcttcactgcccaagttatcatcatgaaccaccctggtcagattggaaacggatatgccccagtgctcgactgccacacctcccacattgctgtcaagtttgctgagatcttgaccaagattgacaggcgttcaggtaaggaacttgagaaggagcctaagttcttgaagaatggtgatgctggtatggttaagatgattcccaccaagcccatggttgttgagacctttgctgaataccctccattgggtcgttttgctgtgagggacatgaggcagactgttgctgtcggtgttgtcaagaatgttgacaagaaggacccaactggtgccaaggtgaccaaggctgcccagaagaaggggaagtgaactgtgcagtgtgatgctggtgtttcgaatgctatttatttacatcgagtgtgctatctagactctgttttatttaattctgctttagtttggtctttgagttgtgtattaggttgtagttctctgacttgtatgtcaagtatccattctcagaactgggtacttgataggcggtggcgagcatgattttgagtctgttatcatttgcttttgttgaggtgccttggtttgttttccatggtggctcaggatttttgttgctttaatttgagatttaagttttctactcattacgttacatttaagttaacatgttacctttgctaaagggtggtgatttggttattaatagctcagttgtataatggtgcatcaaattctgcctgtaggatttgttgcaatttttatgctactgtgctgacttcctaatgcactataacatgagtgattttgtaca

SEQ ID NO: 821 - DNA, 1791 bp, Trigonella foenum-graecum
caccacttaataaaccctctaacccttacaattaaaccctaccgcttgcaacaatacaaaccctagcgctcctcttttctctcattctcttcttccttcaagatatatttgtggtgttaagcttttaaggacaaatgggtaaggaaaaggttcacattaacattgttgtcattggccatgttgactctgggaagtcaaccaccaccggtcacttgatctacaagcttggaggtattgacaagcgtgtgattgagaggttcgagaaagaagctgctgagatgaacaagcgttcattcaagtatgcttgggtgcttgacaagctcaaggctgaacgtgaaagaggtatcacaattgacattgctctatggaagtttgagactactaagtactactgcactgtcattgatgcccccggacacagggatttcattaagaacatgattactggtacatctcaagctgattgtgctgttctcatcattgattccactactggtggttttgaagccggtatttccaaggatggtcagacccgtgaacatgctctccttgctttcactcttggtgtgaagcaaatgatctgttgctgcaacaagatggatgccactacacccaagtactccaagggtaggtatgaagaaattgtgaaggaagtttcgtcctatttgaagaaggttggctataacccagacaaaattccatttgttcccatctctggttttgagggtgataacatgatcgaacgctctacaaatcttgactggtacaagggtccaacccttcttgaggcacttgaccaaatcaacgagcctaagaggccatcagacaagcccctccgactaccacttcaggatgtctacaagattggaggaattggaactgtgcctgtgggacgtgttgagactggtgtcttgaaacctggaatggtggtgacttttgcgccatctggactaacaactgaagtcaagtctgtcgagatgcaccatgaagctctcactgaggcacttcctggtgacaatgtcggatttaatgttaagaatgttgctgttaaggatctcaagcgtggttatgttgcctcaaactccaaggatgaccctgccaaggaggcggctaactttacatctcaagtgatcatcatgaatcaccctggccagattggaaatggctacgcccctgttcttgactgccacacctcccacattgctgtcaaatttgctgagcttgttaccaagattgacaggcgttctggaaaggagattgagaaggagcccaaattcctgaagaatggtgatgctggtattattaagatgattcccaccaagcccatggtggttgagactttctctgaatatcctccactcggccgtttcgctgtcagggacatgcgtcaaactgtggctgttggtgtcatcaagggtgtggagaagaaggatcccagtggaggacttaccaaaactaagtcagcattgaagaagaagtgaaccgtgccggatgatctatccaaggaagtctattatggtgattacaataaatggtttgctctatgtagtacttttatttttcgtcttgttaacttgtttttcggattaagtgtcaagtctgcaccgtcatctcgcaacttttgttcccagaactgggttctagatcgacggtggcagggctatttgttttgtgtttatgctttaacttttggaagcagatagactgctgatttggtttttgaatatcaactctttatgttatttggtctatggtgctagttttaagttgctaaggctgggtcctttatct

SEQ ID NO: 822 - DNA, 1733 bp, Tripterygium wilfordii
acttccaagtctgcgaggaaagacagtcgatcgttcttcttgaattctacttgtcagctacagctagaattccataatgggtaaggagaagactcacattaacatcgtggtcattggccatgtcgattctggtaagtcaaccaccacggggcacttgatttacaagcttggtggaattgacaagcgtgttattgagaggtttgagaaggaagctgctgagatgaacaagaggtcattcaagtatgcctgggtgttggacaaactcaaggctgagcgcgaacgtggtatcaccattgatattgctctgtggaagtttgagaccacaaagtactactgcactgtcattgatgctcctggacatcgtgactttattaagaatatgatcactggtacctcacaggctgactgtgctgtcctcattattgactcaaccactggtggttttgaagctggtatttccaaggatggccagacccgtgagcatgcattgcttgcttttacccttggtgtgaaacaaatgatctgttgctgcaacaagatggacgccacaacccccaaatactcgaaggctaggtatgatgaaattgtgaaggaagtttcttcctacttgaagaaggttggttacaaccctgacaagataccatttgttcccatctctggttttgagggtgataacatgatcgagagatctaccaaccttgactggtacaagggcccaaccctccttgaggctcttgacatgatcaatgaacccaagaggccctcagacaagcccctccgtcttcctcttcaggatgtttacaagattggtggtattggaactgtcccggtgggacgtgtggaaactggtgtcgtgaagcctggtatggttgtgacctttggtcctactggactcacaactgaagttaagtctgttgagatgcaccatgaggctctgctggaggccctgccgggtgacaatgttggtttcaatgtcaagaacgttgctgtgaaggatctgaagcgtggttttgttgcttctgactccaaaaatgatcctgctaagggggctgccagcttcacctctcaggtcatcatcatgaaccaccctgggcagattggaaatggctatgccccggtccttgattgccacacatcccacattgctgttaagtttgccgagatcttgactaagattgatcggcgatctggcaaggagcttgagaaggagccaaaatttttgaagaatggtgatgcaggaatggtgaagatgattccaaccaagcctatggtggtggagaccttctccgagtatcctcctcttggtcgttttgctgtgagggacatgcgccagactgtggctgtgggtgtcatcaagagtgttgataagaaggatgcatctggtgccaaggtgaccaagtctgctgctaagaagaagtgactcgtagaagttcatggtggatcatcgccttcagcttctgtctacttttatcaaaataattgtctttcattcgcattttatgtcggtactgtcatattttgtttttcatttggttttatatgttgtaattttgtgccgttgttgggttgccagtctgagaactgggtgcttgacaggcgatggcacagcttatagcatggagtctggtttttagagattttagtgtcaattttctgttaagattactatgtttgaggtgttttgggctttctccccaactgctccgaagttttgtggttgtggtttattaagt

SEQ ID NO: 823 - DNA, 1851 bp, Tripterygium wilfordii
agggtttttagtgccttttctttgcgaaagttttgtattagaaatcagccatgggtaaggagaagactcacatcaacattgtggtcattggccacgtcgactctggaaagtcgaccaccactgggcacttgatttataagcttggtggaattgacaagcgtgttatcgagaggtttgagaaggaagcagctgagatgaacaagagatcatttaaatatgcctgggtgttggacaaactcaaggctgagcgtgaacgtggtattaccattgatattgctctctggaagtttgagaccacgaagtactactgcactgtcattgatgctcctggacatcgtgacttcattaagaatatgatcactggtacctcacaggctgactgtgctgtcctcattattgactccaccactggtggttttgaagctggtatttccaaggatggccagacccgtgagcatgcactgcttgcttttacccttggtgtgaaacaaatgatttgttgttgcaacaagatggacgccactacccccaaatactctaaggctaggtatgatgaaattgtgaaggaagtttcttcctacttgaagaaggttggttacaaccctgacaagatcccatttgttcccatctctggttttgagggtgacaacatgatcgagagatctaccaaccttgactggtacaagggcccaacccttcttgaggctcttgacatgatcaatgaacccaagaggccctcagacaagcccctccgtctccctcttcaggatgtttacaagattggtggtattggaactgtcccagtcggacgtgttgagactggtgttgtgaagcctggtatggttgtgacctttggtcctactggactgacaactgaagttaagtctgttgagatgcaccatgaggctctgctggaggccctgccaggtgacaatgttggtttcaatgtcaagaacgttgctgtgaaggatttgaagcgtggttttgttgcttctgactccaaaaatgatcctgctaagggggctgccagcttcacctctcaggtcattatcatgaaccaccctgggcagattggaaatggctatgccccggtccttgattgccacacatcccacattgctgttaagtttgctgagatcttgactaagattgacaggcgatctggtaaggagcttgagaaggagccaaagtttttgaagaatggtgatgcaggaatggtgaagatgattccaaccaagcctatggtggtggagactttctctgagtaccctcctcttggtcgttttgctgtgagggacatgcgccagactgtggctgtgggtgtcatcaagagtgttgataagaaagatgcatctggtgccaaggtcaccaagtctgctgccaagaagaagtgagccatgggagttcacagttgatcccattttgctgaagtctactttcataggaataattgtctttcatacagattttatgtcggtactgtcaaccagttttgtttcgtttaacatgttttagttgtgttgtcattgttgggttgccagtctgagaaccaggtacttgacaggcggtggcacagcttatagcatggagtcctgctgtttttagagattcaagtgtcaatttcttgttaagattactatatgtctgaggtgcggtttttcccaaacggctcagaaattttgttcttgtggtcaagcaaatttggggattacattcttgtccacttgtgatggactcattgtttttgtgctttagctaaatctctatgatcttgagctatttttgagcagtttatgacgttactaatctgtatttagcttcaagggttagacttattaggaaatatcaatt

SEQ ID NO: 824 - DNA, 1621 bp, Tripterygium wilfordii
gtatccttccaggtcggcgagagagactcagtagatcgttcttctggacttatatttgtcgcctacagctagaattccataatgggtaaggagaagactcacattaacatcgtggtcattggccatgtcgactctggaaagtcgaccaccactggacatttgatttataagcttggtggcattgacaagcgtgttatcgagaggtttgagaaggaagcagctgagatgaacaagagatcatttaagtatgcctgggtgttggacaaactcaaggctgagcgtgaacgtggtattaccattgatattgctctctggaagtttgagaccacgaagtactactgcactgtcattgatgctcctggacatcgtgacttcattaagaatatgatcactggtacctcacaggctgactgtgctgtcctcattattgactccaccactggtggttttgaagctggcatttccaaggatggccagacccgtgagcatgcactgcttgcttttacccttggtgtgaaacaaatgatttgttgttgcaacaagatggacgccactacccccaaatactccaaggctaggtatgatgaaattgtgaaggaagtttcttcctacttgaagaaggttggttacaaccctgacaagatcccatttgttcccatctctggttttgagggtgacaacatgattgagagatctaccaaccttgactggtacaagggcccaacccttcttgaggctcttgacatgatcaatgaacccaagaggccctcagacaagcccctccgtctccctcttcaggatgtttacaagattggtggtattggaactgtcccagtcggacgtgttgagactggtgttgtgaagcctggtatggttgtgacctttggtcctactggactcacaactgaagttaagtccgttgagatgcaccacgaggctctgctggaggccctgccaggtgacaatgttggtttcaatgtcaagaacgttgctgtgaaggatttgaagcgtggttttgttgcttctgactccaaaaatgatcctgctaagggggctgccagcttcacctctcaggtcattatcatgaaccaccctgggcagattggaaatggctatgccccggtccttgattgccacacatcccacattgctgttaagtttgctgagatcttgactaagattgaccgacgatctggtaaggagcttgagaaagagccaaagtttttgaagaatggtgatgcaggaatggtgaagatgattccaaccaagcccatggtggttgagacgttctctgagtaccctcctcttggtcgttttgctgtgagggacatgcgccagaccgtggctgtgggtgtcatcaagagtgttgataagaaggatgcatctggtgccaaggtcaccaagtctgctgctaagaagaagtaatagatgtcttttagttgatttgtgtcagctgctgtagtgtttatttgcattttaccatgcaattttgtttgctttctgtggcagttttgtcatttgtggacatcttaagtcgatgtttcttggttttgttagtgttgtggactatgattcatgaacattgctgagttttgtggtaaaatttctctttttcaaatac

SEQ ID NO: 825 - DNA, 1666 bp, Tripterygium wilfordii
ctcttcgtctgcggctagggtttttagtgccttttctttgcgaaagttttgtattagaaatcagccatgggtaaggagaagactcacatcaacattgtggtcattggccacgtcgactctggaaagtcgaccaccactgggcacttgatttataagcttggtggaattgacaagcgtgttatcgagaggtttgagaaggaagcagctgagatgaacaagagatcatttaaatatgcctgggtgttggacaaactcaaggctgagcgtgaacgtggtattaccattgatattgctctctggaagtttgagaccacgaagtactactgcactgtcattgatgctcctggacatcgtgacttcattaagaatatgatcactggtacctcacaggctgactgtgctgtcctcattattgactccaccactggtggttttgaagctggtatttccaaggatggccagacccgtgagcatgcactgcttgcttttacccttggtgtgaaacaaatgatttgttgttgcaacaagatggacgccactacccccaaatactctaaggctaggtatgatgaaattgtgaaggaagtttcttcctacttgaagaaggttggttacaaccctgacaagatcccatttgttcccatctctggttttgagggtgacaacatgatcgagagatctaccaaccttgactggtacaagggcccaacccttcttgaggctcttgacatgatcaatgaacccaagaggccctcagacaagcccctccgtctccctcttcaggatgtttacaagattggtggtattggaactgtcccagtcggacgtgttgagactggtgttgtgaagcctggtatggttgtgacctttggtcctactggactgacaactgaagttaagtctgttgagatgcaccatgaggctctgctggaggccctgccaggtgacaatgttggtttcaatgtcaagaacgttgctgtgaaggatttgaagcgtggttttgttgcttctgactccaaaaatgatcctgctaagggggctgccagcttcacctctcaggtcattatcatgaaccaccctgggcagattggaaatggctatgccccggtccttgattgccacacatcccacattgctgttaagtttgctgagatcttgactaagattgaccgacgatctggtaaggagcttgagaaagagccaaagtttttgaagaatggtgatgcaggaatggtgaagatgattccaaccaagcccatggtggttgagacgttctctgagtaccctcctcttggtcgttttgctgtgagggacatgcgccagaccgtggctgtgggtgtcatcaagagtgttgataagaaggatgcatctggtgccaaggtcaccaagtctgctgctaagaagaagtaatagatgtcttttagttgatttgtgtcagctgctgtagtgtttatttgcattttaccatgcaattttgtttgctttctgtggcagttttgtcatttgtggacatcttaagtcgatgtttcttggttttgttagtgttgtggactatgattcatgaacattgctgagttttgtggtaaaatttctctttttcaaatacgcttgtggtgtcttgttttgaattgttttagttctgccgaaaaccttttttctgatagaa

SEQ ID NO: 826 - DNA, 1760 bp, Utricularia gibba
ggcgtcttcctttttagttgtctgttgaagctgcgaaatgggtaaagagaaggttcatatcaacattgtggtcattggccatgtcgactccggaaagtccaccaccaccggtcacttgatctacaagcttggtggcatcgacaagcgtgtgattgagaggtttgagaaggaggccgctgagatgaacaagaggtcattcaagtacgcgtgggtgcttgacaagctcaaggctgagcgcgagcgtggtatcaccatcgatattgccttatggaagtttgagacgaccaagtattactgcaccgtgattgacgccccgggacatcgtgactttatcaagaatatgattactggtacctcacaggcagattgtgccgttcttatcattgactctaccactggtggtttcgaagctggtatctctaaggatggccagactcgtgagcacgcgttgcttgccttcaccctgggtgtcaagcagatgatttgctgctgcaacaagatggatgcgaccacaccaaagtactcaaaggccagatatgacgaaattgtcaaggaggtatcttcttacctgaagaaggttggatacaaccctgagaagatccccttcgtcccaatctctggatttgaaggtgacaacatgattgagagatccaccaatcttgactggtacaagggccccacgctactggatgctcttgatttgattaatgagcccaagaggccctcggacaagcccctccgccttccacttcaggatgtttacaagattggtggaattggtaccgtgcctgttggtcgtgtggagaccggtgtcctcaagcctggtatggtggtgacctttggcccctctggtctgaccactgaggtcaagtctgttgagatgcaccacgaggcactacaggaggcccttcccggagacaatgttgggttcaacgttaagaatgttgccgtcaaggatctgaagcgtggttttgtggcatccaattccaaggatgacccagcaaaggaagcggccaacttcacatcccaggtcatcatcatgaaccaccctggccagatcgggaatggatatgcccctgtcctcgattgccatacttctcacattgctgtcaagtttgctgaaatccttaccaagatcgataggcgatctgggaaggagctggagaaagagcccaagttcctgaagaatggtgatgctggtttcgtgaagatgattcccaccaaacccatggtggtggaaaccttctccgagtaccctcctctggggcgtttcgccgtgcgcgacatgcgccaaaccgtggccgtgggtgtcatcaagagcgtggagaagaaggatcccaccggtgccaaggtgaccaaggcagcggcgaagaagggcgccaaatgaatggtgcaatgccccagttctggtatcctttcagtgagtcccaataagagttttctgctcaaagactattgcttcttctgtgtgtctgtttgtgtgcccgcgcatgttggtatgtcccagagctgggttctcgacaggcggtggcgaaacctgaactcttttcctccgccgtggctgctctgaaacttggtttttgtttgcttgtgtcgtcgtgatgctcttctgtgtgtcttcttttgatgaggatttttcctccgacagtgatttaaattattatcctaaagctggaaccaaaaaaaaaaaaaaaaaacaaaactcgagacacaaacccaacgacgtccttagtgagaacacagctactctcacctctaca

SEQ ID NO: 827 - DNA, 1665 bp, Malus domestica
ttttaacacaagcagatttaacacagattgcggacattaatataaagttgtccaatgacccactaaacgaccgatttcaatgtataaaccaacaaatagaatacaacacagcttgccgagcaaccagaatcgcttctagccgctcagctcctccacaatccttgcaagcaaggcaagagggctacgatgtaaaacttgtaaaacctgtccaagtaactccgagagtggcacaaaaatggaaaataaacgacatcagacaaaactgatctagctaagggcggacgataacataaaacacttcacttcttcttggctgcggccttggtcaccttggcaccagttggctccttcttctccacactcttgatcacacccacagcaacggtctggcgcatgtctctcacagcaaaacgtccgagaggggggtactcagagaaggtctcgacaaccatgggcttggtgggaatcatcttaaccataccagcatctccgttcttcaagaatttgggctccttctcaagctccttaccggatcgcctgtcaatcttggtcaagatctcagcaaacttgacagcaatgtgggaggtgtggcaatcgagcactggagcataaccatttccaatctgcccagggtggttcatgatgatgacctgagaggtaaagttggcagcctcctttgcaggatcatccttggagttggaagcaacaaaaccacgcttcagatccttgacagcaacattcttaacattgaacccgacattgtcaccgggaagagcctcctgaagagcttcatggtgcatctcaacagacttaacttcagtggtcagaccagtgggaccgaaggtcacaaccataccaggcttcacaacaccagtttcaactcgtcccacaggcacagttccaatgccaccaatcttgtacacatcctgaagtgggagacggaggggcttgtctgagggcctcttgggctcattgatcaggtcaagggcctcaagaagggttggtcccttgtaccagtctaggttggtggacctctcaatcatgttgtcaccctcaaatccagaaatggggacaaaggcaattttgtcagggttgtacccaaccttcttgaggtaggatgagacttccttcacgatttcatcgtaccttgccttcgagtacttgggagtaacccaccttgttgcagcagcaaatcatctgcttgacaccaagagtgaaagcaagcagagcatgctcacgggtctgaccatccttggaaataccggcctcaaaaccaccagtggtggaatcaataatgaggacagcacaatcagcctgggaggtaccagtgatcatgttcttgatgaaatcacgatgtccgggagcatcaataacagtgcagtagtacttggtggtctcaaacttccacaaggcaatatcaatggtaataccacgctcacgctcagccttgagcttgtccaacacccaagcatacttgaatgacctcttgttcatctcagcagcctccttctcaaacctctcaatgacacgcttgtcaatacctccaagcttgtagatcaagtgaccagtggtggttgacttcccagagtcgacatggccaatgaccacaatgttgatgtgaaacttttccttacccatgatgggatctcagcaagttatctgaaa

SEQ ID NO: 828 - DNA, 1650 bp, Cannabis sativa
aataaaaagtaggatattgtaaaactgataaataatactgttcaagcacaactaagtgcaaaacaaaacaaactcaaacggaatgctaccaccgccggtcgagcacccaattctgagtgcaacgactggaaagcgagcacagacaaacaagacgatcccaaacaaaaccgaatagatagttcaaaacaacacagtaaaaataaaatgacaacttatttcgataaacagataaatagttcttccaaacaccatccagtgcaatttccatttgcaaaagtcacttcttcttggcagcagacttggtcaccttagctcctgatgggtccttcttctccacactcttgatgacaccaacagcaacggtttgacgcatgtcacggacagcaaaacgtccgagtggtgggtactcagcgaaggtttcaaccaccatgggcttggttggaaccatcttaaccatacctgcatcaccgttcttcaagaactttggctccttctcgagctccttaccagacctacggtcaatcttggttaggatttcagaaaacttgacagcaatgtgggaggtgtggcagtcgagaactggggcatagccgttgccaatttgaccagggtggttcatgataatgacctgagcagtgaagttggctgcctccttggcaggatcatccttggagttggatgcaacgtaaccacgcttgagatccttaactgccacattcttaacattgaacccaacattgtcaccgggaagagcctcgagaagagcctcgtggtgcatctcaactgacttgacctcagtggtcagaccggtgggagcaaaggtgacaaccataccaggcttgatgacaccagtctcaacacgacccactggcacagttccaataccaccaatcttgtagacatcctgaagtggaagacggagtggcttgtctgagggtctcttgggctcagagagattgtcaagagcttcaagaagagttggacccttgtaccagtcaaggttggtagacctctcaatcatgttgtctccttcgaaaccagagatgggaacgaatgggattttgtcagggttgtacccaaccttcttcaagtaggaagagacttccttcacgatttcctcatacctggccttggagtatttgggtgtggtggcatccatccttgttacaacaacagatcatctgcctgacaccaagggtgaaagcaagaagagcatgctcacgggtctgtccatccttagagataccagcttcaaaaccaccagtggtggaatcaatgatgagaacagcacaatcagcctgtgaagtaccagtaatcatgttcttgataaagtcacgatggccaggagcatcaatgactgtgcagtagtacttggtggtctcaaacttccacagggcaatgtcaatggtgataccacgctcacgctcagccttaagcttgtcaagaacccaagcatacttgaaagacctcttgttcatctcagcagcttccttctcaaacctctcaatcacacgcttgtcaattcctccaagcttatagataaggtgaccagtggtggtcgacttgccggagtcgacatggccgatgaccacgatgttgatgtggatcttttcctttcccatttcgaatcaaattgcaaactacaaattc

SEQ ID NO: 829 - DNA, 1900 bp, Gossypium hirsutum
aaacaaatctcctaaagggtattttagaaaagataaagtaggcaaacctgagtacagaatagaacaagaggcttgctcgaaaacctatactctctgattatctctcttcttcgagccgctaggtcgtactgttttagcttcaagtctctcttttttgaaagttcctagttaatactggataatgggtaaggagaaggttcacatcaacattgttgtcattggccatgttgactctggaaagtcaaccacaacgggtcacttgatatacaagcttggaggtattgacaagcgtgtgatcgagaggttcgagaaggaagctgctgagatgaacaaaaggtcattcaagtatgcctgggtgctcgacaagttgaaggctgagcgtgagcgtggtatcaccattgatattgccttgtggaagtttgagacaaccaagtactactgcactgtcattgatgctcctggacatcgcgactttattaagaatatgattacgggtacttctcaagctgactgtgctgtccttatcattgactccacaactggaggttttgaagctggtatttccaaggatgggcagacccgtgagcatgctctccttgccttcacccttggtgtcaagcaaatgatttgctgctgcaacaagatggatgccacaacccccaagtactcaaaggcaaggtatgatgaaattgttaaggaagtttcttcttacctgaagaaggttggttacaaccctgagaagattccattcgtccccatctctggttttgagggtgacaacatgattgagaggtccaccaacctcgattggtacaagggtccaaccctccttgaggctcttgaccagatcaatgagcccaagagaccctctgacaagcccctccgtctcccacttcaggatgtctacaagatcggtggtattggaactgtcccggtgggtcgtgttgaaaccggtacccttaagcctggaatggttgttacattcggaccttcttggattgaccactgaagttaagtctgttgagatgcatcatgaagctcttcaagaggctcttcctggtgacaatgttgggttcaatgtgaagaatgttgctgtcaaggatctcaagcgtggatttgttgcctccaactccaaggatgatcctgccaaggaggctgccaacttcacctcccaagttatcatcatgaaccacccaggccagattggaaatggctatgcaccggtcctcgattgccacacctcccatattgctgtcaagtttgcagagctcttgaccaagattgacaggcgatctggtaaggagcttgagaaggagcctaagttcttgagaatggtgatgctggtatgattaagatggttccgaccaagcccatggttgtggaaaccttctccgcgtaccctccacttggacgttttgccgttagggacatgagacagactgttgctgttggtgtaatcaagagtgtggagaagaaggacccaactggagccaaggtgaccaagtctgctgccaagaagggcaagtgaacctcaggggatttgttgattcaacaaaagtttatcatggttactacaataaaattttggttcatgttagtaggtccatcactggacgtttagttacatgttttaatggttcaccgtcatctcctggatattgttcccagaactgggttcttgataggcggtggtgaggtttatctttggagtccatagtgtgtcatcattaatattattatgccttattgagctataaacttgatatttttgttcccatttttcgaccaaagtggtcctggagttttacctcttttcctgggctcctttccttcactcaatgttctatctaaaccttttatattatccaagtctataacctgtttctgttttaaaaaaaaa

SEQ ID NO: 830 - DNA, 1398 bp, Eschscholzia californica
gagcttttttccttgacgttttcatcaccaaagttatttgattttctgaggaactcaacatgggtaaagagaagattcatatcagtattgtcgtcattggacatgtcgactctggaaagtcgaccaccactggtcacttgatctacaagttgggaggtattgacaagcgtgttatcgaaagattcgagaaggaggctgctgagatgaacaagaggtctttcaagtacgcatgggttcttgacaagcttaaggctgaacgtgagcgtggtattaccattgatattgccttgtggaaatttgagaccaccaagtactactgcactgttattgatgccccaggacatcgtgatttcatcaagaacatgattactggtacctctcaggctgattgtgccgtcctcatcattgactccaccactggaggttttgaagccggtatctctaaggatggacagacccgtgagcacgctcttcttgctttcacccttggtgtcaagcagatgatctgttgttgtaacaagatggatgctacacccccaagtactcaaaggcaaggtacgaggaaatcgttaaggaagtctcatcttacttgaagaaggttggatacaacccagacaaaatcgcctttgttcccatctctgggtttgagggtgacaacatgattgagagatccaccaaccttgactggtacaagggaccaacccttcttgacgcccttgaccaaatcaatgagccaaagagaccctcagacaagccactccgtcttccacttcaagatgtttacaagattggtggtattggaactgtgccagttggacgtgttgagactggagtcatcaagcccggtatggttgtcacttttggtcccactgggttgaccactgaggttaagtccgtggagatgcaccacgaggctctccaggaagcacttccaggtgacaatgtcggattcaacgttaagaatgttgctgtcaaggatctcaagcgtggtttcgttgcctccaactccaaggacgacccagccagggaagctgctaacttcacctcccaggttatcatcatgaaccaccctggtcagatcggtaacggatacgctccagttcttgattgtcacacctcccacattgctgtgaagttcggtgagatcctcaccaagattgacagacgatctggaaaggagctcgagaaggagcccaagtttttgaagaatggtgatgccggtatggttaagatgcttccaaccaagcccatggttgtggagacctttgccgaatacccaccccttggtcgtttcgctgttagggatatgcgacagacagttgctgtcggagtcatcaagagtgttgagaagaaggatccatcaggtgccaaggtcaccaagtcagctgccaagaagaa

SEQ ID NO: 831 - DNA, 1545 bp, Flaveria ramosissima
tttcctccatctaccttgagagatcgtctgcataatcttcgttaaggatgggtaaggaaaagacgcatatcagtattgttgtcattggacatgtcgactccgggaagtctaccactaccggacatcttatctacaagcttggtggtatcgacaagcgtgtgatcgaaaggttcgagaaggaagctgctgagatgaacaagaggtccttcaaatacgcttgggtgctcgacaagctcaaggcagagcgtgaaagaggtattaccattgatattgccttgtggaagttcgagaccaccaagtactactgcactgtcattgatgctcccggacatcgtgatttcatcaagaacatgattactggtacctcccaagctgactgtgctgttctcatcatcgactcgaccactggtggttttgaagccggtatttccaaggatggtcagacccgtgagcacgcgcttcttgctttcactcttggtgtcaagcaaatgatttgctgctgtaacaagatggatgccaccaccccgaaatactccaaggcaaggtatgatgaaattgtgaaggaagtttcttcatacttgaagaaggtcggatacaacccgacaaaatcccatttgtgccaatctctggtttcgaaggagacaacatgattgagaggtccaccaacctcgactggtacaagggtccacccttcttgaagctcttgaccagatcaacgagcccaagagaccctcagacaagccacttcgtctcccacttcaggacgtgtacaagatcggtggtattggaactgtgccagtgggacgtgttgagactggtgtgatcaagcctggtatggttgtcaccttcggaccatctgggttgaccactgaagtcaagtctgttgagatgcaccacgaagcacttaccgaagctctccccggtgacaacgttgggttcaacgtcaagaacgttgctgtcaaggatctcaagcgtggttatgttgcctcaaactccaaggatgatcccgctaagggtgcagccagcttcacctctcaggtcatcatcatgaaccaccctggccagatcggtaacggttatgccccagttctcgactgccacacctcccacattgctgtcaagttctccgagctcttgaccaagatcgacaggcgatctggtaaggagctcgagaaggagcctaagttcttgaagaacggtgatgctggtatggttaagatgcttcccaccaagcccatggttgttgagacctttgctgaatacccaccacttggaaggtttgccgtgagagacatgcgtcagacggttgcagtcggtgttatcaagagtgttgataagaaggacccgaccggagccaaggtgaccaaggctgcagccaagaagggagccaagtgaggtgaggtggtttgtgatttggtttatggagtattttatgttttgtcatttgatttactagttttgaactttatttcgttgaggagttttgtttgtttttcaatctttgaagctttcattattattgtggaagttttatgggttgcagac

SEQ ID NO: 832 - DNA, 1715 bp, Vitis vinifera
acagttgattaaaaaccaaaatatccggagtaaaagacacaacaaaactcttgagccgcgaaagcacctcgatcaaaagaggacacgacacaacatgacaatgacaaaggaaaagcaaaggactcaaccagttatctgccaccgcctatcaagcacccagttctgggacaggctacccaaggaagaaggcagaaaactatgacgcacaaaataaagcggacgatctatgacagtagtaatagataaaatgttttcacgacaaatcattttattttgatgataggaggcttcctctgttgagctcccattgcgcacgcttcacttcttcttggctgcagacttggtgaccttggctccagatggatccttcttctccacgctcttgatgactccaacagcaacagtctgacgcatgtcacgaacagcaaaacgaccaagtgggggatactcggagaaagtctccaccaccatgggcttggttggaatcatcttaacaaaccctgcatcaccattcttcaagaacttgggctccttctcaagctccttgccagatcgcctgtcaatcttggtcagtatctcagcaaacttaacagcaatgtgggaggtgtggcagtccagaacaggggcatagccatttccgatctgacccgggtggttcatgatgatgacctgggaggtgaagttggctgcctccttagcagggtcatccttggagttggaggcaacaaacccacgcttgagatccttcacagcaacgttcttcacattgaagccaacattgtcaccaggcaaagcctctgggagagactcatggtgcatctcaacagacttgacttcagttgtcagtccagaggggccaaaggtcaccaccataccgggcttcaggacaccagtctccacacgtcccactgggacagttccaatcccaccaatcttgtacacatcctgaagagggagtcgcagtggcttgtctgtgggcctcttgggctcattgatcatgtccagggcctcaagaagagttgggcccttgtaccagtcaaggttggtagacctctctatcatattgtcaccctcaaagccagagatggggacaaatggaatcttatcagggttgtatccaaccttcttcaggtaggaagaaacttccttcacgatttcatcgtaccttgccttggagtacttgggtgttgtggcatccatctattacagcaaatcatctgcttcacaccaagggtgaaagcaagtagtgcatgctcacgggtttgtccatccttggagataccagcttcaaaaccaccagtggtggagtcaataatgaggacagcacaatctgcctgtgaggtaccagtaatcatgttcttgatgaagtcccgatggccaggagcatcaataacagtgcagtagtacctggtggtttcaaacttccacaaggcaatatcaatggtgataccacgttcacgctcagccttcagcttgtccaacacccaagcatacttgaatgacctcttgttcatctcagccgcttccttttcaaacctctcaatcacacgcttgtcaatacctccaagcttgtagatcaagtgaccagtggtagtcgacttgccagagtcgacatggccaatgacgacaatgttgatgtgaaccttctctttacccattgtggattcctaaaaagatgctttagaaggagatatcgtgctaaaaccctagccgca

SEQ ID NO: 833 - DNA, 1605 bp, Papaver somniferum
tagcgagaggcgctctcaggaatttctctgctctgcaagtgtcttaaacatggggaaggagaaggttcacatcaacattgtcgttattggacatgtcgactctgggaagtcaaccaccactggtcacttgatttacaagcttggaggtattgacaagcgtgtgattgagagatttgagaaggaagctgctgagatgaacaagaggtcattcaagtacgcatgggtgctcgacaagctcaaggctgaacgtgagcgtggtatcaccattgacattgctctatggaaatttgagaccaccaagtactactgcactgtcattgatgcacctggtcatcgtgactttatcaagaacatgattactggtacttctcaggctgactgtgctgtccttattatcgattccaccactggtggttttgaagctgggtatctctaaggatggacagacccgtgagcatgctcttcttgctttcacccttggtgtgaagcagatgatctgttgttgtaacaagatggatgccactacccccaagtactccaaggctaggtacgatgaaatcgttaaggaagtctcatcctacctgaagaaggttgggtacaacccagacaaaattgcctttgtccccatctctggttttgagggagacaacatgattgagaggtctaccaaccttgactggtacaagggaccaaccctccttgaggcccttgaccagatcaatgagcccaagagacccacagacaagcccctccgtcttccacttcaggatgtttacaagattggtggtattggaactgtgccagtgggacgtgttgaaactggtttgatcaagcctggtatggttgtgacttttggccctactggtttgaccactgaagttaagtctgtggagatgcatcatgaggctctcctggaagctcttccaggtgacaatgttgggttcaacgtcaagaatgttgctgtgaaggatctcaagcgtgggtttgttgcctccaactccaaggatgaccctgccagggaggctgccagcttcacctcccaggtcatcatcatgaaccaccctggtcagatcggtaacggttatgccccagtgcttgactgccacacttcccacattgctgtcaagttcggtgagatcctcaccaagattgacaggcgatctggtaaggagcttgagaaggagcccaagttcttgaagaatggagatgctggtattattaagatgcttcccaccaagcctatggttgtggagaccttctctgagtaccctcctcttggacgttttgctgtcagagacatgaggcagactgttgctgttggagttatcaagagtgttgagaagaaggatccatctggagccaaggtcaccaagtctgctgctaagaagaagtgaaccgagcagtgtcatcgcctagttaatgcttctgaatttcattacaattactatcataaagactggttacttgttagttgtattatcaactctttaggttttgtttgttgtggttatagttctttgccatcatcttcgttaggcagccgttctcagaactgggtgcttgacaggcggtggcggtgctatttatcatcagtgtctccgtttt

SEQ ID NO: 834 - DNA, 1589 bp, Sorghum bicolor
gtttcctgcagccatgggtaaggagaagactcacataaacattgtggtcattggccatgtcgactctggcaagtcgaccaccactggccacctgatctacaagcttggtggtattgacaagcgtgtgatcgagaggttcgagaaagaggctgcggagatgaacaagaggtcgttcaagtatgcgtgggtgcttgacaagctcaaggctgagcgtgagagaggtatcacaattgatattgccctgtggaagttcgagaccaccaagtactactgcacggtcattgatgcccctggccaccgtgacttcatcaagaatatgatcactggcacttctcaggctgactgtgctgttcttatcattgactccaccactggtggttttgaggctggtatctccaaggatggccagacccgtgagcatgctctccttgctttcacacttggagtgaagcagatgatttgctgctgcaataaggtatgatccacacccaagtactcgaaggcccgttatgatgaaattgtgaaggaagtctcttcctacctgaagaaggttggatacaacccagacaagatccactttgttcccatctctggttttgaaggtgacaacatgattgagaggtccaccaaccttgactggtacaagggcccaaccctgcttgaggctctggacttaatcaatgagccaaagaggccttcagacaagcccctgcgtctcccccttcaggatgtgtacaagattggtggtattggaactgttcctgtgggacgtgttgagactggtatcatcaagccgggtatggttgtcaccttcggtcctagtggccttacaactgaggttaagtctgttgagatgcaccacgaggctctccaggaggcccttcctggtgacaatgttggcttcaacgttaagaatgttgctgtgaaggatctgaagcgtgggtatgtggcctccaactccaaggatgaccctgccaaggaggctgctagcttcacctcacaggtcatcatcatgaaccaccctgggcagattggcaatggctatgccccagtgctggactgccacacctcacacattgctgtcaagtttgctgagcttgttaccaagattgataggcgatctggcaaggagcttgagaaggagcccaaattcctcaagaacggtgatgctggtatggtgaagatggttcccactaagcccatggtggtggagaccttctctgagtatcctcctcttggtcgctttgctgtccgggacatgaggcaaacggtggctgttggagtcatcaagagcgtggagaagaaggacccaactggagccaaggtgaccaaggctgccgccaagaagaaatgaggtgtctgtctggctggttctgtgttttctcgatggatacctagttgaaacttaaaatatttcgtcattgctgttatcgacgtgagcaactaaactgtgctagcaatgtttgtctggtcgatttagtattgttattttcgttaaaaccagggtactattaagactcaatttctgttatttttgtatcgaacatcgggtgttggccatatgtggttatgagttttgttactaccct

SEQ ID NO: 835 - DNA, 1708 bp, Glycine max
ttaacaaaacttccttataaattaaatgcaaatttaagacatccctcctcagcagcaaaggaaatggactaaaaccctatggctgcttgtgaatttgaaaatctcagacttttaccatcaaaacaaaaaacagtactcatcaaaaacaaacagcaacgaaaatgttaccgccgatcaagaacccagttttgaaggctacggctacatgaaatcggcggacacttcaaaatataactggtaaaacaaacacctaagactctgcaaagataaactactgtaaaggaacaagtttttttgaaaccacgttgatgatcacatgtgctagcaaaattgccaaaatgcaatcacttcttcttggcggcagcctttgtgaccttggctccggtggggtctttcttctcaacactcttgatgactccaacagctacggtctgacgcatgtccctcacagcaaaacgaccaaggggaggatactcagagaaagtttcaaccaccatgggcttggttggaaccatcttaaccataccagcatcaccattcttcaaaaatttgggctccttctcaagctccttaccagatcgcctgtcaatcttggtcaagatttcagaaaacttcacagcaatgtgagaagtgtggcagtcaaggactggtgcgtatccattaccaatctggccaggatggttcatgataatgacttgggatgtgaagttggcagcttccttggcagggtcgtccttggagttggatgcaacaaaaccacgcttgagatccttgactgcaacattcttcacattaaatccaacattgtcacctggaagagcctctgtgagagcctcatggtgcatctcaacagacttaacctcagttgtcagcccagtgggaccaaaagtcaccaccataccaggcttcacaaccccagtctctacacgtcccactggcacagtaccaataccaccaatcttgtagacatcctgcaatggaagccttagaggcttgtcggagggcctcttgggctcattgatttggtcaagagcctcaaggagagttggtcccttgtaccagtcaaggttggtggacctctcaatcatgttgtcaccctcaaaaccagagatgggaacaaagggaatcttgtctgggttgtaaccaaccttcttcaagtaagaagagacttccttcacgatttcatcatacctagccttagagtacttgggggcttagatttataccttgttacagcaacagatcatctgcttcacacctagggtgaaagcaagaagagcatgctcacgggtctgtccatccttagaaataccagcttcaaaaccaccagtggtggagtcaataataaggacagcacagtcggcctgggaggtaccagtaatcatgttcttgataaagtcacgatgtccaggagcatcaatgaccgtgcagtagtacttggtggtttcaaacttccacaaagcaatatcaatggtaattcctctttcacgctcagctttgagcttgtcgagcacccaggcatacttgaatgacctcttgttcatctcggcagcctccttctcgaacctctcaatcacacgcttgtcaatacctccaagcttgtagatcaagtgaccagtggtagttgacttcccagagtcgacatgtccaatgacgacaatgttgatgtgaaccttttccttacccatgattacttaaactagaatca

SEQ ID NO: 836 - DNA, 1335 bp, Triticum aestivum
gagaagactcacatcaacatcctggtcactggccatgtcgactctggcaagtcgacaaccactggccatctgatctacaagcttggaggtattgacaagcgtgtgatcgagaggttcgagaaagaagccgccgagatgaacaagaggtctttcaagtacgcctgggtgcttgacaagctgaaggccgagcgtgagaggggtatcaccattgatattgccctgtggaagttcgagaccaccaagtatactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcacccttggagtgaagcagatgatctgctgctgcaacaagatggacgccaccactcccaagtactcaaaggcccgttacgaggaaattgtcaaggaagtctcttcgtacctgaagaaggtcggctacaaccctgacaaggttccctttgttcccatctctgggtttgagggcgacaacatgattgagaggtccaccaaccttgactggtacaagggccctaaccttcttgaggctcttgaccagatcaacgagaccaagaggccctcagacaagcccctgcgtcttccccttcaggacgtctacagtattgccggcattggaactgtgccagtggggcgtgttgagactggagtcatcaagccaggcatggttgtcacccttggtcctactggcctgaccactgaggtgaagtctgtggagatgcaccacgagtctctcctggaggcgcttcctggtgacaatgtcggcttcaacgtcaagaacgtggccgtcaaggatctcaagcgtggatacgtcgcttccaactccaaggacgaccctgccaaggaggctgccaacttcaccgcccaggtcatcatcatgaaccaccctggccagatcagcaacggctatgccccggtgctggactgccacacgtcccacattgctgtcaagttcgctgagatccagaccaagattgaccggcggtctggcaaggagattgaggcggcgcccaagttcctgaagaacggtgatgccgggttcgtcaagatgatccccaccaagcccatggtggtggaaacctttgcccagtaccctcccctgggccggtttgctgtgcgcgacatgaggcagacggttgccgtgggcgttatcaaggccgtggagaaaaaggatccgaccggcgccaaggtgaccaaggctgcggccaagaagaaatgag

SEQ ID NO: 837 - DNA, 2022 bp, Prunus mume
caggcattaggtctctcaaagcaaaccctaggtatttccccgactctctcagcctataaataagtcacgtagcgcctctcaaaccctgccttctctctcactgcctctgccgctctgcttgaacctagcgtttgagcttcagatctgtggtaaattttaatcgcttataatgggtaaagaaaagtttcacatcaacatcgtggtcattggccatgtcgactctggaaaatcgaccacaactggtcatcttatctacaagcttggaggtattgacaagcgtgtcattgagaggtttgagaaggaagctgctgagatgaacaaaaggtcattcaagtacgcctgggtgcttgacaagcttaaggctgagcgtgagcgtggtatcaccattgatattgccttgtggaagtttgagaccaccaagtactactgcacagtcattgatgccccaggacatcgtgactttatcaagaacatgattactggaacctcacaggctgactgtgctgttctcatcatcgattccaccactggtggttttgaagctggtatctccaaggatggccagacccgtgagcatgctcttcttgctttcacccttggtgtgaagcagatgatttgctgctgtaacaagatggatgccactactcccaagtactccaaggcaaggtacgatgaaatcgtgaaggaagtctcatcctatctgaagaaggttgggtacaacccagacaaaattgcctttgttcccatctctgggttcgagggcgacaacatgattgagaggtccaccaaccttgactggtacaagggaccaacccttcttgaggctctggacttgatcaacgagcccaagaggccctcagataagcccctccgtctaccacttcaggatgtttacaagattggtggcattggaactgtgccagtgggccgtgttgagaccggtattatcaagcctggtatggttgtcacttttggaccaactgggctcaccactgaagttaagtctgttgagatgcatcatgaggcccttcaggaggcactgcctggtgacaatgtcggattcaatgttaagaatgttgctgtgaaggatctcaagcgtggtttcgttgcatctaactccaaggatgatcctgccagggaggctgccaacttcacatctcaggtcatcatcatgaaccaccctggtcagattggtaacggatatgctccagttcttgattgccacacttcccacattgctgtgaagttcggtgagatcctcaccaagattgacaggaggtctggtaaggagattgagaaggagcccaaatttttgaagaatggagatgcaggtatggtgaagatgcttcccaccaagcccatggttgtggagactttctctgagtaccctccattgggtcgttttgctgtccgtgacatgcgtcagaccgttgctgttggtgttatcaagagcgtggagaagaaggatcccagtggtgccaaggtcaccaagtctgctgccaagaagaagtgaagaataatggcgcagtatcaaaatttcaatgatgcaaacttatgcattgcttttaaagactcatatttaagttgtgtgtttttaaattgtttagccagtttagtctgtagttcttttgcttctgctagttctctgtgctccatctccggcgtatgctctcagaactgggtgctggacaggcggtggtgacacattgctggtttatgtttgagtcaattccgcctttttaaggaggatgttgagagttgagactgtttaattttcaagttttgttgcgtctgttgaatggataattttttcaaccttatatatttggctttggagtatttttaattcttggtttgatggatccaatactgccgagtcatttgagttttgattatttcttgagatgatgttgtatacatccttgagtggatgtcttgtggcctttattgaagcaggttcattaatactcggtggtatttgaattgggatgctccaaattggagcctccaattggattctgg

SEQ ID NO: 838 - DNA, 1484 bp, Amorphophallus konjac
cggccggggctctccattcagtttcggcgttcgcccttcaccggtgttcttgcgcagagaaggcttcttctcctcccccacgccgcctcttctcaagcttccaatcgcacgtcagcatgggtaaggaaaaggtgcacatcaacattgtcgtcattggacatgtcgactccggcaagtctaccaccacaggccatcttatctacaagcttggtggtattgacaagcgtgtcattgagaggttcgagaaagaggctgctgagatgaacaaaaggtcattcaagtatgcctgggtccttgacaagctgaaggctgagcgtgagcgtggtatcactattgacattgctctctggaaatttgagaccaccaagtactactgtactgtcatcgatgctcctgggcatcgtgacttcatcaagaacatgatcacgggtacttctcaggctgactgtgccgtcctcatcattgactccaccaccggtggttttgaggccggtatctccaaggacggccagactcgggagcatgctttacttgccttcacacttggagtcaagcagatgatttgctgttgcaacaagatggatgcaactacccccaagtactccaaggccaggtatgatgaaattgttaaggaagtctcatcctacctgaagaaggtgggatacaacccagacaagattccttttgttcccatctctgggtttgaaggtgacaacatgatcgagaggtccaccaacctcgactggtacaagggacccacgctccttgacgctcttgacctgattcaggagcccaagaggcctactgacaagcccctccgcctccctcttcaggatgtctataagattggtggtattggtaccgtgcccgtcgggcgggttgagaccggcatcctgaagcctggtatggtggtctgcttcggccccaccggcctgaccactgaagtgaagtctgttgagatgcaccacgaggcccttgtggaagctctccctggtgacaacgtgggcttcaacgtgaagaacgtcgccgtgaaggacctgaagcgtggattcgttgcctccaactccaaggatgacccggcgaaggaagccgccaacttcacttctcaggtcatcatcatgaaccacccggggcagatcggcaacggatacgcgcccgtgctcgactgtcacacctcccacatcgccgtcaagtttgcggagatcctcaccaagattgacaggcgttctgggaaagagctggagaaggagcccaagttcctgaagaacggcgatgccggtttcgtgaagatgattcccaccaagcccatggtggtggagacgttctccgagtatcctcccctcggccgtttcgccgtgagggacatgcggcagactgtggccgtcggtgtcatcaagagcgtcgacaagaaggacccaactggtgccaaggtcaccaagtctgctgccaagaagaagtgagagagagagagagcaggtgtgtgt

SEQ ID NO: 839 - DNA, 1773 bp, Amorphophallus konjac
accggtgttcttgcgcagagaaggcttcttctcctcccccacgccgcctcttctcaagcttccaatcgcacgtcagcatgggtaaggaaaaggtgcacatcaacattgtcgtcattggacatgtcgactccggcaagtctaccaccacaggccatcttatctacaagcttggtggtattgacaagcgtgtcattgagaggttcgagaaagaggctgctgagatgaacaaaaggtcattcaagtatgcctgggtccttgacaagctgaaggctgagcgtgagcgtggtatcactattgacattgctctctggaaatttgagaccaccaagtactactgtactgtcatcgatgctcctgggcatcgtgacttcatcaagaacatgatcacgggtacttctcaggccgactgtgccgtcctcatcattgactccaccaccggtggttttgaggccggtatctccaaggacggccagactcgggagcatgctttgcttgccttcacactcggagtcaagcagatgatttgctgttgcaacaagatggatgcaactacccccaagtactccaaggccaggtatgatgaaattgttaaggaagtctcatcctacctgaagaaggtgggatacaacccagacaagattccttttgttcccatctctgggtttgaaggtgacaacatgatcgagaggtccaccaacctcgactggtacaagggacccacgctccttgacgctcttgacctgattcaggagcccaagaggcctactgacaagcccctccgcctccctcttcaggatgtctataagattggtggtattggtaccgtgcccgtcgggcgggttgagaccggcatcctgaagcctggtatggtggtctgtttcggccccaccggcctgaccactgaagtgaagtctgttgagatgcaccacgaggcccttgtggaagctctccctggtgacaacgtgggcttcaacgtgaagaacgtcgccgtgaaggacctgaagcgtggattcgttgcctccaactccaaggatgacccggcgaaggaagccgccaacttcacttctcaggtcatcatcatgaaccacccggggcagatcggcaacggatacgcgcccgtgctcgactgtcacacctcccacatcgccgtcaagtttgcggagatcctcaccaagattgacaggcgttctgggaaagagctggagaaggagcccaagttcctgaagaacggcgatgccggtttcgtgaagatgattcccaccaagcccatggtggtggagacgttctccgagtatcctcccctcggccgtttcgccgtgagggacatgcggcagactgtggccgtcggtgtcatcaagagcgtcgacaagaaggacccaactggtgccaaggtcaccaagtctgctgccaagaagaagtgagagagagagagcaggtgtgtgttagtggttacgtggtcggtatggtctttcgtttttcttccttttttttcttttaattatcgggggcagccttcatcagccattttctctgccctccataacgagtagaatggtgtttgacaggcggcttttagtagtgtttcttcgtcatcgcatgcatttctctgtctggaccctcaaaatattttctgttcctctttttttcttgctttaagattttggatggttgaaacttgttataatagttcagttttgcattacaagtctcatggctctctctattgttgcgtgaccaatttgttttgtggataaccagttgtgacagcggttt

SEQ ID NO: 840 - DNA, 1782 bp, Amorphophallus konjac
ggtgttctttcgcagagaaggcttcttctcctaccccacgccgcctcttctcaagcttccaatcgcacgtcagcatgggtaaggaaaaggtgcacatcaacattgtcgtcattggacatgtcgactccggcaagtctaccaccacaggccatcttatctacaagcttggtggtattgacaagcgtgtcattgagaggttcgagaaagaggctgctgagatgaacaaaaggtcattcaagtatgcctgggtccttgacaagctgaaggctgagcgtgagcgtggtatcactattgacattgctctctggaaatttgagaccaccaagtactactgtactgtcatcgatgctcctgggcatcgtgacttcatcaagaacatgatcacgggtacttctcaggctgactgtgccgtcctcatcattgactccaccaccggtggttttgaggccggtatctccaaggacggccagactcgggagcatgctttacttgccttcacacttggagtcaagcagatgatttgctgttgcaacaagatggatgcaactacccccaagtactccaaggccaggtatgatgaaattgttaaggaagtctcatcctacctgaagaaggtgggatacaacccagacaagattccttttgttcccatctctgggtttgaaggtgacaacatgatcgagaggtccaccaacctcgactggtacaagggacccacgctccttgacgctcttgacctgattcaggagcccaagaggcctactgacaagcccctccgcctccctcttcaggatgtctataagattggtggtattggtaccgtgcccgtcgggcgggttgagaccggcatcctgaagcctggtatggtggtctgcttcggccccaccggcctgaccactgaagtgaagtctgttgagatgcaccacgaggcccttgtggaagctctccctggtgacaacgtgggcttcaacgtgaagaacgtcgccgtgaaggacctgaagcgtggattcgttgcctccaactccaaggatgacccggcgaaggaagccgccaacttcacttctcaggtcatcatcatgaaccacccggggcagatcggcaacggatacgcgcccgtgctcgactgtcacacctcccacatcgccgtcaagtttgcggagatcctcaccaagattgacaggcgttctgggaaagagctggagaaggagcccaagttcctgaagaacggcgatgccggtttcgtgaagatgattcccaccaagcccatggtggtggagacgttctccgagtatcctcccctcggccgtttcgccgtgagggacatgcggcagactgtggccgtcggtgtcatcaagagcgtcgacaagaaggacccaactggtgccaaggtcaccaagtctgctgccaagaagaagtgagagagagagagagcaggtgtgtgttagtggttacgtggtcggtatgctctttcgtttttcttccttttttttcttttaattatcgggggcagccttcatcagccattttctctgccctccataacgagtagaatggtgtttgacaggcggcttttagtagtgtttcttcgtcatcgcatgcatttctctgtctggaccctcaaaatattttctgtttctctttttttattgcattaagattttggatggttgaaacttgttataatagttcagttttgcattacaagtctcatggctctctctatttgttgcgtgaccaatttgttttggtggataaccagttgtgacagcggtttgtactggg

SEQ ID NO: 841 - DNA, 1841 bp, Amsonia hubrichtii
cgcagcctctcgtttgctctatttcccaagttttctatctgttcagcatgggtaaggaaaaggttcacattaacattgtggttattggacatgtcgactctggcaagtcgaccaccactggtcacttgatctacaagcttggtggtattgataagcgtgtgattgaaaggtttgagaaggaggctgctgagatgaacaagaggtcattcaagtacgcctgggtgcttgacaagctcaaggctgagcgtgagcgtggtattaccattgatattgccctgtggaagttcgaaacaaccaagtactactgcactgtcattgatgcccctggacatcgtgactttatcaagaacatgattactggtacctcacaggctgactgtgccgtcctcatcattgactccaccactggtggttttgaagctggcatctccaaggatggtcagacccgtgagcatgccttgcttgcttttacgcttggtgtgaagcaaatgatttgctgctgtaacaagatggatgccaccacccccaagtactccaaggctaggtacgatgaaattgtgaaggaagtctcatcatacctcaagaaggtcggatacaaccctgacaaaatccccttcgtccccatctctggttttgagggagacaacatgattgagagatccaccaacctcgactggtacaagggcccaaccctccttgaggctcttgaccagatctctgagcccaagagaccctcagacaagccactccgtctcccacttcaggatgtttacaagattggtggtattggaactgtccctgtgggtcgtgtagaaactggtgtcctcaagcccggtatggttgtgaccttcggtccaactggtctgacaactgaagttaagtcagttgagatgcaccacgaagcccttcaggaggctcttcccggtgacaacgttgggttcaacgtgaagaacgttgctgttaaggatctgaaacgtggttttgttgcatccaactccaaggatgacccagccaagggagctgccaacttcaccgcacaggtcatcatcatgaaccaccctggccagattggaaatggatatgccccagtgctggactgccacacctctcacattgccgtgaagtttgctgagattttgaccaagattgacagacgatctggtaaggagctggagaaggagcccaagttcttgaagaacggtgatgctggtatggttaagatgattcccaccaagcccatggttgtggagaccttctctgagtacccacctcttggtcgttttgctgtgagggacatgcgtcaaactgttgctgttggtgtgatcaagagtgttgacaagaaggacccaagtggtgccaaggtcaccaaggctgctgctaagaagggtgccaaatgaaccgtgctggttcgttctggtattacttctgatgaagtctattattacaataagtcttgtcatgaaaactgcatctttcttagaactgctattgtagtttggtctttgttctatctgttgtgtcgtaggtttctgccttgtaagttcagtatcctttctcagaattgggtacttgaccgccggtggcggatcctacaatatcatagtctttgatatgttttgtttcgagtctgtgcgtttgaggtgcttggtttttcctagcggctcaggagttttgttgtttgattacaatttattggagaacttattcagcgaattgccctccatttttttattatatttttttggtggttagctaggtccagattatttttagaacacaaggaatggattcgctgggttgtttttcttgtcaaaaaatgatttctgcattttcttattaaa

SEQ ID NO: 842 - DNA, 1642 bp, Aquilegia formosa
aaacagcagcagcagcagcgagagagagtggtgttagctttgattcttcgttcttctgtttgtacaagtgcagctatgggtaaagagaaggttcacattaacattgtagttattggtcatgttgattctgggaaatcaacaacaactggtcatttgatctacaagcttggtggtattgacaagcgtgtgatagaacgttttgaaaaggaagccgctgaaatgaacaagcgatccttcaagtatgcttgggtgcttgacaaacttaaggccgagcgtgaacgtggtatcactatagacattgccttgtggaagtttgagactaccaagtactactgcacagtcattgatgctcctggtcatcgtgactttattaagaacatgatcactggaacttctcaggctgactgtgctgtcttgatcattgactcaactactggtggatttgaagctggaatctccaaggatgggcagactcgtgagcatgcattgcttgcattcacactgggagtgaagcagatgatctgctgttgtaacaagatggatgccaccacaccaaagtactcgaaagctaggtatgatgaaattgtgaaggaagtctcttcatacttgaagaaagttggctacaaccctgacaagatcccctttgtcccaatttctggctttgagggtgacaatatgattgaaagatctaccaaccttgattggtacaagggcccaacccttcttgatgccttggataatgtttctgagcccaagcgtccctccgacaagccccttcgtcttcctctgcaggatgtttacaagattggtggtattggaactgtacctgttggtcgtgttgagactggagtcatcaagccaggaattctggttacttttggtccatctggtcttactactgaagtcaagtctgtggagatgcatcatgaggctcttacagaggctctgcctggtgacaatgttggctttaatgtgaagaatgttgctgttaaggatctgaagcgtggttatgttgcttctaattcaaaggatgaccctgctaaggaggctgctaacttcacctcgcaagttatcatcatgaatcacccaggccagattggtaatggatatgcacctgtccttgattgtcacacttctcacattgcagtaaagttcgcagagattacaaccaagattgataggcgttctggaaaagaacttgagaaagagcctaagtttttgaagaatggtgatgctggatatgttaagatgatccctacaaagccaatggtggtggagacattctctgagtatcctcctcttggtcgttttgctgttcgtgacatgaggcagactgttgctgttggtgttatcaaagctgtggagaagaaggagcccactggtgccaaggttacaaaggccgctgcaaaaaagaagtgaactgagagagattgtgcttcagtaacagttttaggtaatggccctataggcttttatttttgtcttatcaagtctgtaggttcagtgtctagtgtttggatggagaactgggttcttgaccggtggtggcatcagactcattgcttttttcaatgtttgttctgagtcctattttgtgttctaaactgagtttcagatattaagttttgtttttagttctctg

SEQ ID NO: 843 - DNA, 1626 bp, Aquilegia formosa
cacagagccgagcttaagcattctcgtcttcatctttattttgtttgtacttgaataggcagctatgggtaaagagaagtttcacattaacattgttgttattggtcatgttgactctgggaagtccacaacaactggacatctgatctataagcttggtggtattgacaagcgtgtgattgaacgttttgagaaggaagctgctgagatgaacaagcgatccttcaagtatgcctgggttcttgacaagcttaaggctgagcgtgaacgtggtatcaccattgatattgccttgtggaagtttgaaacaaccaagtactattgcactgttattgatgctcctggccatcgtgacttcatcaagaatatgatcactggaacatctcaggcagattgtgctgttttaatcattgactcaactactggtgggtttgaagctggaatttcaaaggatgggcagactcgtgagcatgcgttgcttgcttttactttgggagtgaagcaaatgatctgttgctgtaacaagatggatgccaccacacccaagtactcgaaggctaggtacgatgaaattgtgaaggaagtctcttcttacttgaagaaagttggctacaaccctgacaagatcccctttgtcccaatttctggctttgagggtgacaatatgattgaaagatctaccaaccttgattggtacaagggcccaacccttcttgaagccttggataatgtttcagagcccaagcgtccctccgacaagccccttcgtcttcctctgcaggatgtttacaagattggtggtattggaactgtacctgttggtcgtgttgagactggagtcatcaagccaggaattctagttacttttggtccatctggtctcactactgaagtcaagtctgtggagatgcatcatgaggctcttacagaggctctgcctggtgacaatgttggcttcaatgtgaagaatgttgctgtcaaggatcttaaacgtggttatgttgcttcaaactcaaaggaggaccctgctaaggaagctgctaacttcacctcacaagttatcatcatgaatcacccagggcagattggtaatgggtatgctcctgttctggattgtcacacttctcacattgcagtcaagtttgcagagatccttaccaagattgataggcgttctggaaaagaacttgagaaggagcccaagtttttgaagaatggtgatgctggtatggttaagatgattcctactaagccaatggttgtggagaccttttcagagtatcctccacttggtcgttttgctgttcgtgacatgaggcagactgttgctgttggtgtcatcaagtcagtggaaaagaaggagcccaccggtgccaaggtcaccaaggctgccgcaaagaagaagtgaaccgagatctattctgcttcagtagtagttagtaatggccctatagggttttgtttttttgttatcgagtctgtgtgtgaactttcaagtgtttggatggaaaactgggtacttgacaggcggtggcacctgttttagtgtccttttgttttgcagtagagtgttgatccaaactaagtattttcatataataaattatgtctttgttatactgctct

SEQ ID NO: 844 - DNA, 1773 bp, Musa acuminata
atgaccccgagtgacgtgcagcaccagaacacttctctcggccgtctctctccgctctctcgtgggagcaaccctctagtttcttttgctttaagttactgttaccatggggaaggagaaggttcacattaacattgtggtcattggtcatgtcgactctgggaagtcgaccaccactggtcatctcatctacaagttgggaggtattgacaagcgtgtgatcgagaggtttgaaaaggaggctgcagaaatgaacaagaggtcgttcaagtatgcctgggttcttgacaagcttaaggctgagcgtgagagagggattaccattgatattgccctttggaagtttgagaccaccaagtactactgcacggtcattgatgctcctggacatcgtgacttcatcaagaatatgatcactggaacctcccaggcggactgtgctgttcttatcattgactcaaccactggtggttttgaagctggtatctcaaaggatggacagacacgggagcatgccttgcttgcttttactcttggagttaaacagatgatttgctgttgcaacaagatggatgcaaccacccccaaatattccaaggccaggtatgatgaaattgtgaaggaggtttcttcttacctcaagaaggtcggttacaaccctgagaagattccctttgttccaatctctggatttgagggtgacaacatgatcgagaggtctaccaacctggactggtacaagggcccaactcttcttgaagcccttgacttgatccaggagccaaagaggcccacggacaagccccttcgccttcctcttcaggatgtgtacaagattggaggcattggtactgttcctgttggacgggtcgagaccggagtactcaagcctggtatggttgttacatttggtccgacaggtctgacaactgaagtaaagtccgtcgagatgcaccatgaagcactccaggaagctttccctggtgataatgtgggctttaacgtgaagaatgttgctgttaaggatctaaagagaggttttgttgcatctaattccaaggaagatcccacaaaagaggctgctagcttcacttctcaggtcatcatcatgaaccatcctggccagattggcaatggttatgcccctgtgctcgactgccacacatcccacattgccgtcaagttcgccgagctgctcaccaagattgataggcgatctggaaaggagctcgagaaggagcctaagttcctcaaaaatggtgatgctggcttcgttaaaatgattcctaccaagccaatggttgtggaaacattctcagagtatcctcccctcggacgttttgctgtgagggacatgcggcagaccgtggctgtaggagtcatcaagagtgtcgagaagaaggatcctaccggtgctaagatcaccaaggctgctgccaagaagaagtgagcaaatctgcagcaacttgagaccttagtggtatttatccgatgtgctataggttttgggtgcttaatggttgtggaactcatggaagggtttttactggtggcttcaaatgagtccgaactatgctttttgctgcctgggaagatttttaggctttctacttctgggctgagcggttctgatacctatatttctttgcctttaaataatgttatgacattatgttttcagtaagaattgcctgcttttaaatctgtttggtttttgttttgaagtgtttttatgttttctgtcttcctggaataccagaaaattgttttaaa

SEQ ID NO: 845 - DNA, 1594 bp, Ocimum basilicum
tctctcgattcatatctgaaggtttaatacttgaaacatgggtaaggaaaagactcacattagcattgtggtcattggccacgtcgactctggaaagtcgaccaccactgggcatttgatttacaagcttggtggtattgacaagcgtgtcattgagaggtttgagaaggaagctgctgagatgaacaagaggtccttcaagtatgcatgggtacttgacaagctcaaggctgagcgtgagcgtggtatcaccattgatattgcgttgtggaaattcgagaccaccaagtactactgcacggttattgatgctcccggccatcgtgatttcatcaagaacatgattactggaacttctcaggctgactgtgctgttcttatcattgattcaactactggtggttttgaggctggtatctcaaaggatggtcagacccgtgagcatgctctccttgctttcactcttggagtcaagcaaatgatctgctgctgtaacaagatggatgctaccactcccaagtactcaaaggccaggtatgatgaaattgtgaaggaagtctcttcctacatgaagaaggttggctacaaccctgagaagatcccatttgtgcctatctctggatttgagggtgataacatgattgagaggtcgaccaacctcgactggtacaagggcccaactctccttgaggctcttgacgggatcatggagccaaagaggccctcagacaagcccctccgtctcccacttcaggatgtgtacaagatcggtggtattggcactgtccccgtgggaagagtcgaaactggtatcatcaagcctggtatggttgtcactttcggcccaactggtctgaccactgaagtcaagtctgtcgagatgcaccacgaggccctccaagaagctctccccggtgacaatgtgggtttcaacgtcaagaacgttgctgtcaaggatctcaagcgtggatacgtggcctcaaactccaaggatgatcctgccaaggaagcagccaacttcacctcccaggtcatcatcatgaaccaccctggtcagatcggaaacggttacgccccagttctcgactgccacacttcccacattgctgtcaaatttgctgagctcctcaccaagatcgacaggcgttccggtaaggagcttgagaaggagcccaagttcttgaagaatggtgatgcaggtatgatcaagatgattccgaccaagcccatggtggtggagacgttctcagcctacccgcctctcggtaggttcgctgttagagacatgcgtcagacggtagccgtgggtgtgatcaagagcgtggagaagaaggatccgaccggagctaaggtgaccaaggctgcagccaagaagggggccaagtgaatagttggtcatgttgggcgtctattttattgctatcgcaaagactatttatgttttcaaacatttttgtttcgtatggtttgttttgtctgtgtcgtctccagttggtgcgattttgtctcgcagagctgggttcttgatagacggtggcgtttgttaatttgagactttgctttttttattatgaattatcgagttacaagtgtc

SEQ ID NO: 846 - DNA, 1653 bp, Vaccinium corymbosum
gtaagctagtggtattctaacgtctagagtggacattacgccgggcagctagggttctctccgcctccttcacgaagtgtcttcctgcgagcttgacttttgtggttgaaaatgggtaaggaaaagtttcatattaacattgttgtcattggccatgtcgactctggcaagtcgaccacaactgggcatctcatttacaagcttggaggtattgacaagcgtgtgattgagaggttcgagaaggaagctgctgaaatgaacaagaggtcattcaagtacgcatgggtgttggacaagctcaaggctgagcgtgaacgaggtatcaccattgatattgctctgtggaaatttgagaccaccaagtactactgcacggtcattgacgctcctggccatcgtgactttatcaagaacatgattactggaacgtcacaggctgactgtgctattctcatcattgattccaccactggtggttttgaagctggtatctctaaggatggccagacccgtgagcatgctcttcttgctttcacccttggtgtgaagcaaatgatttgctgctgtaacaagatggatgccaccactcccaagtactcaaaagcaaggtatgatgaaatcgtgaaggaagtgtcttcttacctgaagaaggtgggctacaaccctgaaaaaatcccctttgtcccaatctctgggtttgagggtgacaacatgattgagaggtcaaccaacctcgactggtacaagggccccaccctccttgaggccctcgacatgatctcagagcccaagaggccatcagacaagcccctccgccttccccttcaggacgtctacaagatcggtggcattggaactgtcccggtcgggcgggttgagactggtgttatcaagcccggaatggttgtcacctttgggcccacagggttgaccactgaagtcaagtccgtcgaaatgcaccacgaagctttgcaggaggccttacctggtgacaatgtagggttcaatgtgaagaatgttgctgtgaaggatctcaagcgtgggttcgttgcatcaaactctaaggatgatccagcaagagaggcagcaaatttcacgtctcaggttattatcatgaatcatccaggtcaaattggaaatgggtatgccccagttcttgactgccacacttgccacatcgctgtcaagtttgctgagatcttgaccaagattgatcgacgatctggcaaggagattgagaaggaacccaagttcttgaagaatggagatgccggtatggtgaagatgattccgaccaagcctatggttgtcgagacattctccgagtacccacctttgggaaggtttgctgttagggacatgcgccagacagttgctgttggagttatcaagagtgtggagaagaaggatccatcaggtgctaaggtcacaaagtctgctgccaagaagaagtgaagcatggagtctggttggagtaaagtcaattgctatcacagaaaagacctggtttttgctgtttctattctaagttatttagttgatctagtttgtttcttttttcgtggcagttttttgtcgtcgcttcttggttgttgctcccgtaattgggtgctggaccggcggtggcgacaatgaagtttatgcttggaattc

SEQ ID NO: 847 - DNA, 1780 bp, Vaccinium corymbosum
ctcttcgtgcggccagggtgtcaccggagtctctctctacctctctcactgcgtatattctttctgctccgcttttcgtgctaagagttcagcatgggaaaagagaaatttcacatcaacattgtggttattggccatgtcgactctggaaagtccaccaccactggtcacctcatctacaagcttggaggcattgacaagcgtgttatcgagaggtttgagaaggaggctgctgagatgaacaagcggtcattcaagtatgcctgggtgttggacaagctcaaggctgagcgtgaacgtggtatcaccattgacattgctctgtggaagttcgagaccacaaagtactactgcactgtcatcgatgctcctggacatcgtgatttcatcaagaacatgatcactggcacttcccaggctgactgtgcagtcctcattattgattccaccactggtggttttgaagctggtatatccaaggatggtcagacccgagagcatgctttgcttgctttcactcttggtgtcaggcaaatgatctgctgctgcaacaagatggatgccacaacccctaaatattccaaggcaaggtatgatgaaattgtgaaggaagtttcttcctacctgaagaaggttggatacaatcctgagaagatcccctttgtccccatctctggttttgaaggagacaacatgattgaaaggtctacaaatctcgactggtacaagggcccgaccctcctggaggctcttgacatgatttcagaacccaagaggccctcagacaagccactccgcctcccacttcaggacgtctacaagattggtggcattggaactgtcccagtgggtcgtgtcgagactggtgttatcaagcccggtatggttgtcacctttgggccgactggactgacaactgaagtcaagtctgtggagatgcaccacgaggctcttccggaggcccttccaggtgataacgtgggattcaacgtgaagaatgttgctgtgaaggatctcaagcgtggatatgtggcttccaactcaaaagatgatcctgccaaggaggctgcaaatttctcatctcaggtcatcataatgaaccaccctgggcagattggaaacggttatgctcctgtgcttgactgccacacatcccacatcgcggtcaagtttgctgagctgttgaccaagattgacaggcgatccgggaaggagcttgagaaggagcccaagttcttgaaaaacggtgactctggtatggtgaagatgatccctaccaaacctatggtggtggagaccttctctgagtacccacctctggggcgttttgcagtgagggacatgaggcagacagtggcagtgggtgttatcaagagtgttgagaagaaggatcctactggagctaaagtcaccaaggctgcagccaagaagggtgtgaagtgaaccgtccgggtttggtttactgcaggtggagtcaactattataagaataaagggtggggtttgatcaccttatttgtcagttctagcattgtgggttggtcgtcgtgttttgtactttgtagctttctgccttgtttgtcatgcagccgttcccagaactgggtgcttgacaggcggtggcagatcctatagcatgagagtcggtcctatgtggtttatgtttgcattgtgtagtgtgtttggcttgagatccgttggtgtttccaatgtgtctcaaagagttttgtgaagtcatgtctaaggatgatattcgtataattggatttctggttttggc

SEQ ID NO: 848 - DNA, 1802 bp, Vaccinium corymbosum
acactctcactcctcatttgcttgttttcgcggctagggtttttgcgcggtatatctctctcttcgccgattcatctggttcagcagtttctttttaaagtcagaatgggtaaggagaagtttcacatcaacattgtggttattggccatgtcgactctggcaagtcaaccacaactggtcacctcatctacaagcttggaggtattgacaagcgtgttattgagaggtttgagaaggaggctgctgagatgaacaagaggtcattcaagtatgcctgggtgttggacaaactgaaggctgagcgtgaacgtggtatcaccattgatattgccttgtggaagtttgagaccaccaagtactactgcactgtgatcgatgctcctgggcatcgcgacttcatcaagaacatgattactggtacctcccaggctgactgtgctgtcctcatcattgactccaccactggtggttttgaagctggtatctcaaaggatggtcaaacccgtgagcatgctttgcttgctttcacactcggtgtgaagcaaatgatctgctgttgtaacaagatggatgcaacaacaccaaagtactccaaggcaaggtacgatgaaattgtgaaggaagtctcttcttatttgaagaaggttggttataacccagagaagatcccattcgtccccatctctggattcgaaggagacaacatgattgagaggtccacaaaccttgactggtacaagggccccaccctccttgaggctcttgacatgatctcagaacccaagaggccctcagacaagcccctccgcctcccattgcaggacgtctacaagattggtgggattggaactgtcccagtgggcagggttgagaccggtgttatcaaacccggtatggtcgtgaccttcggtcccactggactgacaactgaagtcaagtctgtggagatgcaccatgaggctcttccggaggccttaccaggtgacaatgttgggttcaacgtgaagaacgttgctgtcaaggatctgaagcgtgggtttgtcgcttccaactccaaggatgatcctgccaaggaggcttccaacttcacctctcaggtcatcatcatgaaccacccaggccagatcggaaatggatatgccccagttctcgactgtcacacctctcatatcgctgtcaagtttgctgagatattgaccaagattgataggcgatccgggaaggagattgagaaggagcccaagttcttgaaaaatggtgatgcaggtatggttaagatgattcccaccaaacctatggtggtggagactttctctgagtacccgcctcttgggcgttttgctgtgagggacatgaggcaaacggtggctgtgggtgtgatcaagagcgtcgagaagaaggatccgtctggagccaaggttaccaaggctgcagcgaagaagggtgccaagtgaaccgtgcaggttgtcggtatcgttgatgctgatggattattatgccatcggttgaataatttgtgtcgtaaaaacttggtattaggtatgagtgttgctgttatgagtcggttgttttgttttgtatggtgtaggtttctgtcttgtttgtttagtagctgttcgcagaattgggtgcttgacaagcggtggccgatcctatagcatagtatgagagtcttgttttcttttggttcatgttttaatcatgtgggtatggtttcagatgctgtcttgtgtaggcatctcccaagagttttgctgtgttgttgaggatacattacgtatcaatgcacttttggtttttc

SEQ ID NO: 849 - DNA, 2135 bp, Theobroma cacao
gtaaaccaccagaaatcgtctccttgtgtaaccctagctctgctgctttcctctctataaatatcacagcaaaaccctacactgcgcccagaaactatccatttttccgctctttaattttctttgttctttcggcgcctagggtttttggcgagctccatatcaagtgaatcagaatgggtaaggaaaaggttcacattagcatcgtggtcatcggccacgtcgattctggtaagtcgaccaccaccggtcacttgatctacaagctcggtggtatcgacaagcgtgtgattgagaggttcgagaaggaagctgctgagatgaacaagaggtcgttcaagtatgcttgggtgcttgacaagctcaaggccgagcgtgagcgtggtattaccatcgatatcgccttgtggaagttcgagaccaccaagtactactgcactgtgatcgatgctcctggacatcgtgactttatcaagaacatgatcactggtacctcacaggctgactgtgctgttttgattattgattccaccactggtggtttcgaggctggtatttccaaggacggtcagactcgtgagcacgctttgcttgcctttacccttggtgtcaagcaaatgatttgctgctgcaacaagatggatgccactacccctaagtactccaaggctcggtatgatgaaattgtgaaggaagtctcttcttacttgaagaaggtgggttacaaccccgataaaattccatttgttcctatttccggtttcgagggtgacaacatgattgaaaggtctacaaaccttgactggtacaagggccctactcttcttgaggctcttgatcagatcaatgagcccaagaggccctccgacaagcccctccgtctcccacttcaggacgtgtacaagattggtggtattggaactgtcccagttggtcgtgttgagactggtatcttgaagcctggtatggttgtgacctttggcccgtctggcctgaccactgaagttaagtctgttgagatgcatcatgaagctcttcaagaggctcttcccggtgacaatgttggcttcaatgtgaagaatgttgctgttaaggatctcaagcgtggttttgttgcttctaactccaaggatgatcctgccaaggaggctgccagcttcacttctcaggtcatcatcatgaaccaccctggccaaattggaaatggatatgccccagtccttgactgtcacacctcccacattgctgtcaagttcgctgagttgttgaccaagattgacaggcgatctggcaaggagcttgagaaggaacccaagtttttgaagaatggtgatgctggtatggtgaagatggttcccaccaagcccatggttgtggagacgttctctgagtacccaccattgggacgttttgctgtgagggacatgcggcagactgtggctgttggtgttattaagaatgttgagaagaaggatccaacaggtgccaaggtcaccaagtctgcagctaagaagggtggaaagtgaactgtgctggttaatcctcttgctgtttccgcagctgatgtactttatcttattaatagtttaagagtctttgttatttttagttatgatacggtttgtctctgctatagggtagtgtctttgtttgtcggtggctgttctcagaattgggtgctggacagacggtggcagctatagcgtggggagtgccttggtttcccaaggtagctcaaaatttttgtttatgtttttcattctgctgcggaatcattgtcagtcattgcattattttgatttttatttcagacgggcttttctatttagtcctagctacttcattctgttcaatcgcttccattatcagattatctatctagtatgagcccaaggttttctgtccccgtgtgactttgctttatgttcatttatcgtctactggcatttctcgggctgaatccaaggtgcattgtgtctcgagatgtgttctcttgatttggtttttaggaggaaatggatgggaagaacgctgtattctgttatgttactacttgcggtgggaaaatttatgctaacttgttacatgttagatgcagaattcgagaaaaaatttaataaaaaataattctgatt

SEQ ID NO: 850 - DNA, 2115 bp, Theobroma cacao
acccgcaccggaaactttaagtgaaccaaatctcattctcatttcaacgcgtccagttcactttcccaataaaaaaagtccgtttacatcactcgattcttcacgcacgtgtcaaacggagctaccccccagctaagtaactgaaggatacatctggcaaaacaaaatttgaagaagggtattttaggaaacatagtatggtggcaaaaactgattatataaaggaacgtgaggctcagtcgaaaccctatcacttactctctcttaatatagctttcttgcttagccgctagggttttagcgtcaaatctctcaccttttcaaagctccaggctaatactacaaaatgggtaaggaaaaggttcacattaacattgtggttattggccatgttgactctggaaagtcgaccaccaccggtcacttgatttacaagcttggaggtattgacaagcgtgtgattgagaggttcgagaaggaagctgctgaaatgaacaagaggtcatttaagtatgcctgggtgcttgacaagttgaaagctgagcgtgagcgtggtattaccattgatattgccttgtggaagttcgagaccaccaagtactactgcactgtcattgatgcccctggacatcgtgactttatcaagaacatgattactggtacctctcaggctgactgtgctgtccttatcattgactccaccactggaggttttgaagctggtatttctaaggatggacagacccgtgagcatgctctccttgccttcactcttggtgtgaggcaaatgatttgctgttgcaacaagatggatgccacaacccccaaatactcaaaggcaaggtatgatgaaattgtgaaggaagtttcttcatacttgaagaaggttggatacaaccctgacaagattccctttgtccccatttctggttttgagggtgacaacatgattgagaggtccaccaaccttgactggtacaagggtccaactcttcttgaggctcttgaccagattaatgagcccaagagaccctctgacaagcccctccgtctcccacttcaggatgtgtacaagattggaggtattggaactgtcccagtgggtcgtgttgaaaccggtatgctcaagcctggtatggttgttacattcggtccctccggattgaccactgaagttaagtctgttgagatgcaccacgaggctcttcaggaggctcttcctggtgacaatgttgggttcaatgtgaagaacgttgctgtcaaggatctcaagcgtggttttgttgcctcaaactcaaaggatgatcctgccaaggaggcagccaacttcacctcccaagtcatcatcatgaaccacccagggcagattggaaatggttatgcccctgttcttgattgccacacctcccacattgctgtaaagtttgctgagctcttgaccaagattgacaggcgttctggtaaggagcttgagaaggagcccaagttcttgaagaatggtgattctggtatggttaagatggttcccaccaagcctatggttgtggaaaccttctctgagtaccccccactggggcgatttgctgtgagggacatgagacagactgttgctgttggtgtcatcaagaatgtggagaagaaggacccaactggagccaaggtgaccaagtctgctgccaagaagggtggcaagtgaaccgtgcaggttttggctgattcagctaaagtctatcatggttcctacaataaagagttggttcttgttagtgggtccatcattgggcatttaattacttgttttgatggctatagttttaagttatcaccgtcatgtcgaggaaattgttcacagaactgggttcttgataggcggtggcgaggttttattgtctgagtccgtagtgtgtcttatttgctgttgtcttatgagttgaaaacattaaaaggtgtctgttttctgtgttgctattttgcaccataaccagctcaggagttttaggtctgttcctgagctccttgaatgttaatcaaacattttatatcatctaaacttgtgtgttttcctgttatgattttgccatcttttttttaccttattaaattgatgtagtgcag

SEQ ID NO: 851 - DNA, 1778 bp, Cedrus atlantica
gaagaaggagaggggctctgcaattctttgttcagtgagagggcgaagctgctttccgtcttgcattcttcgcgtttttgtttccaggaatacttgtttttagataactatgggtaaagaaaaggtccacatcaacatcgttgtcataggacatgtcgactctggcaagtctaccactaccggccatcttatttacaagcttggtggtattgataagcgtgtgatcgagcgttttgagaaggaagctgctgagatgaacaagagatctttcaaatatgcctgggtgctcgacaagcttaaggccgagcgtgaacgtggtattactattgatattgctctctggaagtttgagacgaccaggtactactgcacagttattgatgcacccggccatcgtgactttatcaagaacatgattacgggtacctcgcaggccgactgtgctgttttgattattgattctaccaccggaggttttgaagctggtatttctaaggatggacaaaccagagaacatgcccttttggccttcaccctcggagtgagacagatgatctgttgttgtaacaagatggatgctactacacccaagtactccaaggcccgttatgaggaaattgtaaaggaggtgtcatcatacctgaagaaggttgggtacaacccagataaaattccctttgttcccatctctgggtttgaaggagacaacatgattgagcgatccaccaacctggattggtacaagggtccaactctgttggaagcccttgatcaggtgtctgagcccaagagaccatctgacaaaccccttcgattaccactacaggatgtgtacaagatcggtggtattggcactgtgcccgtgggacgtgttgaaactggtattattaagcctggtatggttgtaacctttggtcctactgggttgacaactgaagtaaagtctgtggaaatgcatcatgaagctttgctagaggcattacccggtgacaatgttggctttaacgtgaagaacgttgcagtcaaggatctgaaacgtgggtttgttgcttccgactccaagaatgacccagcaaaggaagcagccaacttcaccgcccaggtgattatcatgaaccaccctggacagattggaaatggctacgctcctgttttggactgccacactagtcacattgctgtcaagtttgctgaaattatgaccaaggttgataggcgatctggtaaagaacttgagaaggagccgaaattcctcaagaatggggatgctgggtttatcaagatgattccctccaagcccatggttgtagagacattctccgattatcctccattaggtcgttttgctgtgagagacatgcgccaaacggtcgctgttggtgtcatcaaggctgttgagaaaaaggatcctactggtgccaaggttaccaaggctgcggccaagaagaaatgaaatttggtgctaccaagtacatattatgtgcagagggaagaggggcatggataccatactgctacgtggtgtggatgcttgtcatgttccgctgcacgagatttggtagttaggggtttgatagctcggcgtatgcaaacatgggttcttgacaggcggtggcagcatcatattcttaatgttatttattgttcttagttctagtaatttgggcgggtttagtataaacttggtgggtgagggtagagtactgcatctgattttccagaccattgcaaccgcattttaattgcggattatgtttgtgcgttgtttaaaacttttt

SEQ ID NO: 852 - DNA, 1553 bp, Cirsium arvense
ttgtttaagatgggtaaggaaaagattcatatcagcattgtcgtcatcggacatgtcgactccggcaagtctacaaccaccggtcacttgatctacaagcttggaggtattgacaagcgtgtgatcgaacgtttcgagaaggaagcagctgagatgaacaaaaggtcattcaagtacgcatgggtgcttgacaaacttaaggccgagcgtgaacgtggtattaccatcgatattgccttgtggaagtttgagaccaccaagtactactgcacagtcattgatgcccctggacatcgtgatttcatcaagaacatgattactggtacctcccaggctgattgtgctgtcctcattatcgactcgaccactggtggttttgaggccggtatttccaaggacggacagacccgtgagcacgctcttcttgctttcacccttggtgtcaagcagatgatctgttgttgtaacaagatggatgccaccacacccaagtactcaaagtcgaggtacgaggaaatcgtgaaggaagtttcttcatacttgaagaaggttggatacaaccctgacaaaatcccattcgtgccaatctctggtttcgagggagacaacatgattgagaggtccaccaacctcgactggtacaagggaccaacccttcttgatgctcttgaccagatcagcgagcccaagagaccatcagacaagcccctccgtcttccacttcaggatgtttacaagattggtggtattggaactgtgcctgtgggacgtgttgagactggtgtcatcaagcctggtatggttgttacctttggaccatctgggttgaccactgaagttaagtctgttgagatgcaccacgaagcccttctcgaggctctccccggtgacaatgttgggttcaacgtcaagaacgttgctgtcaaggatctcaagcgtgggtatgttgcatccaactccaaggatgaccccgccaagggtgctgccagtttcacctcgcaggttatcatcatgaaccacccagggcagatcggaaacggttatgcaccggttctggattgccacacctcccacattgccgttaagttccaggagctagtgaccaagatcgacagacgatctggaaaggagattgagaaggagcccaagttcttgaagaacggagatgcgggtatggttaagatgattcccaccaagcccatggttgtcgagacttttgccgagtacccaccccttggaaggtttgccgttagggacatgcgtcagacggttgctgttggagtcatcaagagcgtcgacaagaaggatcccacaggagctaaggtgaccaaggccgccgtgaagaagggagccaagtgatctgtttgattgtgttttggttatggtgtctttatcttttatgtcgtttcatttactagttttgaagaactttacattttgttgaagagttttggtattgcagacttttgttgtgggttaaaatttatagtggtctaccgcaatgagtttgttgttggagtcggtaaacaatttctatatctgttatccaacag

SEQ ID NO: 853 - DNA, 1411 bp, Cirsium arvense
atgggtaaggaaaagattcatatcagcattgtcgtcattggacatgtcgactccggcaagtctacaaccaccggtcacttgatctacaagcttggaggtattgacaagcgtgtgatcgaacgtttcgagaaggaagcagctgagatgaacaaaaggtcattcaagtacgcatgggttcttgacaaacttaaggccgagcgtgaacgtggtattaccatcgatattgccttgtggaagtttgagaccaccaagtactactgcacagtcatcgatgcccccggacatcgtgatttcatcaagaacatgattactggtacctcccaggctgattgtgctgtcctcattatcgactcgaccactggtggttttgaggccggtatttccaaggacggacagacccgtgagcacgctcttcttgctttcacccttggtgtcaagcagatgatctgttgttgtaacaagatggatgccaccacacccaagtactcaaagtcgaggtacgaggaaatcgtgaaggaagtttcttcatacttgaagaaggttggatacaaccctgacaaaatcccattcgtgccaatctctggtttcgagggagacaacatgattgagaggtccaccaacctcgactggtacaagggaccaacacttcttgatgctcttgaccagatcagcgagcccaagagaccatcagacaagcccctccgtcttccacttcaggatgtttacaagattggtggtattggaactgtgcctgtgggacgtgttgagactggtgtcatcaagcctggtatggttgttacctttggaccatctgggttgaccactgaagttaagtctgttgagatgcaccacgaagctcttcttgaggctcttcctggtgacaatgttgggttcaacgtcaagaacgttgctgtcaaggatctcaagcgtgggtatgttgcatccaactccaaggatgaccccgccaagggcgctgccagtttcacctcgcaggttatcatcatgaaccacccagggcagatcggaaacggttatgcaccagttctggattgccacacctcccacattgccgtcaagttccaggagctagtgaccaagatcgacagacgatctggaaaggagattgagaaggagcccaagttcttgaagaacggagatgccggtatggttaagatgattcccaccaagcccatggttgtcgagacttttgccgagtacccaccccttggaaggtttgccgtgagggacatgcgtcagacggttgctgttggagttatcaagagcgttgacaagaaggatcctaccggagctaaggtgaccaaggccgccgtgaagaagggagccaagtgatctgtttgattgtgttttggttatggtgtctttatcttttatgtcgtttcatttactagtt

SEQ ID NO: 854 - DNA, 1900 bp, Citrus clementina
atcagctctctctgttctgtccagtctctttctatcgcttgcggctagggttttagcagagctctttcagttttaagcaaatactttatcatgggcaaggagaagtttcatatcaatattgtggttattggccatgtcgactctgggaagtcaaccaccaccggtcacttgatctacaagcttggaggtattgacaagcgtgtgattgagcggtttgagaaggaagctgctgagatgaacaagagatcattcaagtacgcatgggtgcttgacaagctcaaggctgagcgtgagcgtggtatcaccattgatattgctttgtggaagttcgagaccacgaagtactactgcactgtcattgatgcccctggacatcgtgactttattaagaacatgattaccggtacttctcaggctgattgtgctgtccttatcatcgactccaccactggtggttttgaagctggtatctctaaggatgggcagaccagagagcacgctctacttgctttcacccttggtgtgaagcaaatgatttgttgctgtaacaagatggatgccaccactcccaagtattcaaaggcaagatatgatgaaattgttaaggaagtctcttcctacttgaagaaggttggctacaacccagataagattccatttgtcccaatctctggatttgagggtgataacatgattgagaggtccacgaaccttgactggtacaagggcccaacccttcttgaagctcttgaccagatcaatgaacccaagagaccaacagacaagcctctccgtctcccccttcaggatgtctacaagattggtggtattggaactgtccctgttggccgtgttgaaactggtgtactcaagcccggtatggtagtcacattcggtccgtctggattgactacggaagttaagtcggttgagatgcaccatgagtctctccaggaggcacttcctggtgataatgtggggttcaacgttaagaatgtttcagtgaaggatcttaagcgtggttacgttgcatctaactccaaggacgatcccgccaagggggcatccaacttcacctcccaagttatcatcatgaaccaccctggccagattggaaacggttatgcacctgttcttgattgccacacttcccacatagctgtcaagtttgctgaaatcttgaccaagattgacaggcgatctggtaaggagctggagaaggagcccaaattcttaaagaatggtgatgctgggtttgttaagatgattcccaccaagcctatggttgtggaaactttctccgaatatcccccacttggtcgttttgctgtgagagacatgcgccagaccgtcgctgttggagtcatcaagagcgtggacaagaaggatccatctggagccaaggtaaccaagtctgctgtgaagaagaagtgaactgtgctggtatctttgtctgcaagtaatgtctataggcgtcatcacaataaagattgtgttctttttaggcataaatgtgttggatgtttgggtcgtcaatttgctggttataattacaattcgtcaccatcgacaagagacttttgttcacagaactgggttcttgatcggcggtggcgagattactgtattgagtctatttttgttgtccatgtcatgttcaaacttggatattttgtaagcagctcaggagttttaggtctctgctgagctccttaagatgttgtttgttgatgttttatgttctatctagtttgccattttcaaatatttttggcttctggagatcttttattcttttcttcatggttgcaagatacggtggtggactttacagccaactgcaataatcctttcaaatcactactagtcacagaccatttacagatgaaaatggttaata

SEQ ID NO: 855 - DNA, 1711 bp, Cleome gynandra
tcggggtaccttctcttccatcacaggctctagtcagatcctctctcctccggctagggttttagctttctcctatctcctcctcgcagttctgagcttaagaacgccgtcatgggtaaggaaaagactcacatcaacattgttgtcattgggcatgtcgactctggaaagtcgacaaccaccggtcacttgatctacaagcttggaggtattgacaagcgtgtcatcgagaggtttgagaaggaggctgctgagatgaacaagaggtcattcaagtatgcgtgggtgttggacaagctcaaggcagagcgcgagcgtggtatcaccatcgacattgccctgtggaagttcgagaccacaaaatactactgcactgtcattgatgcacctggacacagggacttcatcaagaacatgattacaggtacctcccaggctgactgtgctgttctcatcattgactctaccactggaggtttcgaggccggtatctccaaggatggtcaaacccgagagcatgcgttgcttgcattcacccttggagtcaagcagatgatctgctgttgtaacaagatggatgccacaactcccaagtactcaaaggcaaggtacgatgagatcgttaaggaagtttcatcctacttgaagaaagttggttacaaccctgataagatccctttcgtccccatttctggtttcgagggagacaatatgattgagaggtcaaccaaccttgactggtacaagggtccgaccctcctcgaggcccttgaccagattaatgagcccaagaggccgacagaaaagcctctccgtctacctcttcaggatgtctacaaaatcggtggtattggaactgttcctgtaggtcgtgttgagactggtatcctcaagcctggtatggttgtgacctttggcccctctggactgaccactgaggttaagtccgttgagatgcaccatgaagctctccaagaggccctcccaggtgacaacgttggtttcaatgtcaagaatgttgctgtcaaggatctcaagcgtggtttcgttgcttccaactccaaggatgaccctgccaaggaagctgccaatttcacatcccaggttatcattatgaaccaccctggtcagattggaaatggctatgccccagtccttgactgccacacctcccatatcgctgtcaagttttccgagatcctcaccaaaatcgacaggaggtctggtaaggagctggagaaagagcccaagttcctaaagaacggtgatgctgggtttgtgaagatgattccgaccaagcctatggtcgttgagaccttctctgagtacccaccgttgggacgtttcgctgtcagggacatgcggcagacagtggccgtgggtgtaatcaagagcgtggagaagaaggatccaagtggtgcaaaggtcacgaaggccgcagcaaagaagggggcaaagtgaagcgtgcagggatactacagctacagtaacaaaggtggaaataagggcggggtggttttgcccaggcgagtctggagtcagtcacgggtaatagggtatttgcgtcggtcatatgcacagaactgggttctggatcgacggtggcgtcttgattttggttgtgtttgaaggataaataaacaatttgaaaacctcttttgtggtgtttttcttaatctctgttactaattaatgcgtagttgcttcattg

SEQ ID NO: 856 - DNA, 1548 bp, Cleome spinosa
tttcgggggtcgctcttattcctttcgtcgccgcacttcttctgtcggattcttcctcgcagtttctttttgaggatcagctatgggtaaagagaaggttcacatcaacattgtggtcattggccatgtcgactctggaaagtcgaccaccactggtcacttgatctacaagcttggtggtattgacaagcgtgtcatcgagaggttcgagaaggaagctgctgagatgaacaagaggtccttcaaatatgcctgggtgctggacaagcttaaggccgagcgtgagcgtggtattaccattgacattgccctctggaaatttgagaccaccaagtattactgcaccgtcattgatgctcctggacaccgtgactttatcaagaacatgatcacggggacttcccaggctgactgtgctgtccttatcatcgattccaccactggtggttttgaggccggtatctccaaggatggtcagacccgtgagcacgctttgcttgcgttcaccctcggtgtcaaacaaatgatttgctgctgcaacaagatggatgctaccacccccaagtactccaaggctaggtatgatgaaattattaaggaagtagcttcctacctgaagaaggttggttacaaccctgacaagatcccgttcgttcccatctctggttttgagggtgacaacatgatcgagagatccaccaacctcgactggtacaagggacccaccctccttgaggctcttgaccagatcaatgagcccaagaggccatcagacaaacctctccgtctccctcttcaagatgtctacaagatcggtggtatcggaactgtccctgtgggtcgtgtcgagaccggtgtaatcaagcctggtatgttagtgacctttgctccctctggactaaccactgaggttaagtccgtcgagatgcaccacgaggctctcctggaggctctccctggtgacaatgtcggattcaacgtcaaaaatgtcgctgtcaaggatctcaagcgtggatatgtcgcatcaaactcgaaggacgacccggccaaggaagcagccagtttcacctcccaagtcatcatcatgaaccaccctggtcagattggaaacggttatgcaccggttctcgactgccacacctcccacattgccgtgaaatttgccgagctgttgaccaagattgacaggcgttcggggaaggagctggagaaagagccgaagtttttgaagaacggagatgccgggatggtgaagatggttccgacaaagccgatggtggtggagacattctcggagtatcctcctcttgggcggtttgcggtgagggacatgaggcagacggtggctgtgggagtcatcaagagtgtcgagaagaaggaccccaccggtgccaaggtgacaaaggccgctgccaagaagggtgccaaatgagactgatgatctctcgtctccttttattatttttggtttgctttccagttttaatggtttcaggtgttttgcgacttctgtgaacaatttacatttttattagttgcattttcgga

SEQ ID NO: 857 - DNA, 1469 bp, Cleome spinosa
atgggtaaggaaaaggttcacatcaacattgtggtcatcggccacgtcgactctggtaagtcgaccaccacgggtcacttgatctacaagttgggaggtatcgacaagcgtgtgatcgaaaggttcgagaaggaggctgctgagatgaacaaacggtccttcaagtatgcgtgggtgttggacaagctcaaggcagagcgtgagcgtggtatcaccatcgacattgccctctggaagtttgagaccaccaagtactactgcactgtcatcgatgcccctggccaccgtgactttatcaagaacatgatcacgggtacctcccaggctgactgtgccgtcctcatcatcgactccaccactggtggttttgaggccggtatctccaaggacggtcagacccgtgagcatgctttgcttgctttcacccttggtgtcaaacagatgatctgctgctgcaacaagatggatgccaccacccccaagtactcgaaggctaggtatgatgagatcgtgaaggaagtgtcctcctacctgaagaaggttggatacaacccagacaagatcccctttgttcccatctctgggttcgagggtgacaacatgatcgagaggtccaccaaccttgactggtacaagggtccgaccctactcgaggctcttgatcagatcaacgagcccaagaggccatcagacaagcccctccgtctcccgcttcaggatgtctacaagattggtggtattggaactgtccctgttggtcgtgttgagactggtgtcctcaagcctggtatgcttgtgacctttgctccctctggtttgaccactgaggtcaaatctgtcgagatgcaccatgaggctctccaggaggctctccccggtgacaatgtcgggttcaatgtgaagaatgttgctgtcaaggatctcaagcgtggtttcgttgcatccaactcaaaggatgacccggccaaggaagctgccagcttcacctctcaggtcatcatcatgaaccaccctggtcaaatcggtaacggatacgccccggttcttgactgccacacctcccacatcgctgtcaagtttgccgagatattgacaaagatcgacaggcgttccggtaaggagctcgagaaggagcctaagttcttgaagaacggtgatgctggtatggttaagatggttccgaccaagcccatggttgtcgagactttctccgagtacccgccgctcggacgatttgccgtcagggacatgaggcagaccgtcgccgtcggagttatcaagaatgttgagaagaaggacccgaccggagctaaggtaaccaaagctgcggccaagaagggtgccaagtgagtggcgatgtccgtttgaaggagtttttagcgttagtctctgtttgttgtgttaagtttttattgaaccttgacgatttcatggtttataatttgctcttccatttttggattaatgtt

SEQ ID NO: 858 - DNA, 1738 bp, Coffea canephora
tattgctcagcagcgagagagctctccatctgcatttgttttaagtgtcttttgaaagtttaggatgggtaaggaaaaggttcacattaacattgtcgtcattggacatgtcgactctggaaagtcaaccaccactggtcacttgatctacaagcttggaggtattgacaagcgtgtgattgaaaggttcgagaaggaggctgctgaaatgaacaagaggtcattcaagtatgcctgggtgctggacaaactcaaggctgagcgtgagcgtggtattaccattgatattgccttgtggaagtttgagaccaccaagtactactgcacggtcattgatgcccctggacatcgtgactttatcaagaacatgattactggtacctcacaggctgattgtgctgtgcttatcattgactctaccactggtggttttgaagctggtatttccaaggatggtcagacccgtgagcatgctttgcttgccttcacccttggtgtcaagcaaatgatttgctgctgcaacaagatggatgccaccactcctaagtattctaaggcaaggtatgatgaaattatcaaggaagtctcttcctacttgaagaaggttggatacaaccctgacaaaatcaacttcgtccccatttctggttttgagggagacaacatgatcgagaggtctacaaaccttgactggtacaagggcccaactctccttgaggctcttgaccagatccaagagcccaagagaccctcagacaagccactccgtctcccactccaggacgtctacaagattggtggtattggaactgttcctgttggtcgtgtggaaactggggtcctcaagcctggtatggtggttacttttggtccaacagggttgacaactgaagttaagtctgttgagatgcaccatgaagcccttcaggaggctctgcctggtgacaatgttgggttcaacgttaagaatgttgctgtcaaggatcttaagcgtggttttgttgcctccaactctaaggatgaccctgccaagggagcttccagctttacctctcaggttatcatcatgaaccaccctggccagataggaaatggatacgcaccagtgcttgactgccacacctctcacattgctgtcaagtttgctgaacttgtgaccaagattgacagacgatctggtaaggagcttgagaaggagcccaagtttttgaagaatggtgatgctggtatggttaagatgattcccaccaagcccatggttgtggagactttctctgagtatccacctcttggacgttttgctgtgagggacatgcgtcaaactgttgctgttggtgtgatcaagaacgttgacaagaaggatccaactggtgccaaggtcaccaaggctgcagccaagaagggagccaaatgaaatgtgtttatgagatttcgctctgatgaactagtttctgttatttgctttagttattttcgattttcttttcgacattctagcagttttgaatattggagagtggatttcatcacagttctctagccttgcttgtgaggatggtggagaaatcgagcaatctgggtgtgaacctggtttgcttgatgacagtggtggagtccatttcgaagctgtcaattgttttggtttctataggtttaaaacatatgatgatgagtttttactccttggtcggtaaacaatttaaagttcaacgtttcgtcattcttgtgccttgtgcta

SEQ ID NO: 859 - DNA, 1718 bp, Gossypium hirsutum
ataatgggtaaggagaaggttcacatcaacattgttgtcattggccatgttgactctgggaagtcaaccacaacgggtcacttgatctacaagcttggaggtattgacaagcgtgtgatcgagaggttcgagaaggaagctgctgagatgaacaaaaggtcattcaagtatgcctgggtgctcgacaagttgaaggctgagcgtgagcgcggtatcaccattgatattgccttgtggaagtttgagacaaccaagtactactgcactgtcattgatgctcctggacatcgcgacttcattaagaatatgattacgggtacttctcaagctgactgtgctgtccttatcattaactccacaactggaggttttgaagctggtatttccaaggatgggcagacccgtgagcatgctctccttgccttcactcttggtgtcaagcaaatgatttgctgctgcaacaagatggatgccacaacccccaagtactcaaaggcaaggtatgatgaaattgttaaggaagtttcttcctacctgaagaaggttggttacaaccctgagaagattccattcgtacccatctctggttttgagggtgacaacatgattgagaggtccaccaacctcgattggtacaagggtccaaccctccttgaggctcttgaccagatcaatgagcccaagagaccctctgacaagcccctccgtctcccacttcaggatgtctacaagatcggtggtattggaactgtcccggtgggtcgtgttgaaaccggtacccttaagcctggaatggttgttacattcggaccttctggattgaccactgaagttaagtctgttgagatgcatcatgaagctcttcaagaggctcttcctggtgacaatgttgggttcaacgtgaagaatgttgctgtcaaggatctcaagcgtggatttgttgcctccaactccaaggatgatcctgccaaggaggcagccaacttcacctcccaagttatcatcatgaaccacccagggcagattggaaatggctatgcaccggtcctagattgccacacctcccatattgctgtcaagtttgcagagctcttgaccaagattgacaggcgatctggtaaggagcttgagaaggagcctaagttcttgaagaatggtgatgctggtatgattaagatggttccgaccaagcccatggttgtcgaaaccttctccgcgtaccctccacttggacgttttgccgttagggacatgagacagactgttgctgttggtgtgatcaagagcgtggagaagaaggacccaactggagccaaggtgaccaagtctgctgccaagaagggcaagtgaacctcgggggaatttgttgattcaacaaaagtttatcatggttactacaataaaattttggttcatgttagtaggtccatcactggacttttggttacatgttttaatggttcaccgtcatctcctggatattgttcccagacctgggttcttgataggcggtggtgaggcttatctttggagtccatagtgtgtcatcattaatattattatgccttaatgagctataaacttgatgatattttttgttcccatttttccaccaaagtggtcctggagttttacctctcttcgtgggctgctttccttcactcaatgttctatctaaaccttttatattatccaagtctatagcctgcttctgtttt

SEQ ID NO: 860 - DNA, 1849 bp, Gossypium hirsutum
aaagataaagtaggcaaacctgagtacaaaatagaactagaggcttgctcgaaaaactatactctctgattatctctcttcttcgagccgctaggtcgtactgttttagcttcaagtctctcttttttgaaagttcctagttaatactgcataatgggtaaggagaaggttcacatcaacattgttgtcattggccatgttgactctggaaagtcaaccacaacaggtcacttgatctacaagcttggaggtattgacaagcgtgtgatcgagaggttcgagaaggaagctgctgagatgaacaaaaggtcattcaagtatgcctgggtgctcgacaaattgaaggctgagcgtgagcgtggtatcaccattgatattgccttgtggaagtttgagacgaccaagtactactgcactgtcattgatgctcctggacatcgcgactttattaagaatatgattacgggtacttctcaagctgactgtgctgtccttatcattgactccacaactggaggttttgaagctggtatttccaaggatgggcagacccgtgagcatgctctccttgccttcacccttggtgtcaaacaaatgatttgctgctgcaacaagatggatgccacaacccccaagtactcaaaggcaaggtatgatgaaattgttaaggaagtttcttcttacctgaagaaggttggctacaaccctgagaagattccattcgtccccatctctggttttgagggtgacaacatgattgagaggtccaccaacctcgattggtacaagggtccaaccctccttgaggctcttgaccagatcaatgagcccaagagaccctctgacaagcccctccgtctcccacttcaggatgtctacaagattggtggtattggaactgtcccagtgggtcgtgttgaaactggaatcctcaagcctggaatggttgttacattcggaccttctggattgaccactgaagttaagtctgttgagatgcatcatgaagctcttcaagaggctcttcctggtgacaatgttgggttcaatgtgaagaatgttgctgtcaaggatctcaagcgtggatatgttgcctccaactccaaggatgatcctgccaaggaggcagccaacttcacctcccaagttatcatcatgaaccacccaggacagattggaaatggctatgcaccggtcctcgattgccacacctcccatattgctgtcaagtttgcagagctcttgaccaagattgacaggcgatctggtaaggagcttgagaaggagcctaagttcttgaagaatggtgatgctggtatgattaagatggttccgaccaagcccatggttgtggaaactttctccgagtaccctccacttggacgttttgccgttagggacatgagacagactgttgctgttggtgtgatcaagagtgtggagaagaaggacccaactggagccaaggtgacgaagtctgctgccaagaagggcaagtgaacctcgggattttgttgattcgacaaaagtttatcatggttactccaatgaaattggttcatgttagtaggtccatcactggacgtttagttacatgttttaatgcttcaccgtcatctcttggatattgttcccagaactgggttcttgataggcggtggtgaggtttatatttggagtcaatagtgtgtcatcattaatattattatgcgttatcgagctataagctccttgatagtttttgttcccgtttttccaccaaagtggtcctggagctttaggtctgttcctgggctcctttccttcactcaatgttctatctacacgttttatattatccaactctaaa

SEQ ID NO: 861 - DNA, 1601 bp, Taraxacum officinale
tcggccggggatcttcattttcctccatctatcgagagagctagtctgcagataattcattaaggatgggtaaggaaaagattcacattagcattgtcgtcatcggacatgtcgactccggcaagtctacaaccaccggtcacttgatctacaagcttggaggtatcgacaagcgtgtgatcgagagattcgagaaggaagccgctgagatgaacaaacgttcattcaagtacgcatgggtgctcgacaaacttaaggccgagcgtgaacgtggtatcaccatcgatattgctctatggaagttcgaaaccaccaagtactactgcacagtcatcgatgcccccggacatcgtgatttcatcaagaacatgattactggtacttcccaggccgattgcgccgttctcatcatcgattccaccactggaggtttcgaagctggtatttccaaggatggacagacccgtgagcacgctcttctcgccttcacccttggtgtgaaacaaatgatctgctgttgtaacaagatggatgctaccacccccaaatactccaagtccaggtacgaggaaatcgtgaaggaagtctcttcatacttgaagaaggtcggatacaaccctgacaaaatccccttcgtcccaatctccggattcgaaggtgacaacatgattgagaggtcaaccaacctcgactggtacaagggaccaactctcctagacgctcttgaccagatcaacgagcccaagagaccatcagacaagccactccgtctaccccttcaggacgtctacaagatcggaggtattggaactgtgccagtcggacgtgttgaaaccggagtcatcaagccaggtatggtcgtcaccttcggtccctcagggttgacaactgaagtcaagtccgtcgagatgcaccacgaatcattgttagaagctcatcccggagacaatgtcggattcaacgtcaagaacgttgcagtcaaggatctcaagcgtggatacgtcgcttccaactccaaggacgaccctgctaaaggtgccgccagtttcgtctcccaggtcatcatcatgaaccaccctggacagatcggaaacggttatgctccagtcctcgattgccacacctcccacattgctgttaagttccaagagcttgtgaccaagatcgacagacgatctggaaaggagatcgagaaggagcccaagtttttgaagaacggagatgcaggtatggtgaagatgattccgaccaagccgatggtggtggagacgtttgctgagtaccccccacttggaaggtttgctgtgagggacatgcgtcagactgttgctgttggtgtgatcaagagcgtggacaagaaggacccaaccggagctaaggtgaccaaggctgcggtgaagaagggagctaagtgatatgataggttgtgtgttttggtaatcgagtctttttattttctgtctgtttggattactagttttggacaatcttatattttgttgaagagtttttggtattggatctgggaggctttcacaatgttggaagctttttagattataaagacttttgttgtgggttaaatctatagttgtttgctg

SEQ ID NO: 862 - DNA, 1327 bp, Eschscholzia californica
catgggtaaagagaagattcatatcagtattgtcgtcattggacatgtcgactctggaaagtcgaccaccactggtcacttgatctacaagttgggaggtattgacaagcgtgttatcgaaagattcgagaaggaggctgctgagatgaacaagaggtcattcaagtacgcatgggttcttgacaagcttaaggctgaacgtgagcgtggtattaccattgatattgccttgtggaagtttgagaccaccaagtactactgcactgttattgatgccccaggacatcgtgatttcatcaagaacatgattactggtacctctcaggctgattgtgccgtcctcatcattgactccaccactggagggtttgaagctggtatctctaaggatggacagacccgtgagcacgctcttcttgctttcacccttggtgtcaagcagatgatctgttgttgtaacaagatggatgctaccacccccaagtactcaaaggcaaggtacgaggaaatcgttaaggaagtctcatcttacttgaagaaggttggatacaacccagacaaaatcgcctttgttcccatctctgggtttgaaggtgacaacatgattgagagatccaccaaccttgactggtacaagggaccaacccttcttgaggcacttgaccagatcaatgagccaaagagaccctcagacaagccactccgtcttccacttcaggatgtttacaagattggtggtattggaactgtgccagtgggacgtgttgagactggagtcatcaagcccggtatggtcgtcacttttggccccactgggttgaccactgaggttaagtccgtggagatgcaccacgaggctctccaggaagcacttccaggtgacaatgttggattcaatgttaagaatgttgctgtcaaggatctcaagcgtggttttgttgcctccaactccaaggatgacccagccagggaagctgctaacttcacctcccaggtcatcatcatgaaccatcctggtcagatcggtaacggatacgccccagtccttgactgccacacctctcacattgccgtgaagttcggtgagatcctcaccaagatcgacagacgatcaggaaaggagcttgagaaggagcccaagtttttgaagaatggtgatgctggtatggttaagatgcttccaaccaagcccatggttgtggagacctttgctgagtacccacctctaggacgttttgccgtgagggacatgcgtcagactgttgctgtcggagtcatcaagagtgtcgagaagaaggacccatcaggtgccaaggtcactaagtct

SEQ ID NO: 863 - DNA, 1781 bp, Eucalyptus grandis
gattcgtctgcttcgtgtcgctgagagatcgtcaaacccttcggaatcgagcaatactaaaaggctatcatgggtaaagagaaggttcacatcaacatcgtggtcattggccatgtcgactctgggaagtcaactacaactggacacttgatctacaagcttggaggaattgacaagcgtgtgattgagaggtttgagaaggaagctgctgagatgaacaagagatcattcaaatacgcttgggtgcttgacaagctcaaggccgagcgtgagcgtggtatcaccatcgatattgccttgtggaagttcgagaccaccaagtactactgtactgtcattgatgctcctggacatcgtgactttattaagaacatgattacgggaacctcccaggctgactgtgctatcctcatcattgattccaccaccggtggttttgaggctggtatttccaaggatggccagacccgcgagcatgctcttctcgccttcactcttggtgtgaagcagatgatttgctgttgcaacaagatggatgccaccacacccaagtattccaagtcccgttttgatgaaatcgtgaaggaagtctcttcatacttgaagaaggtcgggtacaaccctgacaagattcccttcgtccccatctctggttttgagggtgacaacatgattgagaggtccaccaaccttgactggtacaagggccccaccctccttgaggctcttgaccagattctggagccaaagaggcctacagacaagcctctccgtctcccacttcaggatgtgtacaagattggtggtattggaactgtccccgttggtcgtgttgagaccggtgtcctcaagcctggtatggttgtcacttttggtccctctgggttgactactgaagttaagtccgtggagatgcaccatgaggctctccaggaggcccttcctggtgacaacgttgggtttaacgtgaagaatgttgctgtcaaggatctcaagcgtggcttcgttgcatccaactcaaaggatgatcccgccaaggaagcagccaacttcacctcccaagttatcatcatgaaccaccctgggcaaattggaaatggttatgcccctgttcttgattgccacacctcccacattgctgtcaagtttgccgagctgttgaccaagatcgacaggcgatcaggtaaggagcttgagaaggagcccaagttcttgaagaatggtgatgctgggatggtgaagatgattcccagcaagcccatggttgtcgagactttctctgagtatcctcctctcggtcgttttgctgtgagggacatgcgccagacggttgccgtcggtgtcatcaagagtgtcgagaagaaggatccttctggtgccaaggtcaccaaatcagccgccaagaagaaatgagagaagcttatatagcatgaagttttttagtgtctgtggagaaacctgggtgaaccgtttttatctgaactccttttccttttagtagatgttgtctttcttgcttttgtttttgtttttgcggctgcggacatctagtgtttgctactatctacaactaattccccttggaggaggtggttgagaatgtagcaagagctttgctcgtttttgttctgtgtagtttgttaagtcgatactgtttggtgatgcagtaaaaactttgtttcctattgccatggctgctttcttttgtctttttaacttttttaatctccgcctcattgatatgtcatctgcatttttgcaaggaaaggtagcgtgcgcaa

SEQ ID NO: 864 - DNA, 1842 bp, Euphorbia peplus
ctcttcctcttgttcttcttcgaagcttctcttccaaatttaatcatgggtaaggagaaggttcacattaacattgtggtcattggccatgtcgattctggcaagtcaacaaccaccggtcatctgatttacaagcttgggggcattgacaagcgtgtgattgagagatttgagaaggaagctgctgagatgaacaaacggtcattcaagtatgcttgggtgttggacaagctcaaggctgagcgtgagcgtggtattactatcgatattgctctctggaagtttgagaccaccaaatactactgcactgtcattgatgcccctggacatcgtgatttcatcaagaacatgatcactggtacatctcaggctgattgtgctgtactcattattgactccaccactggtggttttgaggctggtatttctaaggacggccaaacacgtgagcatgcattgcttgcatttacacttggtgtcaggcagatgatttgctgctgcaacaagatggatgctacgactcccaagtactccaaagccaggtacgacgaaattgtgaaggaagtgtcttcctatctgaagaaggttggttacaacccggacaaaatcccatttgttcccatctctggtttcgagggtgataacatgattgagaggtcaaccaaccttgattggtacaagggccctacccttctcgaggcacttgacaatgtcagcgaacccaagagaccctcagacaagcctctccgtctcccacttcaggacgtgtataagatcggaggaattggaactgttcctgttgggcgagtggagaccggtgttatcaaacctggtatggttgttacttttggaccttcgggcttgaccactgaagtaaagtccgttgagatgcaccatgaatctcttgtggagggccttcctggtgacaatgttggattcaatgttaagaatgttgccgtcaaggatttgaagcgtggttttgttgcttctaactccaaggatgatcctgcaaaggaagctgccaacttcacctcccaggtcatcatcatgaaccacccaggtcagatcggaaatgggtatgccccagttctcgattgtcacacttctcatattgcagtcaagttttctgaaattcttaccaagattgataggcgatccggaaaggaacttgagaaggagcccaagttcttgaagaatggtgacgctggcataattaagatgattccgactaagcccatggttgttgagaccttctctgagtaccctcctctcggacgttttgcagtgagagacatgcgtcaaacggttgctgttggtgtggtcaagagcgttgagaagaaggatccaagtggtgctaaggttacaaaatctgctgccaagaagaagtaaactcacatcacctaaatggtgttataagtgagttctgtgaagtgattagtttttgtttccttttcgctgatgtgtctcgttatcttcagtttcaaacttttatttctccctcagttttgtgaacatcaatgggttactgtgtacttaatgcttttgaaaagtttatagcgttagctttggttccatgttcggtatcaagttcttgtgtccgtgcatgagtagctttatcatgccctaatatggtgccactgattggccttctgagccagttttggaaagtacatgcttgtaccagccagctggtggcagtttcattgcatacctgccccatcaacgggcaacacgatgatatgctaatctaaaagttacatagcttggaaactccatcttttggaggctaagctgatcagttgctcaaagtagtttttgtatacagggttcattagtcagttt

SEQ ID NO: 865 - DNA, 2483 bp, Vitis vinifera
cagaaatggaaacagacggaaatggaatgtgacacccattcctattcttattcctatctagggctaaaataggaattccaatataaagatggagtaacgacgctgacggacgtctcgattcgcgtctaaacctccaagaatgacatagggtttccctgacgccgttggattattcaatccaacggctcagagagaaaccctaatcacaccatggacctatagtggtacataaagtgaagtagcctttcactcttctccctctcgtgcctttgccctctgcgctctctctctattttccgagagagccattttcgacctaaagaaagattcttgctaaaattttataatgggtaaggagaaggttcacattaatattgtggtcattggtcatgttgactctggaaagtcgaccaccactggtcatttgatatacaagcttggaggtattgacaagcgtgttattgagcggtttgaaaaagaagccgctgaaatgaataaaagatcattcaagtatgcttgggtcttggacaagctcaaggctgagcgtgagcgcggtattaccattgatattgctttgtggaagtttgagaccactaaatattactgcactgtcattgatgctcctgggcatcgtgacttcatcaagaacatgatcactggtacctcacaggctgattgtgctgtgcttatcattgattctaccactggtggttttgaagctggtatttccaaggatggtcagacccgtgagcatgctttgcttgccttcacccttggtgtcaggcaaatgatctgctgttgcaataagatggatgcgacaacaccgaagtactccaagtccaggtatgatgaaattgtgaaggaagtttcttcctatcttaagaaggtcggttacaaccctgataagatcccctttgttccaatctctggatttgagggtgacaacatgattgagcggtcaacaaaccttgactggtacaagggccctaccctccttgaggctcttgacatgattcacgagcccaagaggccctcggacaagcctcttcgtctcccactacaggacgtttacaagattggtggcattggcactgttcctgttggtcgtgttgaaactggtattattaaacccggtatggttgtcacctttgggccaagtggactcactactgaagtcaagtcagttgaaatgcaccatgagtctttggtagagggtctgcctggtgacaatgttggtttcaatgtgaagaatgttgctgtcaaggatctaaaacgtggctttgttgcatctaactccaaagatgatcctgcaaaggaagctgccaacttcacagcccaggtgattatcatgaaccatcctggccaaattggaaatggttatgccccagtccttgactgccacacctcccacattgcggtgaagtttgctgagattacgaccaagattgacaggcggtctggcaaggagcttgagaaggagcccaagttcttgaagaatggtgatgctggatttgttaagatgattccaaccaagcccatggttgtggaaactttctccgagtaccctccacttggccgttttgctgttagggacatgcgtcaaactgttgctgtcggtgttatcaagagtgttgagaagaaggatccaagtggtgccaaggttaccaagtccgctgccaagaagaaatgaaaggtttgttttagaaaaccaatgctaagggaagtagtgtctatggtcttctttagttatatggtcaattttgtctcaatgggcttttatggcctttgttgctgcactctagcctcacttgtggggatggtggaggtgttgagcacttaggttccaacctgagtggcttgacaagcaatggcaaaacctacaaacccgttatattgtgcttcccctctttagtaaactgagtttttagtttctagttgaagaacaaatttggattggataacaaacgttttgaggtcccttggatgttttcatttcagtaattacctttatagtgctaggtttgtgcttagtgtttgttttcttcttagaattctggtaatccatttccgtgtttggcgagggggcaagcattaccagtgaataggaatacagatttcagcaggcggccccatggttcttgcccccttataatgtgtatatataaatctttttcacatgcaagcatatcattacgtatctcagagagcagcggaaaacaatctgtagccaatctctgaggctgaagcctcgttctcttgaatctcaatttttgaagaagaatttgatccgaagtttgattatccttgagcctcaattaaaaggaaataaaggcgctgatctgaggaggtcgttcatattgacatcataagcagggaaattcatgaaaatattgggctctggggtttgtcgtgtaggctggttgtgagcatcatcggttatggtttggcaggttgcgtttctaagtaaacaaaaccgttggttg

SEQ ID NO: 866 - DNA, 1563 bp, Humulus lupulus
cttctctctcgtttctgcctagggttttagcgcagctctcgccactataaaattacagtatggggaaggaaaagatccatattaatattgttgtcattggccatgtcgattctgggaaatcgaccacaaccggtcatttaatctacaagcttggaggaattgataagcgtgtgatcgaaaggtttgagaaggaggctgctgagatgaacaagagatcattcaagtatgcctgggtgcttgacaagctcaaggcagagcgtgagcgtggtattaccattgacattgccctctggaagtttgagaccaccaagtattactgtactgtcattgatgctcctggacatcgtgatttcatcaagaacatgattacgggaacttcacaggctgattgtgctgtgctcattattgactccacaactggtggttttgaggctggtatttccaaggatggacagacccgagagcatgctcttctcgccttcactcttggtgtcaagcaaatgatttgttgttgcaacaagatggatgccaccaccccaaagtactcaaaggcaaggtatgatgaaatcgtgaaggaagtttcttcatacctgaagaaggttggttacaacccagataagattgcattcattcccatctctgggtttgagggtgataacatgattgagagatccactaaccttgactggtacaagggcccgactcttcttgatgctcttgaccagatcctagaacctaagagaccctcagacaaacctcttcgtctcccacttcaggatgtttacaagattggaggcattggaactgtgccagttggacgtgtggaaactggtgtcatcaagcctggaatggttgtaacttttggtcccactggactgaccactgaagtcaagtctgttgagatgcaccacgaggcacttcaggaggctcttcctggtgacaatgttggctttaacgtgaagaatgttgctgtcaaggatctcaagcgcggttttgtcgcctcaaactctaaggatgatcctgccagggaggcagccaacttcacctcccaagttatcatcatgaaccatcctggccagattggcaatggttacgccccagttcttgattgtcatacctctcacattgctgttaagttttctgagatcctgaccaagattgaccgacggtctggtaaggagattgagaaggagcctaaatttttgaagaatggtgatgctgggtttgttaagatgattcccactaagcctatggttgtggaaactttctcagagtaccccccacttggtcgttttgctgtcagggacatgcgacaaactgtggccgtcggagtcatcaagagtgtggagaagaaggatccttctggggccaaggttaccaaatccgctgccaagaagaagtgaatcgtgcagttcaacattactgaaaccaaaggcagtttttgcggatgggttcttattactcatacttccaatggcgtcttatatgtctgttttgcttcttataacaattttccaccgtcgtcatgcagctgttctcagaactgggtgcttgacagacggt

SEQ ID NO: 867 - DNA, 1566 bp, Humulus lupulus
atcgtggtcattggccatgttgactcaggaaagtcgaccaccactggtcatttgatctacaagcttggaggtattgacaagcgtgtcattgagaggttcgagaaggaggctgctgagatgaacaaaaggtcattcaagtatgcctgggtgttggacaagctcaaggctgagcgtgagcgtggtattaccattgatattgccttgtggaagttcgagaccaccaagtactactgcactgtcattgatgccccaggacatcgtgactttatcaagaacatgattactggtacctctcaggctgactgtgccgtcctcattattgactccaccaccggaggttttgaggctggtatttccaaggatgggcagacccgtgagcacgcattgctggctttcactcttggtgtgaagcagatgatttgctgctgcaacaagatggatgccactacccccaagtattctaaggctaggtacgatgaaatcgttaaggaggtttcctcttacttgaagaaggttggttacaacccagacaaaattgcattcgtcccaatatctggttttgagggtgacaacatgattgagaggtctaccaaccttgactggtacaagggaccaacccttcttgaggctcttgaccaaatcaatgagcccaagaggcccacagacaagccccttcgtctcccacttcaggatgtgtacaagatcggtggtattggaactgtgcctgttggacgtgttgagactggtgttatcaagcctggtatggttgtgacctttggccccactggtctgactactgaagttaagtctgttgagatgcaccatgaagctcttctagaggctcttccaggtgacaatgttggattcaatgttaagaatgttgctgtcaaggatcttaagagaggttttgttgcctccaactccaaggatgaccctgctaaggaagcagccaacttcacatcccaggtcatcatcatgaaccaccctggtcagattggaaacggttatgctccagtgctggattgccacacctctcacattgctgttaagtttgctgagcttgttaccaagattgacaggcgttctggtaaggagcttgagaaggagcccaagtttttgaagaacggtgatgctggtattattaagatgattcccaccaagcccatggttgtggagactttctctgagtaccctcctcttggtcgttttgccgtgagggacatgcgtcagaccgttgctgtcggagtcatcaaggctgttgagaagaaggacccatcaggcgccaaggtcaccaagtctgctgtcaagaagaagtgaagtgttgtttaggagtttttatagttaggctagttttgtctctggtctttgcctttcgattttgttttgctttaatatgcggacaattatatgggtttgcattgcagtgagttgagcaacagatgcctttctgtttgcttggcaagcttttgatgtgagctttcgtttttaattatcgttttttgctttaatatcattgagaatgagttgtctagttgattgtcgatgaacaactacatttaaatttta

SEQ ID NO: 868 - DNA, 1899 bp, Zea mays
gataaggcacggagaacgagtgaccggcgcgtgaagcagcggtggtggagtgggcctagggcagggtagccgtcaaggcagggcgttcgtaggcgctacgaaagctcgaggactgtactcgctcgcaaaccctagccgccggaccggccggtgaccgtgcggcgctgaggcgcgcgctatataaacagagccatccattcctcccttaccgttcagtcccacctcgaccgcctcctctcccctcccccggctctgtctgttgacttaccccgtcgagctttctagtcagctgctcccgttgccatggggaaggagaaggttcacatcaacattgtggtcattggccatgtcgactccggcaagtccacaaccaccggccacctcatctacaagcttggaggcattgacaagcgtgtcatcgagaggtttgagaaggaggctgccgagatgaacaagaggtccttcaagtacgcctgggtccttgacaagctcaaggccgagcgcgagaggggcatcaccattgacattgccctgtggaagtttgagacaaccaagtactactgcaccgtgattgatgcccctgggcaccgtgacttcatcaagaacatgatcaccggcacctcccaggctgattgtgcggtgctcatcattgactccaccactggtggcttcgaggctggtatctccaaggacggccagacccgtgagcatgcgctccttgctttcactcttggtgtgaggcagatgatctgctgctgcaacaagatggatgccactacccccaagtactccaaggctcggtacgacgagatcgtcaaggaagtgggttcctacctgaagaaggtggggtacaacccggacaagatccccttcgtgcccatctctgggttcgagggtgacaacatgatcgagaggtcgacgaacctggactggtacaagggccccaccctccttgaggcgctggaccagatcaacgagcccaagcggccctcggacaagcccctgcggcttcctctgcaggacgtgtacaagatcggcggcatcggcaccgtcccggtgggccgcgtggaaactgggctcctgaagcccggcatggtggtcacctttgcgcccacgggcctgacgacggaggtcaagtcggtggagatgcaccacgagacgatgcaggaggcgctgcccggcgacaacgtcggcttcaacgtcaagaacgtggcggtcaaggacctgaagcgcggttacgtggcctccaactccaaggacgaccccgccaaggaggctgccagcttcaccgcgcaggtgatcatcatgaaccacccggggcagatcggcaacggctacgccccggtgctggactgccacacgtcccacatcgccgtgaagttctcggagctgctcaccaagattgaccggcggtcgggcaaggagctggagagcgcccccaagttcctcaagaacggtgacgccggcttcgtcaagatgatccccacgaagcccatggtggtggagactttctccgagtatcctccactggggcgcttcgcggttcgcgacatgaggcagacggttgcggtcggcgtgataaagagcgtggagaagaaggacccaacgggagccaaggtgaccaaggcggctgccaagaagaaatgatgatgattctgcatgtaatccatggttcctggtttctttgctggtcggagtattttgttgggtggtgctagtagtagttaacaaaagaataattttcatgggttcattgtgtaggtttggactgttgtgttcgtgattgcgtaccacactatatatattgggttttgcttctatagtaatattatcgatgaccatgatgctatgaggcttgtctacccagtcatgattgcttgccttttggctaataaacgg

SEQ ID NO: 869 - DNA, 1732 bp, Elaeis guineensis
cctccgagtgctgaagcttgccctggttcttcttttttgggagggctcagttgtttcccacacaccgccgtcacgtccaaaagcaaccatgggtaaggagaaggtccatatcaacattgtcgtcattggtcatgttgactctggcaagtcgaccaccactgggcatctcatttacaagcttggtggaattgataagcgtgtgattgagagatttgaaaaggaggctgcggaaatgaacaagaggtctttcaagtatgcatgggttttggacaagctgaaggctgagcgtgagcgtggtatcaccattgatattgctctgtggaagtttgagaccaccaagtactactgcacagtcattgatgcacctggtcatcgtgacttcattaagaacatgatcacaggaacctcccaggctgactgtgctgtccttattattgactccactactggtggttttgaggctggtatatcaaaggatgggcagacccgtgagcatgctttgcttgcctttacccttggtgtgaagcagatgatttgctgttgcaacaagatggatgcaactacaccaaagtactccaaggcaaggtatgatgaaattgttaaagaagtgtcctcctacctgaagaaggtaggttacaatcctgagaagattccttttgttcccatctccggttttgaaggtgacaacatgatcgagaggtccacaaacttagattggtacaagggcccaacacttcttgaggctcttgacatgatccaggagcccaagaggccctccgataagccccttcgcctcccacttcaggatgtctacaagattggtggcattggtactgtccccgttggacgtgttgagactggtatcctcaagcctggtatggttgtcacctttgggccaagtggactgactactgaagttaaatctgttgagatgcaccatgaagccttgcaagaggctctccctggtgacaatgtaggatttaacgttaagaatgttgctgtcaaagatctcaagcgtggttttgttgcctccaactcaaaggatgatcctgcaaaggaggctgccagcttcacttctcaggtcatcatcatgaatcacccgggtcagattggtaatggttatgcccctgtgcttgattgccacacctctcacattgctgtcaaattcgctgagatcctcaccaagattgacaggcgatctggcaaggagcttgagaaggagcctaagttccttaagaatggtgatgctggatttgtgaagatgattcccaccaagcctatggtggttgagactttctctcagtatcctcctcttggtcgttttgctgtcagagacatgagacagacggtggctgtgggagtgatcaagagtgttgagaagaaggaccctagtggtgccaaggtcaccaagtctgctgcaaagaagaagtaaagctcgaggccataaggtatgagctacaacagccataatggagctcatctttcaagtcatgtgatggtttatctttcaagtcatgtgatggtggtgttgacctgtggttaggaattaggtttttgtatcagtgttcttttttgttttttcaggtttgatacagcataatatggtggaaattttgattccaatttatgatttttgggattttaactatgtcatttgccgatatgtaccatgcatatttggttttattggagactttaaactgtttggaagaaatttacattctgtctggcc

SEQ ID NO: 870 - DNA, 1856 bp, Elaeis guineensis
ctcagccctactcttcaagatctctcggttgtggaggccggcccttcttcgatccccttctcgatcttagttctacgcaaacataacaatgggtaaagagaaggttcacattaacattgtggtcattggccatgtcgattctgggaaatccacaaccactgggcatctcatctacaagcttggtggcattgacaagcgtgtgattgaaaggtttgagaaggaagctgctgagatgaacaagaggtcatttaaatatgcttgggtgctcgacaagcttaaggctgaacgtgagcgtggcatcaccattgatatcgcactgtggaagtttgaaaccaccaaatactactgtacggtcattgatgctcctggacatcgtgacttcatcaagaatatgattacagggacctctcaggctgactgtgctgtcctcattattgactccactactggtggttttgaagctgggatttccaaggatggtcagactcgtgagcatgcccttcttgctttcacccttggagttaaacagatgatctgttgctgcaacaagatggatgcaaccacaccaaaatattccaaggcaaggtatgatgaaattgtgaaggaggtctcttcatacctcaagaaagttggctacaaccctgaaaagatcccctttgttccaatttctggtttcgaaggtgataatatgatcgagagatccaccaaccttgactggtacaagggcccaactttgcttgaggcacttgacatgattcaagaacccaagcgtccatcagacaagcccctccgccttccccttcaggatgtctacaagattgggggcatcggaactgttcctgtggggcgtgttgagactggaatcctgaaacctggaatggttgtcacttttggcccctctggtctgacaaccgaagtcaagtctgtagagatgcaccatgaggctctccaggaggcccttcctggagacaatgttggctttaatgtcaagaatgttgctgtcaaggatctgaagcgaggttatgttgcctccaactcaaaggatgacccagccaaagaagcagctagcttcacctcgcaggttattataatgaaccatccagggcagattgggaatggttatgccccagtccttgactgtcacacctcccacattgccgtcaagttcgcagagattttgaccaagattgacaggcgatctggtaaggagctggagaaggagccaaagttcttgaaaaatggtgatgctggttttgtgaagatgattcccaccaagcccatggttgtggagactttctctgagtatcctcctctagggaggtttgctgtccgggacatgaggcagacagttgcagtaggtgtcatcaagagcgtggagaagaaggatcctacgggagccaaggttaccaaatcggcagccaagaagaagtgaaccgagatgagctcggcattggtgggtcatggggtcgtcggtcgtcttagtgtcatcagttattgtcattgtgggtatgagttcatcaattatgtatctgtggtctggatgcagaattgggtgcttgaccgacggtggcataggtttgagtttctggtttttattacatgatggttgcactggttaatggttataatgcttttcagtatcttcagttttgtttgtgctaggtcattttgagataacctatttccgattttcttatgaatggactctagtattatcacatgagagagctttggttttgatgaattaagtgaatctaattttatcttttataatattctatttatagtaaaaaaaaaaaaactagtaagtaacttagtaccaaaggacaacaacagggagtaggaccccccccccc

SEQ ID NO: 871 - DNA, 1816 bp, Elaeis guineensis
gtagcgaggcggccgccgattcgatccctccttctcgatcatagccctttgtgaacttgtaaatgggaaaggagaaggttcacattaacattgtggtcattggccatgtcgattccgggaagtctactaccactggacatctcatatacaagcttggaggcattgacaagcgtgtgattgagaggtttgagaaggaagccgctgagatgaacaagaggtcattcaagtatgcttgggtgcttgacaagcttaaggctgaacgtgagcgtggcatcaccattgatattgcactatggaagttcgagaccaccaagtactactgtactgtcattgatgctcctgggcatcgtgacttcatcaagaatatgattacaggaacatctcaggctgactgtgctgtcctcattattgactccacaactggtggttttgaagctggaatttccaaggatggtcagactcgtgagcatgcccttcttgctttcacccttggagtgaaacagatgatctgctgctgcaacaagatggatgcaaccacaccaaaatattccaaggcaaggtatgatgagattgtgaaggaggtttcttcatacctcaagaaggtcggctacaaccctgaaaagatcccctttgtcccaatttctggttttgaaggtgataacatgattgagagatccaccaaccttgactggtacaagggcccaaccctactggaagctcttgacatgatccaagagcccaagcgtccatcagacaagcccctgcggcttccccttcaggatgtctacaagattggaggcattggaactgtccctgtggggcgtgttgagactggaatcctaaagcctggaatggttgtcaccttcggcccctctggcctcacaactgaagtcaagtctgtggagatgcaccatgaggctctccaggaggcccttcctggtgacaacgtgggctttaatgttaagaatgttgcagtcaaggatctgaagcgagggtatgttgcctccaactccaaggatgacccggccaaagaggccgctagctttacctcacaagttattataatgaaccacccagggcagattgggaatggttatgccccagtcctcgactgtcacacctctcacattgccgtcaaatttgctgagattttaaccaagattgacaggcggtctggtaaggagctggagaaggagccaaagttcttgaaaaatggtgatgctggatttgttaaaatgattcccactaagccaatggtggttgagactttttctgagtatcctcctcttgggaggtttgctgtcagggacatgaggcagacggttgcggttggtgtcatcaagagtgtggagaagaaggatccgactggagccaaggttaccaaatcggcagcaaagaaaaagtgaactgagaagagctctgcatttgtggggcttggagtggccggttgacatagtgtcgtcacttacagccattgtgtgggagtccaattctgtgtccgtggtctggctgggtactggacaggcggtggtggtgctaggtcttggtttatcatttatttatattacatgtggttgtgttgtcttagacagttatatcctctttaatggcttgagttttgttttgtgctaggttattggtgatacctcttagatttttttatcagtggactcggaatattatcaagtgagaaagagctttggttttgaagagaatgattcgaattgtagcttcttatgttattcagtttacaatgcttttaaggttgtttagcagcaatatgatgtgttaatcattgtcgccatagtggtgctat

SEQ ID NO: 872 - DNA, 1914 bp, Citrus sinensis
atcagctctctctgccctgaccagtctctttctatcgcttgcggctagggttttagcagagctctttcagttttaagcaaatactttatcatgggcaaggagaagtttcatatcaatattgtggttattggccatgtcgactctgggaagtcaaccaccaccggtcacttgatctacaagcttggaggtattgacaagcgtgtgattgagcggttcgagaaggaagctgctgagatgaacaagagatcattcaagtacgcatgggtgcttgacaagctcaaggctgagcgtgagcgtggtatcaccattgatattgctttgtggaagttcgagaccacgaagtactactgcactgtcattgatgcccctggacatcgtgactttattaagaacatgattaccggtacttctcaggctgattgtgctgtccttatcatcgactccaccactggtggttttgaagctggtatctctaaggatgggcagaccagagagcacgctctacttgctttcacccttggtgtgaagcaaatgatttgttgctgtaacaagatggatgccaccactcccaagtattcaaaggcaagatatgatgaaattgttaaggaagtctcttcctacttgaagaaggttggctacaacccagataagattccatttgtcccaatctctggatttgagggtgataacatgattgagaggtccacgaaccttgactggtacaagggcccaacccttcttgaagctcttgaccagatcaatgaacccaagagaccaacagacaagcctctccgtctcccccttcaggatgtctacaagattggtggtattggaactgtccctgttggccgtgttgaaactggtgtactcaagcccggtatggtagtcacattcggtccgtctggattgactacggaagttaagtcggttgagatgcaccatgagtctctccaggaggcacttcctggtgataatgtggggttcaacgttaagaatgtttcagtgaaggatcttaagcgtggttacgttgcatctaactccaaggacgatcccgccaagggggcatccaacttcacctcccaagttatcatcatgaaccaccctggccagattggaaacggttatgcacctgttcttgattgccacacttcccacattgctgtcaagtttgctgaaatcttgaccaagattgacaggcgatctggtaaggagctggagaaggagcccaaattcttaaagaatggtgatgctgggtttgttaagatgattcccaccaagcctatggttgtggaaactttctccgaatatcccccacttggtcgttttgctgtgagagacatgcgccagaccgtcgctgttggagtcatcaagagcgtggacaagaaggatccatctggagccaaggtaaccaagtctgctgccaagaagaagtgaaccgtgctggtatctttgtctgcaagtaatgtctataggtgtcatcacaataaagattgtgttctttttaggcataaatgtgttgggtgtttgggtcgtcaatttgctggttataattacaattcgccaccatcgacaagagacttttgttcacagaactgggttcttgatcggcggtggcgagattactgtattgagtctttttgagtgttgtccatgtcatgttaaaacttggatattttgtaagcagctcaggagctttaggtctctgctgagctccttaagatgttgtttgttgatgttttatgttctatctagtttgccattttcaaatatttttggcttctggagatcttttattcttttcttcatggttgcaagatacggtggtggactttacagccaactgcaataatcctttcaaatcactactagtcactgaccatttacagatgaaaatggttaatagtctgtcagaac

SEQ ID NO: 873 - DNA, 1890 bp, Orobanche aegyptiaca
acttttctgtatcctgcccgtctgatcaattgatccaacggcccaagaaaaaccctaatcgccccgaagttattgacttcatctataaatatcatttcctgctactatttctgcctctttcatttctcgaatctcaaatactctctctaatcgaccggcgagagagctctctgtattcgacgcgtagattcttgtgacagcttactttgaaagttcagcatgggcaaagagaagtttcacatcaacattgtggtcattggccatgtcgactctggaaaatcgaccaccactggtcacttgatctacaagcttggtggtattgacaagcgtgtcatagagaggtttgagaaggaggctgctgagatgaacaagaggtcattcaagtatgcttgggtgctcgacaaacttaaggctgagcgtgaacgtggtattaccattgatattgccttgtggaaatttgagaccaccaagtactactgtaccgtgattgatgcacctggtcaccgtgactttatcaagaacatgatcactggcacctcacaggcagactgtgctgtcctcatcattgactcgaccactggtggttttgaagctggtatttctaaggatggtcagacccgtgagcatgccttgcttgctttcactctcggtgtcaagcaaatgatctgttgctgcaacaagatggatgctaccacaccaaaatactccaaggccagatacgatgaaattgttaaggaagtgtcttcgtacctcaagaaggtcggatacaatcctgacaagatcaactttgtgccaatttctggtttcgagggagacaacatgattgagaggtccactaacctcgactggtacaagggcccaactctcctggaggcacttgatatgattcaggagcccaagaggccctcggacaagccccttcgtctcccccttcaggatgtttacaagatcggtggcattggtactgttcctgttggtcgtgtggaaactggtatcatcaagcccggtatgcttgtcacctttggcccgactggtctgaccactgaagttaagtctgttgagatgcaccatgaatccatgccagaggctctacctggtgacaatgttgggtttaatgtgaagaatgttgctgtgaaggatctcaagcgtggtttcgttgcttccaactccaaggatgaccccgcgaaggaagctgctaactttacgtctcaggttatcatcatgaaccatcctggacagattggacaaggatatgccccagtgcttgattgtcacacgtcacacattgctgttaagtttgctgagcttgtgaccaagattgacaggagatctggtaaggagattgagaaggagcccaagttcttgaagaatggtgatgctggtatggttaagatgattcccacaaagcccatggttgtggagaccttctccgagtacccaccgctgggacgttttgctgtaagagacatgcgccagacagttgctgttggtgtgatcaagagtgttgaaaagaaagacccatctggagccaaggtcaccaaggctgctgccaagaagggtgctaagtgattgctttttcaggagatggaatgccctgtatcagtttttatcttatgcctttattttcaattttgttttgttctggactatttttgagtctttgtgatggattcccatttaagtagcagtttttaggattattggagtgaacttgttattatccttgtatttgaatgactagtgaaagctgaaaacattccgaattaatcttctttatctttgtttttagaccgactttgtcattaaagctttgtgaacttgtattctgcattatgtcaggtaaagacggcaattcgtcaattattcactcgtataactgaaaaatgcaat

SEQ ID NO: 874 - DNA, 1434 bp, Orobanche aegyptiaca
aagaatcggcgcagagttagcttctctccaagaatccctttataattttgaaacatgggtaaggaaaagtttcacataaacattgtggtcatcggccatgtcgactctggaaaatcaaccactactggtcaccttatctacaagctcggtggtatcgacaaacgtgtcattgaaaggttcgaaaaggaagctgctgagatgaacaagaggtcattcaagtacgcatgggtgctcgacaaactgaaggcggaacgtgaacgtggtatcaccattgatatcgccttgtggaaattcgagaccaccaaatactactgcactgtgattgatgcacctggtcaccgtgactttatcaagaacatgattacgggtacctctcaggcggattgtgctgttcttattattgactcgaccactggtggtttcgaagctggtatttcgaaggacggtcagacacgtgagcatgccttgcttgcttttactcttggtgtcaaacagatgatttgttgctgtaacaagatggatgccactacgccaaaatactcgaaatctaggtatgatgaaatcgtgaaggaagtgtcgtcttatctcaagaaggtcggatacaaccccgacaagattaactttgttcccatttctggttttgagggagataacatgattgagaggtctacgaacctcgactggtacaagggcccaactctattggaggctctggacatgattcaggagcccaagagaccatcggacaagcccctccgtctcccacttcaggatgtttacaagattggtggtattggaactgtccctgttggtcgtgttgaaactggtgtcatcaagcccggcatgttagtcacctttgccccgactgggttgactactgaagttaagtctgttgagatgcatcatgaatccatgcttgaggctcttcccggtgacaatgtcggtttcaatgttaagaatgttgccgtgaaggatctgaaacgtggttatgttgcttcgaattctaaagacgaccctgctaaggaagctgctaacttcacatcacaagtcatcatcatgaaccatcctggacagattggccagggttatgctccagtgctcgactgccacacgtctcatattgctgttaaatttgctgagctcgtgaccaaaatcgatagacggtctggaaaagaactcgagaaggagcctaagttcttgaaaaacggagatgctggttttgttaagatgattccaaccaagcctatggttgtggagactttctccgagtacccacctcttggtcggtttgcagttcgtgacatgagacagacagttgctgtcggtgttatcaagagtgtcgagaagaaagatccttcgggtgctaaggtgaccaaggctgctgcaaagaagggtgcaaagtgaaccgtgctggtgtcgggttctgcttgcaag

SEQ ID NO: 875 - DNA, 1607 bp, Parthenium argentatum
ccatctttcataaaattcgtttgcagatattttgttaaggatgggtaaggaaaagattcatatcagtattgttgtcattggacatgttgactccggaaagtcaacgacaaccgggcacttgatctacaagctcgggggtatcgataagcgagttatcgagcggttcgagaaggaagctgctgaaatgaacaagaggtcattcaagtatgcttgggtgcttgacaagcttaaggcggagcgtgaaagaggtatcactatcgatattgcgttgtggaagttcgagacaacgaagtattactgcacggttattgatgctcctggacatcgtgattttattaagaacatgattactggtacctcacaggctgactgtgctgttcttattattgattcaacgactggtgggtttgaagctggtatttccaaggatggacagacgcgtgagcatgctcttcttgctttcactcttggtgttaagcaaatgatttgctgctgtaacaagatggatgctaccacaccaaaatactccaagtcaagatatgaggaaattgtgaaggaagtgtcatcatacttgaagaaggtcggatacaacccggacaaaatcccatttgttccaatctccggatttgaaggagacaacatgattgagaggtctaccaaccttgactggtacaagggtccaactcttcttgaagcacttgaccagatcaatgagcccaagagaccatcagacaagcctctccgtctcccacttcaggatgtgtacaagattggtggtattggaactgtgccggtgggacgtgttgagaccggtgtcatcaagcctggtatggttgttacttttggaccgtctgggttgactactgaagtcaagtctgttgagatgcaccatgaagctctacaagaggcgcttcctggtgacaatgttgggtttaacgtcaagaacgttgctgttaaggatctcaagcgtggttatgtagcgtcaaactccaaggatgacccagctaagggtgctgctagtttcacctcacaggttattataatgaaccaccctggtcagatcggtaacggttatgcaccggttcttgattgccacacctcccacattgctgtcaagttctctgagcttttgaccaagattgacagacgatctggtaaggagcttgagaaggagcctaagttcttgaagaacggtgacgccggtatggtaaagatgcttcccaccaagcctatggttgttgagactttcgctgagtacccaccgctaggaaggtttgctgtgagagacatgcgtcaaacggttgctgttggtgtgatcaagagcgttgacaagaaggacccaactggagccaaggtgaccaaggctgcagccaagaagggagtcaagtgaggttgtttgtgttttgattatttatattcagtgtttgttttcactagttttaaacatttgagagttttgctattcgatcttcgaatctttcgttttcgtgaaaggtttttggattgcagacttttgttggttaattttatagctggtctcctgcaatgagtttgtagttgatggttgaacaaaacttttaaatcttctattttactttatatttttc

SEQ ID NO: 876 - DNA, 1752 bp, Capsicum annuum
atttgctgtgattcccttctctcagagctgccgcaaagtgacctaatttctcttctttaagtcttttagtctctcaagatgggtaaggagaagattcacatcagcattgtggtcattggccacgttgactctggaaagtcaactaccactggtcacttgatctataagcttggcggtattgacaagcgtgttattgagaggtttgagaaggaagctgctgagatgaacaagagatcattcaagtatgcctgggtgcttgacaagcttaaggctgaacgtgagcgtggtatcaccattgatattgctttgtggaagtttgagaccactaagtactactgcaccgtgattgatgcccccgggcacagggactttatcaagaacatgattactggtacctcccaggctgattgtgctgtcctgattattgactctaccactggtggttttgaagctggtatctctaaagatggccagacccgtgaacatgctttgcttgctttcacccttggagtcaagcaaatgatttgctgctgcaacaagatggatgctaccactcccaagtactccaaggctaggtatgatgaaatcgtgaaggaagtttcttcctacctcaagaaggttggttacaaccctgacaagatccccttcgtccctatctctggttttgaaggagataatatgattgagaggtctaccaaccttgactggtacaagggtccaacccttcttgaggctcttgaccagattaatgagcccaagaggccatcagacaagcccctccgccttccacttcaggatgtttacaagattggtggtattggaactgtccctgttggtcgtgtagagactggtgtgatcaagcctggtatggttgtgacctttggaccttctggtttgacaactgaagtcaaatctgtagagatgcaccacgaagctctccaggaggcactccctggtgacaatgttggattcaacgttaagaatgttgctgttaaggatcttaagcgtggttatgttgcctcaaactccaaggatgacccagccaagggggctgccagcttcactgcccaggtcatcatcatgaaccatcctggacagattggaaatggatatgccccagttctcgactgccacacttcccacattgctgtcaagtttgctgagattttgaccaagatcgacaggcgttcaggtaaggaactcgagaaggagcctaagttcttgaagaatggtgatgctggcatggttaagatgattcccaccaagccaatggtggttgaaacctttgctgaatacccaccattgggtcgttttgctgtgagagacatgaggcaaactgttgctgttggtgttgtcaagaatgttgacaagaaggacccaactggtgccaaggtcaccaaggctgcccagaagaaggggaagtgaacagtgctgtgtaatgctggagttttcaatgctttctattgtcataaagtgtgttatgtgaactctattttgtttagttctgctatatttttatcttcgatttgctttctaggttctaattctctgccttgtatgtcagttaaccattcacagaattgggtgcttgataggcggtggcgagcatgatttgaatatgttttcatttacttgaggtgccttggttttccttccatggtggctcaggagttttgctctttatgtttcctaaatttgagatttgagtttgagactcattgccttttcttgcattaagtttctccgtcttat

SEQ ID NO: 877 - DNA, 1757 bp, Capsicum annuum
tcttcgtggagactataaaaagcccattatccttccaacattagcacttcctcactttttctgtgattcccttctctctgagccgccgcaaagtgacctaattcctcttctctctaagtcttttagtccctcaagatgggtaaggaaaagattcacatcagcattgtggtcattggtcacgtcgactctggaaagtcaactaccactggtcacttgatctacaagcttggtggtattgacaagcgtgttattgagaggttcgagaaggaagctgctgaaatgaacaagaggtcattcaagtatgcctgggtgcttgacaagcttaaggctgaacgtgagcgtggtatcaccattgatattgctttatggaagtttgagaccactaagtactactgcactgtgattgatgcccctggacacagggactttatcaagaacatgatcactggtacctcacaggctgactgtgctgtccttattatcgactccaccactggtggttttgaagctggtatctcgaaagatggtcagacccgtgaacatgcattgcttgctttcacccttggtgtcaagcaaatgatttgctgctgcaacaagatggatgcaaccacccccaagtactccaaggctaggtatgatgaaatcgtgaaggaagtgtcttcctacctcaagaaggtcggttacaaccctgacaagatccccttcgtccccatctctggttttgaaggtgataatatgattgagaggtctaccaacctcgactggtacaagggcccaaccctccttgaggctctcgaccagattaatgagcccaagaggccatcagacaaacccctccgtcttccacttcaggacgtttacaagattggtggtattggaactgtccctgttggccgtgtagagactggtgtgatcaagcctggtatggttgtgacctttggcccttctggtttgacaactgaagttaagtccgtagagatgcaccacgaagctctccaagaggcactccctggtgacaatgttgggttcaatgttaagaatgttgctgttaaggatcttaagcgtggttacgttgcctcaaactccaaggatgacccggctaagggggctgccagcttcactgcccaggtcatcatcatgaaccatcctggccagattggaaatggatacgcaccagtgctcgactgccacacttcccacattgctgtcaagtttgctgagatattgaccaagattgataggcgttcgggtaaggaactcgagaaggagcccaagttcttgaagaatggtgatgctggtatggttaagatgattcccaccaagcctatggtggttgaaacctttgctgaatatccaccattgggtcgttttgctgttagagacatgaggcaaactgttgctgttggtgttgtcaagaatgttgacaagaaggacccaactggtgccaaggtcacaaaggctgcccagaagaagggaaagtgaacagtgcattataatgctagtgtttccaatgctatcttttatcgtcaagtgtgctatctagacgttttatttaattatgttatagtttggtctttgatttgcttattaggttctagttctctgccttgtatgtcaggtaaccattctcagaactgggtacttgataggcggtggcgagcatatttcgagtctcttttcattttctgttgaggtgccatgatggctttgtatttttgctattaatgttaactgaattgcttaatttggacgttaaa

SEQ ID NO: 878 - DNA, 1656 bp, Phalaenopsis aphrodite
cctagctctcgtcggcagagccgcgccttcgtctcctcttgctagtagttttctccagccatgggtaaggagaaggtacacatcaacattgtggtcattggccatgtcgattccggcaagtccaccaccactggccatctcatttacaagcttggcggtattgacaagcgtgtgattgagaggtttgagaaggaggctgccgaaatgaacaagaggtcattcaaatatgcttgggttctcgacaagctcaaggctgagcgtgaaagaggaatcaccattgatatcgctctctggaaattcgagaccaccaagtattactgcactgttattgatgctcctggccatcgtgacttcatcaaaaacatgattactggaacttctcaggctgactgcgctgtcctgatcattgattccaccactggtggttttgaagctggtatctccaaggatggccagactcgcgagcatgctttgcttgctttcactcttggggtgaagcagatgatttgctgctgtaacaagatggatgccaccacccccaagtattcaaaggctaggtatgatgaaatcgtcaaggaagtctcctcctatctgaagaaggttggctacaaccctgagaagattccatttgttccgatctctgggtttgagggtgacaacatgatagagagatccacaaaccttgactggtacaagggtccaactctcctcgaagctctcgacctgatccaagagccaaagaggccaacagacaagcccctccgcctcccccttcaggacgtctacaagatcggtggtattggcaccgtccccgtcggtcgagtcgagactggcgttttgaagcctggcatggtagtcacctttggtcccaccggtctcaccactgaagtaaagtctgttgagatgcaccatgaagctcttcaggaggccctccctggcgacaatgttgggttcaatgtgaagaacgttgcagtaaaagatctgaagcgaggtttcgtggcctcaaactccaaggacgatcctgccagggaagccgctaacttcacttcccaggtcatcataatgaaccaccctggtcagattggcaacggctacgctcccgtgctggactgccacacctcccacatagccgtcaagtttgccgaaatcctgaccaagatcgacaggcggtctggcaaggagctcgagaaggagcccaagttcctgaagaatggcgacgcgggtttcgtgaagatggttcccactaagcctatggtggtcgagaccttctccgagtatcctccactgggtcgtttcgccgtgagggacatgaggcaaactgtggctgttggagtcatcaagagcgtggagaagaaggatcccagtggagccaaggttaccaaatctgctgccaagaagaaataaccaaaagccttcctaatttattggtaagattgtatcgttatatatatacttctatatattttgtgagttttatttatgctttagtcttcgagtcctctggtaagagtgtctaatccggtatcgctatcctgcatccatttgaatgagtggttgtcggatgggcgctggcggtgggattttgatttgtttttatttccatgttgttgagtttatgtgaaccgaacaatatttgtctttaatttatcatgttgt

SEQ ID NO: 879 - DNA, 1717 bp, Phalaenopsis aphrodite
ccctgagcagctgccagagagacgaaattcttcagctgttgttcaactctgcaatcgcgtttaagaagataagctatgggaaaggagaaggttcacatcagcattgtggtcattggtcatgttgattccggaaaatcaaccaccactggtcacctcatatacaagcttggtggtattgataagcgagttatcgagcggttcgagaaggaagcggctgagatgaacaagaggtcattcaagtatgcatgggtgcttgacaaactcaaggccgagcgcgagcgtggtatcactattgacatcgccttgtggaagtttgagaccacaaaatactattgtaccgtcattgatgctcccggccatcgtgattttatcaagaatatgatcactggaacttctcaggcagattgtgctgtgctgatcattgattccaccactggaggttttgaagccggtatttccaaggatggccagacacgtgagcatgcccttcttgctttcacccttggtgtgaagcagatgatttgctgttgcaacaagatggatgccaccacgccaaagtactctaaggcgaggtatgatgaaattgtgaaggaggtttcgtcctacttgaagaaggtgggttacaatcctgagaaaattccctttgtgccaatatctggatttgaaggcgacaatatgattgagagatctagcaaccttgactggtacaagggtccaactctgcttgaagccctggacttgattcaggaaccaaagcgtccttcggacaagccccttcgtcttccgctccaggatgtctacaagattggaggcattggaactgttcctgtgggaagagttgagacaggagtcctcaaacccggaattgtggtgacgtttggacctactggcctcacaactgaagtcaagtctgttgagatgcaccacgaggctcttcaggaagcccttcctggggacaatgttggctttaatgtcaagaatgttgctgttaaggacttgaagcgtggatttgtggcctcaaactccaaggatgatccagcaaaggaagctgcaaattttacttcgcaggtcatcattatgaatcatccaggccagattggcaatggctacgcccctgttctagactgtcacacctcccacattgctgttaagttttctgagatattgaccaagattgacaggcgctctggtaaggagcttgagaaggagcctaagttcctgaagaatggggatgctggatttgtgaagatgattcctacaaagcccatggttgttgagacattttctgagtatcctccgcttgggagatttgctgttagggacatgaggcagactgttgctgtcggagttataaagagtgtggagaagaaggatccaactggagccaaagttaccaaatctgctgtgaagaagaaatgaagtgaggactgcttcgtttcaatcgtgttcgagtcatttgttgttcgtgtctgcaggtttttaattaataagtgtgatttggtcgacttggcatcttgtgtttggatgcagaactgggtgcttgaccggaggtggcgctgaaaaatttattttgcttgttttatgtttaatttattttgcattgttaaaggtctttgagtctgttgttgaagacattgtgtcggatttttcttttccatggttatttctgaagtgcaatttgaactaatatgatgtttgcgaagcttggattggttta

SEQ ID NO: 880 - DNA, 1669 bp, Platanus occidentalis
tcggtgagagcttagcgaggcgatcttagcgttctcttctgctgttaaagattcttgcgtttgtttttatagcaatttaaaatgggtaaggagaaggttcacattaacattgttgtcatcggccatgtcgactctggcaagtcaacaaccactggccatcttatctataagcttggaggaattgataagcgtgtgattgagagatttgagaaggaagctgctgagatgaacaagaggtcattcaagtacgcctgggtgctagacaagctcaaggctgagcgtgaacgtggtatcaccattgatattgccttgtggaagttcgagaccaccaagtactactgcactgtcattgatgctcctgggcatcgtgacttcatcaagaacatgattacgggaacctcacaggccgactgtgccgtcctcatcattgactccaccaccggtggttttgaagctggtatctctaaggatgggcagactcgtgagcatgctctgcttgctttcactcttggtgtcaagcaaatgatctgctgttgtaacaagatggatgccactacccctaagtactccaaggcaaggtatgatgaaattgtgaaggaagtttcttcctacttgaagaaggtgggctacaaccctgataaaatccccttcgtccccatttccgggttcgagggtgacaacatgattgagaggtccacaaaccttgactggtacaagggcccaaccctccttgacgcccttgacatgatcttggagcccaagaggccaacagacaagcccctccgtctcccacttcaggacgtttacaagattggaggcattggtactgtccctgtggggcgtgttgagacgggtgttctcaagcctggtatggttgtgacctttggccccactggtttgaccactgaagttaagtcagttgagatgcaccatgaggctctccaggaggctttacctggtgacaatgttggcttcaatgttaagaatgttgctgtcaaggatctcaagcgtgggttcgttgcttccaactccaaggatgatcctgcaagggaggctgccaacttcacctcccaggtcatcataatgaaccacccaggccagatcggaaatggctatgccccagtgctcgactgccacacttcccacattgctgtgaagttttctgagatcctcaccaagatcgacaggcgatccggtaaggagcttgagaaggagcccaagttcttgaagaacggtgatgctgggtttgtgaagatgattcctaccaagcccatggtggtggagacattctccgaataccctccactgggtcgttttgctgtgagagacatgcgccaaacggtggcagttggagtcatcaagagcgtggagaaaaaggatccaagtggtgccaaggtcaccaaatctgcagccaagaagaagtaaaatgtcgtttgagggggttgattttcagaacagagcagactttcgtgtcagttttagtttttctcgattttggttttcttgtttttgcagtggttcgagtagcttttgtcactgtttccaaccctcacttgggagtatggtggtgttgagcattcaggtgcaaacctgggttctcgatcaggggtggcgaggtctctggtcaccaaatttggtttcctgatacaaggtgagttatttttagggg

SEQ ID NO: 881 - DNA, 1931 bp, Platanus occidentalis
ctgctctcactcgtttttgcgtcttatcgcggcgatcgttggagggttttctgattttgaagctcattccaatctagatttttataatgggtaaggagaaggttcacatcaatattgtggtcattggccacgttgattctggcaaatcaaccaccactggtcatcttatctataagctaggaggaattgacaagcgtgttattgagaggttcgagaaggaggctgctgaaatgaacaaaaggtcattcaagtatgcctgggtgttggacaagctcaaggctgagcgggaacgtggaattaccattgacattgccctgtggaaatttgagaccaccaagtactactgcacagtcatcgatgctcctgggcatcgtgacttcattaagaacatgattactggtacttcccaagctgactgtgctgttctcatcattgattccaccactggtggttttgaagctggtatctccaaggatggccagacccgtgaacatgcgctccttgcattcactcttggagtcaagcagatgatctgctgctgcaacaagatggatgctaccacccccaagtactccaaggcaaggtatgatgaaattgtgaaggaagtctcttcctacctgaagaaggttggttacaaccctgacaagattccctttgtacccatctctgggttcgaaggtgacaacatgattgagaggtctaccaaccttgactggtacaagggtcctaccctccttgatgcccttgacatgatcctggagccaaagaggcctacagacaagcccctccgactcccacttcaggatgtctacaagattggtggtattggcactgtcccagtggggcgtgttgagacaggtgttctcaagcctggtatggttgtaactttcggtcctactggactgacaactgaagttaagtctgttgagatgcaccacgaggctctccaggaagccctacctggtgacaatgttgggttcaatgtcaagaatgttgctgtgaaggatcttaaacgtggatttgttgcctccaactccaaggatgatcccgctagggaggctgccaatttcacctcccaggtcatcatcatgaaccaccctggccagattggtaacggttatgccccagtgctcgactgccacacctcccacattgctgttaagttctctgagatcctgacaaagattgacaggcgatctggtaaggagcttgagaaggagcccaaattcttgaagaatggtgatgcaggatttgttaagatgattccaaccaagcccatggtggtggagaccttctctgagtatcccccacttggtcgttttgccgtgagggacatgcgccagacggttgctgttggtgtcatcaagagcgtggagaagaaggacccaagtggagccaaggtcaccaagtccgcagccaagaagaagtgaaccgtgcggtttggcatttgtgttgctgcagctgaagacaattgttatctttatcgcaaagacttggtacttcttagtagtattgttgttggatgtttagttggtcagtctgttggttataattttctgtcttctccttcgggtacccgctctcagaactgggtgctcgataggcggtggcgggagtattaccgtcaggcacagagtctattttgagacattatggatttctaagctgctcgggagtttttaggttttgtgctcctttgctgctcgtgtgtggtcgttttatattttacctttaataatactgtttcttacttttttaagctgataacatgccattacagtggagacgatggacacaggtcacttgtccttgggtcatatatacgtggtaatcacagggccatcttgcagaggataaaaaagatgaaagggtcttgtgctttttaggcttgagatttccaagaaacaaaggttgtgttttgttcatgttga

SEQ ID NO: 882 - DNA, 1803 bp, Papaver somniferum
ctttagtacaacagtagtggaggccacgataaacaagggcatctcacaactttaatatcaatgccgaccacatggagtagataggtatcaacggtcactaacgagctatttaaatccagatacatttggataaaacgtgatccaacgaactagaaagaaaccctaatctcatttggagggtttataggctgagacgcctcctatttttcagtctctacaaatttgttaagctctattcggagctttcaatctcgatttcaaatctcagtcagtttctaagaattcaatatgggtaaagagaaagttcatatcaacattgtcgtcattggacatgtcgactctggaaaatcgaccaccactggtcacttgatctacaagcttggaggtatcgacaagcgtgtgatcgaaagattcgagaaggaggctgctgagatgaacaagaggtcattcaaatatgcatgggttcttgacaagcttaaggctgaacgcgagcgtggtattaccattgatattgccttgtggaagtttgagaccacaaagtactactgcacagttattgatgctcctggacatcgtgatttcatcaagaacatgattactggtacctctcaggctgattgtgctgtccttatcattgactccaccactggaggttttgaggctggtatctctaaggatggacagactcgtgagcacgctcttcttgctttcacccttggtgtcaagcagatgatctgttgttgtaacaagatggatgccaccacccccaagtactcaaagggtaggtacgaagaaattgtaaaggaagtctcttcatacttgaagaaggttggatacaacccagacaaaattgccttcgtccccatctctggtttcgagggagacaacatgattgagaggtccaccaaccttgactggtacaagggaccaactcttcttgatgctcttgacaacatctctgagcctaagagacccacagacaagccccttcgtcttccccttcaagatgtttacaagattggaggtattggaactgtgccagtgggacgtgttgaaactggtttcatcaagcctggtatggttatcacttttggacccactgggttgactactgaagttaagtctgtggagatgcaccacgaggctctcctagaagctcttccaggtgacaatgttgggttcaatgtcaagaatgttgctgtgaaggatctgaagcgtggtttcgtcgcttcaaactccaaggatgaccctgctaaggaagcagccaacttcacatcccaggtcatcatcatgaaccatcctggacagatcggcaacggttatgccccagtcctcgactgtcacacatctcacattgctgttaagttctctgaaatcctcaccaagatcgacaggcgatctggaaaggagctcgagaaggagcccaagttcttgaagaacggtgatgctggtattattaagatgcttccaaccaagccaatggttgtggagaccttctcggagtacccacctcttggacgttttgctgtcagagacatgaggcagactgttgctgttggtgttatcaaggctgttgagaagaaagacccaactggagccaaggtcaccaagtctgctgttaagaagaaatagatgtgttactggagatttgagttagcaacagcagggtttttcagtattctcaattttgttatgatgcttctacacgtgtcataggcttttatcatttttcatgttttgtaattcaaggattttgaacttcatcgaggattctaggtgctaatctagttttgccttgtttgg

SEQ ID NO: 883 - DNA, 1926 bp, Prunus persica
ctcagcctataaataagtcacgtagcgcttctcaaaccctgccttctcttactcactgcctctgccgctctgcttgaacctagcgtttgagcttcagatctgtgaggtaaattttaatcgcttataatgggcaaagaaaagtttcacatcaacatcgtggtcattggccatgtcgactctggaaaatcgaccacaactggtcatcttatctacaagcttggaggtattgacaagcgtgtcattgagaggttcgagaaggaagctgctgagatgaacaaaaggtcattcaagtacgcctgggtgcttgacaagcttaaggctgagcgtgagcgtggtatcaccattgatattgccttgtggaagtttgagaccaccaagtactactgcacagtcattgatgccccaggacatcgtgactttatcaagaacatgattactggaacctcacaggctgactgtgctgttctcatcatcgattccaccactggtggttttgaagctggtatctccaaggatggccagacccgtgagcatgcccttcttgctttcacccttggtgtgaagcagatgatttgctgctgtaacaagatggatgccactactcccaagtactccaaggcaaggtacgatgaaatcgtgaaggaagtctcatcctatctgaagaaggttgggtacaacccggacaaaattgcctttgttcccatctctgggttcgagggtgacaacatgattgagagatccaccaaccttgactggtacaagggaccaacccttcttgaggctcttgacttgatcaatgagcccaagaggccctcagacaagcctctccgtctaccacttcaggatgtgtacaagattggtggtattggaactgtgccagtgggccgtgttgagaccggtattatcaagcctggtatggttgtcacttttggaccaactgggctcaccactgaagttaagtctgtagagatgcatcatgaggcccttcaggaggcactgcctggtgacaatgtcggattcaatgttaagaatgttgctgtgaaggatctcaagcgtggtttcgttgcatctaactccaaggatgatcccgccagggaggctgcgaacttcacatcccaggtcatcatcatgaaccaccctggtcagattggtaacggatatgctccagttcttgattgccacacttctcacattgctgtgaagttcggtgagatcctcaccaagattgacaggaggtctggtaaggagattgagaaggagcccaaatttttgaagaacggagatgcaggtatggtgaagatgcttcccaccaagcccatggttgtggagactttctctgagtaccctccattgggtcgttttgctgtccgtgacatgcgtcagactgttgctgttggtgttatcaagagcgtggagaagaaggatcccagtggtgccaaggtcaccaagtctgctgccaagaagaagtgaagaataatgtcacagtatcaaaatttcaatgatgcaaacttatgcattgcttttaaagactcatatttaagttgtgtgtttttaaattgtttagccagtttagtctgtagttcttttgcttctgctagttctctgggctccatctccggtgtatgcgctcagaactgggtgctggacaggcggtggtgacacattgctggtttatgtttgagtcaattccgcctttttaaggagggatgttgagagttgaggactatttaattttcaagttttgttgcgtctgtcgaatggataattttttcaaccttatatatttggctttggagtatttttaattcttggtttgatggatccaactactgtcgagtcatctgagttttggttatttcttgagataatattgtatatatccttgagtggatatcttgtggcctttattaaagcatgttcattata

SEQ ID NO: 884 - DNA, 1325 bp, Secale cereale
cgcctcctctcggttccttcttctccttccttgggagctaagctctttcagccatgggtaaggagaagactcacatcaacatcgtggtcattggccatgtcgactctggcaagtcgaccaccactggccatctgatctacaagcttggaggtattgacaagcgtgtgatcgagaggtttgagaaggaagccgctgagatgaacaagaggtctttcaagtatgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctcctcgctttcactcttggagtgaagcagatgatctgctgctgcaacaagatggatgccaccactcccaagtactcgaaggcccgttatgaggaaattgtcaaggaagtttcttcgtacctgaagaaggtcggctacaaccctgacaaggttccctttgtccccatctctgggtttgagggtgacaacatgattgagaggtccaccaacctcgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtccgttgagatgcaccacgagtctctcctggaggcgcttcctggtgacaatgttggcttcaacgtcaagaatgttgctgtgaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacagttgctgttggt

SEQ ID NO: 885 - DNA, 1865 bp, Picea glauca
ttaattaaattaatcccccccccccccgccattgtctattccgtggagagcgaacgagaggggctctgcaattctttctttggtgggaaggcgaagctgctttctgtcttgcattcttcgcgttttaggttccaggaatacttgtttctagataaccatgggtaaagaaaagacccacattaacattgtggtcattggacatgtcgactctggcaagtccacaactactgggcatcttatttacaagctcggtggtattgacaagcgtgtgattgagcgttttgagaaggaagccgctgagatgaacaagaggtcatttaaatatgcctgggtgcttgacaaacttaaggctgagcgtgaacgtggtattactattgacattgctctttggaagtttgagaccaccaagtactactgcactgttattgatgcacccggacatcgcgactttattaagaacatgattacgggtacctcacaggccgattgtgctgttttgattattgattctaccaccggaggttttgaagctggtatttccaaggatggacagaccagagaacatgctcttttggcgtttactctcggagtgagacaaatgatctgttgctgtaacaagatggatgcaaccacccccaaatactccaaggcccgttatgaagaaattgtaaaggaagtgtcatcatacctgaagaaggttgggtacaacccagataaaatcccttttgtccccatttctgggtttgaaggagacaacatgattgagcgatccaccaacctggattggtacaagggcccaactctattggaagcccttgaccagttgtctgagcccaagagaccatctgacaagccccttcgattgccactacaggatgtgtacaagattggtggtattggaactgtgcctgtggggcgtgttgaaactggtgttattaagcctggtatggttgtaaccttcggtcccactgggttgacaactgaagttaagtctgtagaaatgcatcatgaagctctgctagaagcatcacccggtgacaatgttggcttcaacgtgaagaacgttgcagtcaaggatttgaaacgtgggtttgttgcctctgactccaagaatgacccagcaaaggaagcggctaacttcaccgcccaggtgatcatcatgaaccaccctggacagattgggaatggctatgctcctgtgttggactgtcacacctcccacattgctgttaagtttgctgaaattatgaccaaagtcgatagacgatctggtaaagagcttgagagggagcccaaattcctgaagaatggagatgctgggtttattaagatgattccttccaagccaatggttgtggagacattcgctgagtatcctccattaggtcgttttgctgtaagagatatgcgtcaaactgttgctgttggagtcatcaaggctgttgagaaaaaagatcccactggtgccaagatcaccaaggctgcggccaagaagggtaaatgatatttgctgctaccaaatacttcttgtgttcagaggaaggtggagggacttgaaatccatttcgctacatggtgtagaagctattctcattctgttgcacgagatttggtagttagggggttggtatctcggcgcatgcaaacatgggttcttgacaggcggtggcagcatatttataatgctatttatttcaacttggatttagtaatttgggcgggtttagtaaaactttgtgggtgaggggtagtactacatcggatttgaaagaccattgttaccgcaatttaattgcgggtttttatgttgtttctttgttgaaaactgtgtgttgagtaaagttacgagaatatttcgtgttaaa

SEQ ID NO: 886 - DNA, 1838 bp, Picea glauca
attgtctactccgtggagagcgaaggagaggggctctgcaattctttctttggtgggaaggcgaagctgctttctgtcttgcattcttcgcgttttaggttccaggaaaacttgattctagataaccatgggtaaagaaaagactcacattaacattgtggtcattggacatgtcgactctggcaagtccacaactaccgggcatcttatttacaagctcggtggtattgacaagcgtgtgattgagcgttttgagaaggaagccgcggagatgaacaagaggtcatttaagtatgcctgggtgcttgacaaacttaaggctgagcgtgaacgtggtattactattgacattgctctttggaagtttgagaccaccaagtactactgcactgttatcgatgcccccggacatcgcgactttattaagaacatgattacgggtacctcacaggccgattgtgctgttttgattattgattctaccaccggaggttttgaagctggtatttccaaggatggacagaccagagaacatgctcttttggcgtttactctcggagtgagacaaatgatctgttgctgtaacaagatggatgcaaccacccccaaatactccaaggcccgttatgaagaaattgtaaaggaagtgtcatcatacctgaagaaggttgggtacaacccagataaaatcccttttgtccccatttctgggtttgaaggagacaacatgattgagcgatccaccaacctggattggtacaagggcccaactctattggaagcccttgaccagttgtctgagcccaagagaccatctgacaagccccttcgattgccactacaggatgtgtacaagattggtggtattggaactgtgcctgtggggcgtgttgaaactggtgttattaagcctggtatggttgtaaccttcggtcccactgggttgacaactgaagttaagtctgtagaaatgcatcatgaagctctgctagaagcatcacccggtgacaatgttggcttcaacgtgaagaacgttgcagtcaaggatttgaaacgtgggtttgttgcctctgactccaagaatgacccagcaaaggaagcggctaacttcaccgcccaggtgatcatcatgaaccaccctggacagattgggaatggctatgctcctgtgttggactgtcacacctcccacattgctgttaagtttgctgaaattatgaccaaagtcgatagacgatctggtaaagagcttgagagggagcccaaattcctgaagaatggagatgctgggtttattaagatgattccttccaagccaatggttgtggagacattcgctgagtatcctccattaggtcgttttgctgtaagagatatgcgtcaaactgttgctgttggagtcatcaaggctgttgagaaaaaagatcccactggtgccaagatcaccaaggctgcggccaagaagggtaaatgatatttgctgctaccaaatacttcttgtgttcagaggaaggtggagggacttgaaatccatttcgctacatggtgtagaagctattctcattctgttgcacgggatttggtagttagggggttggtatctcggcgcatgcaaacatgggttcttgacaggcggtggcagcatatttataatgctatttatttcaacttggatttagtaatttgggcgggtttagtaaaactttgtgggtgaggggtagtactgcatcggattttaaagaccattgttaccgcaatttaattgcgggtttttatgttgtttctttgttgaaaacttcgtgtgttgagtaatgttacgagaatattttgtgttaaaa

SEQ ID NO: 887 - DNA, 1986 bp, Picea glauca
accgcacgatgacttaaatcgagggttccaccgctgttggcgacagcatattttgagaagaggagggctgatctgtccattgtctactccgtggagagcgaaggagaggggctctgcaattctttctttggtgggaaggcgaagctgctttctgtcttgcattcttcgcgttttaggttccaggaatacttgattctagataaccatgggtaaagaaaagacccacattaacattgtggtcattggacatgtcgactctggcaagtccacaactaccgggcatcttatttacaaactcggtggtattgacaagcgtgtgattgagcgttttgagaaggaagccgcggagatgaacaagaggtcatttaagtatgcctgggtgcttgacaaacttaaggctgagcgtgaacgtggtattactattgacattgctctttggaagtttgagaccaccaagtactactgcactgttattgatgcccccggacatcgcgactttattaagaacatgattacgggtacttcacaggccgattgtgctgttttgattattgattctaccaccggaggttttgaagctggtatttccaaggatgggcagaccagagaacatgctcttttggcgtttactctcggagtgagacaaatgatctgttgctgtaacaagatggatgcaaccacccccaaatactccaaggcccgttatgaagaaattgtaaaggaagtgtcatcatacctgaagaaggttgggtacaacccagataaaatcccttttgtccccatttctgggtttgaaggagacaacatgattgagcgatccaccaacctggattggtacaagggcccaactctattggaagcccttgaccagttgtctgagcccaaaagaccatctgacaagccccttcgattgccactacaggatgtgtacaagattggtggtattggaactgtgcctgtggggcgtgttgaaactggtgttattaagcctggtatggttgtaaccttcggtcccactgggttgacaactgaagttaagtctgtagaaatgcatcatgaagctctgctagaagcatcacccggtgacaatgttggcttcaacgtgaagaacgttgcagtcaaggatttgaaacgtgggtttgttgcctctgactccaagaatgacccagcaaaggaagcggctaacttcactgcccaggtgatcatcatgaaccaccctggacagattgggaatggctatgctcctgtgttggactgtcacacctcccacattgctgttaagtttgctgaaattatgaccaaagtcgatagacgatctggtaaagagcttgagagggagcccaaattcctgaagaatggagatgctgggtttattaagatgattccttccaagccaatggttgtggagacattcgctgagtatcctccattaggtcgttttgctgtaagagatatgcgtcaaactgttgctgttggagtcatcaaggctgttgagaaaaaagatcccactggtgccaagatcaccaaggctgcggccaagaagggtaaatgatatttgctgctaccaaatacttcttgtgttcagaggaaggtggagggacttgaaatccatttcgctacatggtgtagaagctattctcattctgttgcacgggatttggtagttagggggttggtatctcggcgcatgcaaacatgggttcttgacaggcggtggcagcatatttataatgctatttattttaacttggatttagtaatttgggcgggtttagtaaaactttgtgggtgaggggtagtactacatcggattttaaagaccattgttaccgcaatttaattgcgggtttttatgttgtttctttgttgaaaacttcgtgtgttgagtaatgttacgagaatattttgtgttaaaagatttttcactgtgatgtctggtgtttttgttttgatattacagattaaaaaaaatacttagcttattat

SEQ ID NO: 888 - DNA, 1708 bp, Fragaria vesca
actcctcctctcacaatacgaagccggcgatcgttttgagacctcaattctcgcctccactctcgttcttcatatttcgtgctaagagctataatgggtaaggaaaagtcccacatcaacattgtggtcattggccacgtcgactctggcaagtcgaccaccactggtcacttgatctacaagcttggtggtattgacaagcgtgtgatcgagaggtttgagaaggaggctgctgagatgaacaagaggtcattcaagtatgcctgggtgttggacaagctcaaggctgagcgtgagcgtggtatcaccattgatattgccttgtggaagtttgagaccaccaagtactactgcactgtcatcgatgctcctggacatcgtgatttcatcaagaacatgattactggaacctctcaggctgattgtgctgtcctcatcattgactccaccactggtgggtttgaggctggtatctcaaaggatgggcagacccgtgagcatgctctccttgctttcactcttggtgtcaagcagatgatctgttgctgtaacaagatggatgccaccacccccaagtactcaaaggcaaggtatgatgaaatcgtgaaggaggtctcttcctacctgaagaaggttggatacaacccagagaagattgcctttgttcccatttctggattcgagggtgacaacatgattgacagatccaccaaccttgactggtacaagggtcctaccctccttgaggctcttgaccagatcaacgagccaaagaggccctcagacaagcccctccgtctcccactccaggatgtgtacaagattggtggcattggaactgtgcctgtgggacgtgttgagactggtgtcatcaagcctggtatggttgtgacctttggtcccagtggtctgaccactgaagtcaagtctgttgagatgcaccatgaagctctccctgaggctcttcctggtgacaatgtcgggttcaatgtgaagaatgtcgctgtcaaggatctcaagcgtggttatgttgcctccaactccaaggatgaccctgccaaggaagctgctaacttcacctcacaggtcatcatcatgaaccaccctggccagattggaaatggatatgctccggttcttgactgccatacctcccacattgctgtgaagtttggtgagattttgaccaagattgacaggcggtctggtaaggagcttgagaaggagcccaagttcttgaagaatggtgatgccggtatggttaagatgcttcccaccaagcccatggttgtcgagaccttctctgagtacccacctcttggtcgttttgctgtgagggacatgcgccaaactgttgctgttggagtcatcaagaatgtggagaagaaggatccatctggtgccaaggtgaccaagtctgctgccaagaagaagtgaaccgtcatggtctcccccaagatttccatagtctttctcaataaaaaaaaatttcttgaaaattctatcaaggtttcttttgctagtatgttgagtcggtttataggtcttagtttgttgccatcgttgttaggtgttcattcccagaattgggtgcttgacaggcggtggcgcaagagtatgtaggtgcttttggtttcgccaaaggtggctaagaattgtgtggtttatctggatttttaagaactaaattttaattttatttcgtagt

SEQ ID NO: 889 - DNA, 1782 bp, Helianthus annuus
ctgctagggcatccgaatatggattccacgtctcattaacccacaaccgtcagatcatttcatccaacggcctccacaaaaccctaatcccctaactcacctataaaaacctctctttcaacctcacttctattcttcgtcttcaccccatctactagagaattcgtctgcagatatttgttaaggatgggtaaggaaaagattcatatcagtattgtcgtcatcggacatgtcgactccggcaagtcgaccacaaccggtcacttgatctacaagcttggtggtatcgacaagcgtgtgatcgaaagattcgagaaggaagctgctgagatgaacaagaggtctttcaaatacgcctgggtgcttgacaaacttaaggctgagcgtgaaagaggtatcaccatcgatatcgcgttgtggaagtttgagaccaccaagtactactgcacagttattgatgcccctggacatcgtgactttatcaagaacatgattactggtacctcacaggctgattgtgctgtgttgatcattgattccaccactggtggttttgaagctggtatttcgaaagacggacagacccgtgagcacgctcttcttgctttcacccttggtgtcaagcaaatgatttgctgctgtaacaagatggatgccaccacaccgaagtactcaaaggcgaggtacgatgaaattgttaaggaagtgtcttcttacttgaagaaggtcggatacaaccccgacaaaatcccatttgttccaatctccggattcgaaggagacaacatgattgagaggtcaaccaaccttgactggtacaagggcccaacccttcttgaagcacttgaccagatcaacgagcccaagagaccatcagacaagcctctccgtctcccacttcaggacgtgtacaagatcggtggtattggaactgtgccggtgggacgtgttgagactggtgtcatcaagcctggtatggttgtcactttcggaccatctgggttgaccactgaagtcaagtctgttgagatgcaccatgaagctcttcaagaggctcttcctggtgacaacgttgggttcaatgttaagaacgttgctgtcaaggatcttaagcgtgggtatgttgcatcgaactctaaggatgaccctgctaagggtgctgctagcttcacctcacaagttatcatcatgaaccaccctggtcagatcggtaacggttatgcaccagttcttgattgccacacctcccacattgctgtcaagttctccgagcttttgaccaagatcgacagacgatctggaaaggagcttgagaaggagcctaagttcttgaagaacggtgatgccggtatggttaagatgcttcccaccaagcctatggttgttgagactttcgctgagtacccaccactcggaaggttcgctgtgagagacatgcgtcaaacggttgctgttggtgtgatcaagagcgttgacaagaaggacccgactggagccaaggtgaccaaggcagcagcaaagaagggagccaagtgaggtggttgtgttttgattatttttattttctgtgtttgaattactagttttgaactgagttttgctatttgatccatgaagctttcatttttttgaaaggtttttggattgcagacttttgttggttaaattttatagtttgctacaattgagtttgtagttgatgggtgaacaaagcttttaaatctgttattttactctataattttctttattttcattttccttggtgtgattgcttgggtt

SEQ ID NO: 890 - DNA, 1776 bp, Helianthus annuus
catctgagtatagaatccacatatgattccctcacaaccgtcagatcacataatccaacggctcacagaaaaaccctaatttcatgccttctttacttcacttataaaacctctctttgcacctcacctcttccattcttcatctttctccatcttcttgagagctactttgcagataattcgttaaggatgggtaaggaaaagattcatatcagcattgtcgtcattggacatgtcgactccggcaagtctacaaccacaggtcaccttatctacaagttgggtggtattgacaagcgtgtgatcgaaagattcgagaaggaagctgctgagatgaacaagaggtccttcaaatacgcatgggtgctcgacaaacttaaggccgagcgtgaaagaggtatcaccatcgatattgccctgtggaagtttgagaccaccaagtactactgcactgtcatcgatgctcccggacatcgtgatttcattaagaacatgattaccggtacttcccaagctgactgtgctgttcttatcatcgactccaccactggtggttttgaggctggtatttccaaggatggtcagacccgtgagcatgctcttcttgctttcacccttggtgtcaagcaaatgatctgctgctgtaacaagatggatgccaccacaccgaagtactcgaaggcgaggtacgatgaaattgtcaaggaagtttcatcctacttgaaaaaggtcggatacaaccccgacaaaatcccattcgtgccaatctctggttttgagggagacaacatgattgagaggtccaccaaccttgactggtacaagggtccaacccttcttgaagctcttgaccaaatcaatgagcccaagagaccctcagacaagccccttcgtctcccacttcaggatgtgtacaagatcggtggtattggaactgtgccagtgggacgtgttgagactggtgtgatcaagcccggtatggttgttaccttcggaccatcagggttgaccactgaagtcaagtccgttgagatgcaccacgaagctcttcaagaggctctccccggtgacaacgtcgggttcaacgtcaagaacgttgcagttaaggatctcaagcgtggttacgttgcatcaaactccaaggatgatcctgctaagggtgctgccagtttcacttcccaggttatcatcatgaaccaccctggccagatcggtaacggttacgccccggttctcgattgccacacctcccacattgccgtcaagttctctgaactcttgaccaagatcgacagacgatctggtaaggagctcgagaaggagcctaagttcttgaagaacggagatgccggtatggttaagatgcttcccaccaagcccatggttgtcgagacctttgctgagtacccaccacttggtcggtttgccgtgagggacatgcgtcagacggttgctgtcggtgttatcaagagtgttgacaagaaggacccaaccggagccaaggtgaccaaggctgcagccaagaagggagccaagtgagagggttgtttgtgttttggtttatggagtattttatggttttctgtcgttttgattactagttttgaactttattttgttgaagagttttgttatttgatccttgaagctttcattattgtgcaagtttttatgggttacagacttttgttgtgggttaaattatagtaatcatgagttgctagttggtggcttaaagcaaaccgaccaagtggtgggtactcaagaacgcgtccc

SEQ ID NO: 891 - DNA, 1656 bp, Helianthus annuus
gggacattttttctcatcctctaatcgccgatcattccccaagataacttacaatgggtaaagaaaagattcacatcagcattgtcgtcattggacatgttgactccggaaagtcaaccacaactggtcacctcatctacaagttgggtggtatcgacaagcgtgtgatcgagaggttcgagaaagaagctgctgagatgaacaagaggtccttcaagtacgcatgggttctcgacaaactaaaggccgaacgtgaacgtggtatcaccattgatattgctctgtggaagtttgagaccaccaagtactactgcactgttatcgatgctcccggacatcgtgatttcattaagaacatgattactggtacttctcaggctgattgtgctgttctcattatcgattccactactggtggttttgaagctggtatttctaaggatggtcagacccgtgaacacgctctgctcgcgtttactcttggtgtgaagcaaatgatctgctgttgtaacaagatggatgcaaccactcccaagtactcaaaggctcgatacgatgaaatcgtgaaggaagtgtcatcttacttgaagaaggtcggttacaaccctgacaaaattcccttcgtgccgatttccggattcgagggtgacaacatgatcgagaggtcaaccaacctcgactggtacaagggacccacccttctcgaagctcttgaccagatcaacgagccgaagagaccctccgacaagccactccgtctcccacttcaggacgtgtacaagattggtggtattggaactgtgccagtgggacgtgttgaaaccggtgtgatcaagcctggtatggttgttacctttggaccatctgggttgaccactgaagttaagtcggttgagatgcaccacgaagctctacaagaagctctccccggtgacaacgttgggttcaacgtcaagaacgttgcggttaaggatctgaaacgtggttacgttgcgtcgaactccaaggatgaccctgctaagggcgcagccagtttcacctcacaagtcatcatcatgaaccaccctggtcagatcggaaacggttatgcgccggttcttgattgccacacatctcacatcgctgtcaagttttccgagcttttgaccaagattgacagacggtccggtaaagagctcgagaaggaacccaagtttttgaagaacggagatgcgggtatggttaagatgcttccaaccaagcccatggtggttgagaccttcgctgaatacccaccactcggtcggtttgctgttcgtgacatgcgtcagacggttgcggtcggtgtgatcaagagcgttgacaagaaggacccgactggagctaaggtgaccaaggctgcagcgaagaagggagctaaatgacgggtttcgagtggttttatcgttaatgaagtttgtatggtattttggaactattttattttggttaagaattttggtgaatggtgttttggtgcttgcatttctgtactctagcctcacttgtgaggatgggtggaggtattgagcaacttagttgcttgatgacggaggtgcaggttaaccaggggccagcttttgttggttgattattatgttgaaccgctatgcttttactagacatcttttatcgttt

SEQ ID NO: 892 - DNA, 1581 bp, Helianthus annuus
cggggacctttttctatcctctaatcgccgatcattccccaagataacttacaatgggtaaagaaaagattcacatcagcattgtcgtcattggacatgtcgactccggaaagtcaaccacaactggtcacctcatctacaagttgggtggtattgacaagcgtgtgatcgagaggttcgagaaagaagctgctgagatgaacaagaggtccttcaagtacgcatgggttctcgacaaactaaaggccgaacgtgaacgtggtatcaccattgatatcgctctgtggaagtttgagaccaccaagtactactgcactgttatcgatgctcccggacatcgtgatttcattaagaacatgattactggtacttctcaggctgattgtgctgttctcattattgactccactactggtggttttgaagctggtatttctaaggatggtcagacccgtgaacacgctctgctcgcgtttactcttggtgtgaaacaaatgatctgctgttgtaacaagatggatgcaaccactcccaagtactcaaaggctcgatacgatgaaatcgtgaaggaagtgtcatcttacttgaagaaggtcggttacaaccccgacaaaattcccttcgtcccgatttctggattcgagggtgacaacatgatcgagaggtcaaccaacctcgactggtacaagggacccacccttcttgaagctcttgaccagatcaacgagccgaagagaccctccgacaagccactccgtctcccacttcaggacgtgtacaagattggtggtattggaactgtgccagtgggacgtgttgaaactggtgtgatcaagcctggtatggttgttaccttcggaccatctgggttgaccactgaagttaagtcggttgagatgcaccacgaagctctacaagaagctctccccggtgacaacgttgggttcaacgtcaagaacgttgcggttaaggatctgaaacgtggttacgttgcgtcgaactctaaggatgaccctgctaagggtgcagccagtttcacctcgcaagtcatcatcatgaaccaccctggtcagatcggaaacggttacgctccggttcttgattgccacacatctcacatcgctgtcaagttttccgagcttttgaccaagattgaccgacggtccggtaaagagctcgagaaggaacccaagtttttgaagaacggagatgcgggtatggttaagatgcttccaaccaagcccatggtggttgagaccttcgctgaatacccaccactcggtcggtttgctgttcgtgacatgcgtcagacagttgcggtcggtgtgatcaagagcgttgacaagaaggacccgactggagctaaggtgaccaaggctgcagcgaagaagggagctaaatgacgggtttcgagtggttttatcgttaatgaagtttgtatggtattttggaactatttttatttgtggttaagaatttttggtgaatggtctttttggtgcttgcatttctgtactctagcctcacttgtgaggatgggtggaggtattgagcaacttagttgcttgatgacggaggtgc

SEQ ID NO: 893 - DNA, 1743 bp, Helianthus annuus
cggggaaccatttctcttaatctctctctcaaatcggcgattcaaacagcttttcaagcagattcgattgtttgacatctcaaaatgggtaaagaaaagatccacatcagcattgtcgtcattggacatgtcgactccggcaagtcaaccactaccggacacttgatctacaagcttggaggaatcgacaagagagttatcgagaggttcgagaaagaagccgctgaaatgaacaaaaggtcattcaagtacgcctgggttcttgacaaactcaaagccgaacgagaacgtggaatcacaatcgatatcgcattgtggaagtttgagaccaccaagtactactgtaccgtcattgatgctcctggacatcgtgatttcatcaagaacatgattactggtacttctcaggctgattgtgcggttctgattatcgactctaccactggtgggtttgaagctggtatttcgaaagacggtcagacccgtgaacacgctctacttgctttcactcttggtgtcaagcaaatgatttgctgttgtaacaagatggatgcaacaactcctaagtactcgaaggcaagatacgatgaaatcgtgaaggaagtttcttcttacttgaaaaaggtcggttacaaccccgacaaaatcccattcgttccaatctccggtttcgagggtgacaacatgattgagaggtcgacaaacctcgactggtacaagggcccaactcttctcgaagctcttgaccagatcaacgagccaaaacgaccatcagacaaaccccttcgtctaccacttcaggacgtgtacaagatcggaggtattggaaccgtgcctgtcggtcgtgttgaaaccggtgtgatcaagcccggtatggttgtcaccttcggtccatctgggttgaccactgaagtcaagtctgttgagatgcaccacgaagcactacaagaagctctccccggtgacaacgttgggttcaacgtcaagaacgttgcggttaaggatctgaaacgtgggtatgtcgcatccaactcgaaggacgaccccgctaagggcgccgccagtttcacctcacaagtcatcatcatgaaccaccctggtcagatcggaaacggttacgctccagttctcgattgccacacttcccacattgctgtcaagttctccgagctgttgaccaagattgaccgacggtccggtaaagaactcgagaaagagcccaagtttttgaagaacggagatgcgggtatggttaagatgcttccaaccaagccgatggtggtcgagactttcgcggagtacccgcctctcggtaggtttgcggttcgtgacatgaggcagacggttgcggttggtgtgatcaagagtgtcgataagaaggacccgactggcgctaaggtgaccaaggctgcagccaagaagggtgccaagtgaaggtggtggaccgatgaagaagttattttattggtgttttgaacaatttaattattatgtttatttggtgtttggtgttgtggcttgcattgctgtactctagcctcacttgtgaggatgtgtggaggtattgagcaacttgttgcttgatgatggtggtgcaagtttacaaaaagccagattttgacttattattgtggtacaagttttatgttttttatggtgtcaagtatttgaacctctttatgtttgtcgaaatatggttattttatatttactaaacttaaaattatcaatgaattgcccggt

SEQ ID NO: 894 - DNA, 1629 bp, Helianthus annuus
atctttctcatcttcttgagagctactttgcagataattcgttaaggatgggtaaggaaaagattcatatcagcattgtcgttattggacatgtcgactccggcaagtccacaaccacaggtcaccttatctacaagttgggtggtattgacaagcgtgtgatagaaagattcgagaaggaagctgctgagatgaacaagaggtccttcaaatacgcatgggtgctcgacaaacttaaggccgagcgtgaaagaggtatcaccatcgatatcgccctgtggaagtttgagaccaccaagtactactgcactgtcatcgatgctcccggacatcgtgatttcattaagaacatgattaccggtacttcccaagctgactgtgctgttcttatcattgactccaccactggtggttttgaggctggtatttccaaggatggtcagacccgtgagcacgctcttcttgctttcacccttggtgtcaagcaaatgatctgctgctgtaacaagatggatgccaccacaccaaagtactcaaaggcgaggtacgatgaaattgtcaaggaagtttcatcctacttgaaaaaggtcggatacaaccccgacaaaatcccattcgtgccaatctctggttttgagggagacaacatgattgagaggtccaccaaccttgactggtacaagggtccaacccttcttgaagctcttgaccaaatcaatgagcccaagagaccctcagacaagccccttcgtctcccacttcaggatgtgtacaagatcggtggtattggaactgtgccagtgggacgtgttgagaccggtgtgatcaagcccggtatggttgttaccttcggaccatcagggttgaccactgaagtcaagtccgttgagatgcaccacgaagctcttcaagaggctctccccggtgacaatgtcgggttcaacgtcaagaacgttgcagttaaggatctcaagcgtggttacgttgcatcaaactccaaggatgatcctgctaagggtgccgccagtttcacttcccaggttatcatcatgaaccaccccggccagatcggtaacggttacgccccggttcttgattgccacacctcccacattgccgtcaagttctctgaactcttgaccaagatcgacagacgatctggtaaggagctcgagaaggagcctaagttcttgaagaacggagatgcaggtatggttaagatgcttcccaccaaacccatggttgtcgagacctttgctgagtacccaccgcttggtcggtttgccgtgagggacatgcgtcagacggttgctgtcggtgttatcaagagtgttgacaagaaggacccaactggagctaaggtgaccaaggctgcagccaagaagggagccaagtgagagggttgtttgtgttttggtttatggactattttatggttttctgtcgttttgtttactagttttgaactttattttgttgaagagttttgttatttgatccttgaagctttcattattgtgcaagttttatgggttacagacttttgttgtgggttaaattatagtaatcatgagttgctagttggtggtttacaaaactttcaaatctgttgtcgcaacatttttttaa

SEQ ID NO: 895 - DNA, 1659 bp, Helianthus annuus
cttttttctatcctctaatcgccgatcattccccaagataacttgcaatgggtaaagaaaagattcacatcagcattgtcgtcattggacatgtcgactccggaaagtcaaccacaaccggtcacctgatctacaagttgggtggtattgacaagcgtgtgatcgagaggttcgagaaagaagctgctgagatgaacaagaggtccttcaagtacgcatgggttcttgacaaactaaaggctgaacgtgaacgtggtatcaccattgatatcgctttgtggaagtttgagaccaccaagtactactgcactgttatcgatgctcccggacatcgtgattttattaagaacatgattactggtacttctcaggctgattgtgctgttctcattatcgactccactactggtggttttgaagctggtatttctaaggatggtcagacccgtgaacacgctctgctcgcgtttactcttggtgtgaagcaaatgatctgctgctgtaacaagatggatgcaaccactcccaagtactcaaaagctcgctatgatgaaatcgtgaaggaagtgtcatcttacttgaagaaggtcggatacaaccccgacaaaattcccttcgtcccgatttccggattcgagggtgacaacatgattgagaggtcaaccaacctcgactggtacaagggacccacccttctcgaagctcttgaccagatcaacgagccgaagagaccctccgacaagccactccgtctcccacttcaggacgtgtacaagattggtggtattggaaccgtgccagtgggacgtgttgaaactggtgtgatcaagcctggtatggttgttacattcggaccatctgggttgaccactgaagttaagtcggttgagatgcaccacgaagctctacaagaagctctccccggtgacaacgttgggttcaacgtcaagaacgttgcggttaaggatctgaaacgtggttacgttgcgtcgaactctaaggatgaccctgctaagggtgcagccagtttcacctcgcaagtcatcatcatgaaccaccctggtcagatcggaaacggttatgctccggttctcgactgccacacttctcacatcgccgtcaagttctccgagcttctgaccaagattgaccgacggtccggtaaagagctcgagaaggaacccaagtttttgaagaacggagatgcgggtatggttaagatgcttccaaccaagcccatggtggttgagaccttcgctgaatacccaccactcggtcggtttgccgttcgtgacatgcgtcagacggttgcggtcggtgtgatcaagagcgttgacaagaaggacccgactggagctaaggtgaccaaggctgcagcgaagaagggagctaaatgacgggtttcgagtggttttatcgttaatgaagtttgtatggtattttggaactatttttatttttggttaagaatttttggtgaatggtctttttggtgcttgcatttctgtactctagcctcacttgtgaggatcggtggaggtatcgagcaacttagttgcttgatgacggaggtgcaggttaaccaggggccagcttttgttggttgattatgttgaaccgctatgcttttactagacatcttttatcgtttcggttaaa

SEQ ID NO: 896 - DNA, 1903 bp, Tabernaemontana elegans
gaactctctcttacaaggactctctcctaggacgactgcgagcgggagagctctctctagccttcggattcttttcgcaagtttgtttgaaagttcagcatgggtaaggaaaaggttcacattaacatcgtggtcattggccatgtcgactctggcaagtcgaccacaactggtcacttgatctacaagcttggtggtattgacaagcgtgtgattgagaggttcgagaaagaggctgctgagatgaacaagaggtcattcaagtatgcctgggtgcttgacaaactcaaggctgagcgtgagcgtggtatcactattgatattgccttgtggaagtttgagaccaccaagtactactgcactgtcattgatgcccctggacatcgtgactttattaagaacatgattactggtacctcacaggctgactgtgctgttctcatcattgactccaccactggtggttttgaggctggtatctccaaagatggccagacccgtgagcatgctttgcttgctttcaccctcggtgtcaagcaaatgatctgctgctgtaacaagatggatgccaccacccccaagtactccaaggctaggtacgatgaaattgtcaaggaagtctcatcatacctcaagaaggttggatacaaccctgacaaaattccctttgtccccatctctggttttgagggagacaacatgattgagaggtctacaaaccttgactggtacaagggcccaaccttgcttgaggctcttgacatgatccaggagcccaagaggccatcagacaagccactccgtctccctcttcaggatgtctacaagattggtggtattggaactgtccccgtgggtcgtgttgaaaccggtgttctgaagcccggtatggttgtgacctttggtccaactggtctgacaactgaagttaagtctgttgagatgcaccacgaggcccttcaggaggctcttccaggtgacaatgttgggttcaacgtgaagaatgttgctgttaaggatctcaagcgtggttttgttgcatccaactccaaggatgacccagccaagggggcttccagtttcaactcacaggtcatcatcatgaaccaccctggccagattggaaatggatatgccccggtgctggactgccacacctctcacattgccgtcaagtttgctgagctcttgaccaagattgacagacgatctggtaaggagcttgagaaggagcccaagttcttgaagaacggtgatgctgggatggttaagatgattcccaccaagccaatggttgtggagaccttcgctgagtacccacctcttggtcgttttgctgtgagggacatgcgtcaaactgttgctgttggtgttatcaagaatgttgacaagaaggatccaactggtgccaaggtcaccaaggcagcagccaagaagggtgccaagtgaaatgcaattatgaggagtttttatatttgttttgttgaactattttctgttatttgctttagttacaatcgattttgttttggacatcttagcagttttgaatctctggtggctctgtgcacagctctctagccttacttttgaggatagtggagaaattgagcaagttcttgcttgttcgatggcagtgatacaggctttctgggtgctttttaatttattttggactttataggatgagttgtaatccttggtcggtagacaattatatttcgtgtcattttaaagatatttgcaattgatggtcttttaccgtctaatactgtgctgctgttgtctttttgtgtgtttgtttcgagttctctctgtgtgctcacttaaggactcttctctattttaagcgaagcctggatttgggtttgtaaatccgtttgtaagctttatatctccggct

SEQ ID NO: 897 - DNA, 1809 bp, Tabernaemontana elegans
catttcaactcgcatcaccaacccaggcgcgcagacacgatctctccgtcaggctagggcttgagcacatccaagtttaattcttgaatatgggcaaggagaaggttcatattaacattgtggtcattggccatgtcgactctggcaagtccaccaccactggccatctcatttacaagcttggaggtattgacaagcgtgtgattgagaggtttgagaaggaagcagctgagatgaacaagaggtcattcaagtatgcttgggtgcttgacaagctcaaggctgagagggagcgcggtatcactattgatattgctttgtggaagtttgagacaacaaagtattactgcactgttattgatgctcctgggcatcgtgactttattaagaacatgattactggtacctcccaggctgactgtgctgtgctcattattgattccactactggtggttttgaagctggtatctctaaggatggtcagacccgtgagcatgccctccttgctttcacacttggagtcaagcaaatgatttgctgctgcaacaagatggatgctactactcccaagtactcaaaggcaaggtatgatgaaattgtaaaggaggtctcatcctatttgaagaaggttggatacaaccctgataagattccttttgttcccatttctgggtttgagggtgacaacatgattgagaggtccaccaaccttgattggtacaagggtccaactcttcttgaggcccttgacttaatcaatgagccaaagagaccaacagacaagcctctccgtctcccactccaggatgtctacaagattggtggaattggtactgttccagtgggaagggttgagactggtatcctcaagccaggaatggttgtgacttttggacccagtgggcttacaactgaagttaaatccgtcgagatgcaccatgaggccctccaagaagctcttcctggtgacaatgtgggctttaatgttaaaaatgttgctgtcaaggatctcaagcgtggttttgttgcatccaactcaaaagatgatcctgccaaggaagctgcaaacttcacatctcaggtcatcatcatgaaccaccctggtcaaattgggaatggctatgcccctgtcctggactgccacacttcccatattgctgttaagtttgcagagatcttgaccaagattgacaggcgatccggtaaggagcttgagaaggaacccaagtttttgaagaatggtgatgctggctttgtcaagatgattcccaccaagcccatggttgttgagaccttctctgagtatccaccacttggaaggtttgctgtcagggacatgcgacagactgttgctgttggtgttatcaagagtgtggataagaaggatccaactggagctaaagtcacaaaggctgcagctaagaagtctgggaagtgaatggagcagcttgggatttgcattaataactatcccaaacaatattattatttgcttaaaagtcgtttttgagtctttttttgtttcttttgtttgtcggaactttttgtcattattgtctggttgctgctcccagaattgggtgttggaccgccggtggtcttggtttatattttgacagtactatgtattattttgtagtctttaattttgtttgagacaatttctgcctttttactatttcttttcttcccattgagatataatcattgagttatagcctggctttggaggcaaggcttgtgatggaatggtaggaattctgttctccaatattgttggagctctgtaatggcaaaacggatcatct

SEQ ID NO: 898 - DNA, 1816 bp, Solanum lycopersicum
ttttgctgtgattcccttctctctgctgtgccgcaatctcctaatttctcttctctaagtcttttagtaactcaatatgggtaaagagaagattcatatcagcattgttgtcattggacatgtcgactctggaaagtcgaccactactggtcacttgatctacaagcttggtggtattgacaagcgtgtgatcgagaggtttgagaaagaagcagctgagatgaacaagaggtcattcaagtatgcatgggtgcttgacaagcttaaggctgagcgtgaacgtggtattaccattgatattgccttgtggaagtttgagaccacaaagtactactgcactgtgattgatgctcctggacacagagatttcatcaagaacatgattactggtacctctcaggctgactgtgctgtcctcatcattgactccaccactggtggttttgaagctggtatttctaaggatggtcagacccgtgaacatgcattgcttgctttcacccttggtgtcaagcaaatgatttgctgctgtaacaagatggatgctaccacccccaagtactccaaggctaggtacgatgaaattgtcaaggaagtttcttcctacctcaagaaagtaggatacaaccctgacaaaatcccctttgtccccatctctggttttgaaggagataatatgattgagaggtctaccaaccttgactggtacaagggaccaaccctccttgaggctcttgaccagattaatgagcccaagaggccctcagacaagcccctccgtcttccacttcaggatgtctacaagattggtggtattggaactgtcccagttggtcgtgtagagactggcgtaatcaagcctggtatggttgtgacctttggccctactggtttgacaactgaagtcaagtctgttgagatgcaccacgaagctctccaggaggcactccctggagacaacgttgggttcaatgttaagaatgttgctgttaaggatcttaagcgtggttatgttgcctcaaactccgaggatgacccagctaagggggcagccagtttcactgcccaggtcatcattatgaaccatcctggccagattggaaatggatatgcaccagtgcttgactgccacacttcccacattgctgtcaagtttgccgagattttgaccaagattgacaggcgttcaggtaaggaacttgagaaagagcctaagttcttgaagaatggtgatgccggtatggttaagatgattcccaccaagcccatggttgttgagacctttgctgagtacccaccattgggacgttttgccgtgagggacatgcgtcagactgttgctgttggagttgtcaagaacgttgacaagaaagaccctactggtgctaaagtcaccaaggctgcccaaaagaagggaaagtgaacagtgctgtgtaatgctagtgtttccaatgctatttattttcataaagtgtgctatctagactctgttttgtttacttcttctatagttttgtctttgatttgctttttaggctcttgtttgtgccttgtatgtcatgtaaccattctcagaactgggtacttgacaggcggtggcgagcatgatttggagactcttgtcactctgttgaggtgccttggttttccatggtgcctcaggatttttgcttttggtgttcgcccaagttatattttatataagccttttaatttctctactttgttgaagatttagagttacaatgcttctgtggaataagttcagctttagaatttttgtgtaggttatctaagaattcaaatgtcttttatt

SEQ ID NO: 899 - DNA, 1638 bp, Tragopogon dubius
attcttcgttttcctccatctaatcgagagagcttttctgcagataattcattaagatgggtaaggaaaagatccatattagcattgtcgtcatcggacatgtcgactccggcaagtccacaaccaccggtcacctcatctacaagctaggaggtattgacaagcgtgtgatcgaaaggttcgagaaggaagccgctgagatgaacaaacgttctttcaaatacgcatgggtgctcgacaaacttaaggccgagcgtgaacgtggtatcaccatcgatatcgctctatggaagtttgaaaccaccaagtactactgcacagtcatcgatgcccccggacatcgtgatttcatcaagaacatgattactggtacctcccaggccgattgcgccgtcctcatcatcgactccaccaccggaggtttcgaagctggtatttccaaggatggtcagacccgtgagcacgctcttcttgccttcacccttggtgtgaaacaaatgatctgctgctgtaacaagatggatgctactaccccgaaatactcgaaatcaaggtacgaggaaatcgtgaaggaagtttcatcatacttgaagaaggtgggatacaacccagacaaaatcccattcgtcccaatctctggatttgaaggtgacaacatgattgagaggtcaaccaacctagactggtacaagggaccaactcttttggacgctcttgaccagatcaacgagccaaagagaccatcagacaagccactccgtctaccactccaggacgtgtacaagatcggtggtattggaactgtgcctgtgggacgtgtggaaaccggagtcatcaagcccggtatggtcgtcaccttcggtccatctgggttgaccactgaagtcaagtccgttgaaatgcaccacgaagctttgaccgaagctctccccggtgacaatgttgggttcaacgtcaagaacgttgcagtgaaggatcttaagcgtgggtatgttgcttccaactccaaggacgaccctgccaaaggtgctgctagtttcacctcgcaggtcatcatcatgaaccaccctggtcagatcggaaatggatatgctcctgtgcttgattgccacacctcccacattgctgtgaagtttcaagagcttttgaccaagatcgacagacgatctggaaaggagcttgagaaggagcctaagtttttgaagaacggagatgctggtatggtgaagatgattccgaccaagcctatggtggtggagacttttgctgagtacccaccgttgggaaggtttgctgttagggacatgcgtcagacggtggctgttggtgtgatcaagaatgtggacaagaaggacccgaccggagctaaggtgaccaaggctgcggtgaagaagggagccaagtgatgtgttgtggtttggtttatggagttggttttatgttatgtctgttttaattactagttttgaacaattttatattttgttggaagagttttggtatttggggacttccattttggtggaagtttttaagacttttgttgtgatgggttaaatttatagtgctctctacttcattagtttgggttgcaaaaactttaaatctgttttaatcaaactattttaatcatttcac

SEQ ID NO: 900 - DNA, 1921 bp, Trigonella foenum-graecum
ggtttataaccctctaacccttcctataaaccctaccgctactctctattctctcattcttccttgcgacttgacttgacttaggtttcagctgcgcagcttttcccccttccttcaatcaaggtctttttgtgtttttaagctttgagtccaaatgggtaaggaaaaggttcacatcaacatcgttgtcattggtcatgtcgactctgggaagtcaactaccaccggccacttgatctacaagcttggaggtattgacaagcgtgtcattgagaggtttgagaaagaagctgctgagatgaacaagcgttcattcaagtatgcttgggtgctcgacaagctcaaggctgaacgtgaaagaggtatcaccattgacattgctctctggaagtttgagacaaccaagtactactgtactgtcattgatgcccctggacacagggatttcattaagaacatgatcaccggaacatcccaagctgattgtgccgttctcatcattgattccactactggtggtttcgaagctggtatttccaaggacggtcagacccgtgaacatgctcttcttgctttcactcttggtgtgaagcaaatgatctgctgctgcaacaagatggatgccactacacccaagtactccaagggtaggtatgaagaaattgtgaaagaagtttcatcttatttgaagaaggttggctataacccagacaaaattccatttgttcccatctctggttttgagggagataacatgatcgagcgctctacaaatcttgattggtacaagggtccgacccttcttgaggcccttgaccaaatcaatgagcctaagaggccatcagacaagcccctccgactaccacttcaggatgtctacaagattggaggaattggaactgtgcctgtgggacgtgttgagactggtgtcttgaaacctggaatggtggtgacttttgccccaagtggactgacaactgaagtcaagtctgtagagatgcaccatgaagctctcattgaggcccttcccggcgacaatgtgggatttaatgttaagaatgttgctgttaaggatctcaagcgtggttatgttgcctcaaactccaaggatgacccagccaaggaggccgctaactttacatctcaagtgatcatcatgaatcaccctggccagattggaaatggctatgcccctgttcttgactgccacacttcccacattgctgtcaaatttgctgaacttgttaccaagattgacaggcgttctggaaaggagattgagaaggagcccaaattcttgaagaatggtgatgctggtattattaagatgattcccaccaagcccatggtggttgagactttctctgaatatcctccacttggccgtttcgctgtcagggacatgcgtcaaactgtggctgttggtgtcatcaaggctgtggagaagaaggatcccagtggaggacttaacaaaactaagtcagcattgaagaagaagtgaaccgagcaggatagggaggtctattgttgtgattacaataaatggtttactcttcgtactgtttctatttctcgtctaagtaacttgttttttggattaagtctcaggtctgcaccgtcatctcgcagcttttgttcccagaactgggttctagatcgacggtggcaggactttttctttttcatgtttatgctttaattactgtgttctgtgagaactattggatttcgtaagcagccagactgcttatttggtttagtaatatcgactcattatttcttgtttagtctgtggtgctatttttaagctgtcatggcatttatccgcatgttaatttttgccggcatagaacttaaacaccacacggtgtgtggtgtttatgtggtaatttcacggcactgggattggattattggttat

SEQ ID NO: 901 - DNA, 1913 bp, Populus trichocarpa
ttacaatatttgcaatataaataacacaaaccctacactctctcttcacccccccatttgctactctctgcctatcatctctttcgcggctgaggtttaagcgaaactttctgcagtttaacactaagacttaagcatgggtaaagagaagactcacatcaacatcgtggtcattggccatgttgactctggaaagtcgaccaccactggccacttgatttataagcttggaggtattgacaagcgtgtcatcgagaggttcgagaaggaagctgctgagatgaacaagaggtcattcaagtatgcctgggtgctcgacaagctcaaggctgagcgtgagcgtggaattaccattgatattgccttgtggaagtttgagaccaccaagtactactgcactgtcattgatgcccctggacatcgtgactttatcaagaacatgattactggaacttcccaggctgactgtgccgtgcttatcattgattccaccactggtggtttcgaagctggtatctccaaggatggccagacccgtgagcacgctcttcttgcttttaccctcggtgtgaagcaaatgatatgctgttgtaacaagatggatgccaccactccaaaatactccaaggcaaggtatgatgaaattgtcaaggaagtgtcctcctacttgaagaaggtcggttacaaccctgacaagattccctttgtcccaatctctggatttgagggtgacaacatgattgagaggtccaccaaccttgactggtacaagggcccaacactcctggatgccctcgaccagatccaggagcccaagaggccctcagacaagcccctccgtctcccacttcaggacgtgtacaagattggtggtatcggaactgtcccagtgggtcgtgttgaaactggtgtcatcaagcccggcatggttgtcacattcggtccaactggactgagtactgaagtcaagtctgttgagatgcaccacgaggctctccaagaggctcttcctggtgacaatgtcgggttcaatgttaagaatgtagctgttaaggatctgaagcgtggttttgtggcctcaaactccaaggacgatcctgccagggaagctgccaacttcacctcccaagttatcatcatgaaccatcctggacagatcggaaatggttatgctccagtccttgactgccacacctctcacattgctgtgaagtttgctgagatcctcaccaagattgacaggcggtctggtaaggaactggagaaggagcccaagttcctgaagaacggtgatgctggtatgatcaagatgattcccaccaagcccatggtggtggagactttctcagagtatcctccacttggtcgttttgctgtgagggacatgcgccagaccgttgctgtgggagttatcaagagcgtggagaagaaggatccctctggtgctaaggtgaccaaatctgctgccaagaagggtgccaagtgaaccgtgcgggttggtgcactaagaagctttaataaaaatcaagagtgggttcttgttactggtccatttcttggatgtctatctgttcattatgagaactgtagtcttaagtcatcaccttcattgcaaggcttttgttcacagaactgggttcttgataggcggtggcgtggtttcggtcttgactttttttccgagtcattgttgtgtctcccatgttgagaattttaatctgtttttattttcacttgctctgctcaggagttaagtattttgctgttatgttaagtacccttgaatactttttaccattttacttgtctagtttttgttcgtctacttagtttctacgtatgcctttgtagaagagtgatattctgaatgttttttctattgcctgtctctcaaggtttgaactgcaatttag

SEQ ID NO: 902 - DNA, 1485 bp, Eucalyptus grandis
ccgcacgattcacttgcccttcttggcagcagacttggtgaccttggcaccactaggatccttcttctcgacactcttgatgacaccaacggcgacggtctggcgcatgtccctcacagcaaaacgaccgaggggaggatactcagagaaggtctcgacaaccatgggcttggtgggaatcatcttgaccattccagcatcaccgttcttcaagaacttgggctccttctcaatctccttacctgatcgcctgtcgatcttggtcaccagctcagaaaacttgactgcaatatgggaggtgtgacagtcaagaacaggggcatatccatttccaatctggccagggtgattcatgataataacttgggaggtaaagttggctgcttccttggcgggatcgtccttcgagttggatgcaacgtagccacgcttgagatccttgacagcaacattcttcacgttaaacccaacgttgtcacctggaagagcctcctggagagcctcatggtgcatctccacggacttaacttcagtggtcaacccagagggaccaaaagtgacaaccatcccaggcttaatgacaccagtctcaacacggccgacagggacagttccgataccaccaatcttgtacacgtcctgaagtgggagacggaggggcttgtcagatggtctcttgggctcattaatctggtcgagggcgtcgagcaatgttggacccttgtaccagtcaaggttggtagacctctcaatcatgttgtctccctcgaatccggagatggggacaaatggaatcttgtcagggttatatcccaccttcttcaggtaagaagagacttccttaacaatttcatcatacctagccttggagtacttgggggtggtggcatccatctcataccttgttacagcagcagatcatttgcttgacaccgagggtgaaggcaaggagagcatgctcgcgggtttggccatccttggagataccagcttcaaaaccaccagttgtggaatcgatgataaggacagcacagtcagcctgggaggttccagtaatcatgttcttaatgaaatcacgatgtcccggagcatcaatgacggtgcagtagtacttggtggtctcgaacttccacaaggcaatatcaatggtgattccacgctcacgctcggccttgagcttgtcaagcacccaggcgtacttgaatgatctcttgttcatctcagcagcttccttctcgaatctctcaatcacacgcttgtcgattcctccaagcttgtaaatcaagtggccagtggtagttgatttaccagagtcgacatggccaatgaccacaatgctgatgtgaaccttttccttacccatcttgaattataaggcttgattctcctgatgcctcggccaccaaaaccaaaaacccttcggccgctcgagcgctggcgaagcgaatggagaagacgaggaaggtgggtgtggaaatggagagc

SEQ ID NO: 903 - DNA, 1645 bp, Medicago truncatula
atgggtaaggaaaaggttcacattaacattgttgtcattggtcatgtcgactccgggaagtcaaccaccaccggtcacttgatctacaagcttggaggtattgacaagcgtgtgattgagaggtttgagaaagaagctgctgagatgaacaagcgttcattcaagtatgcttgggtgctcgacaagctcaaggctgaatgtgaaagaggtatcacaattgacattgctctgtggaagtttgagactactaagtactactgcactgtcattgatgcccccggacacagggatttcattaagaacatgattactggaacatcccaagctgattgtgctgttctgatcattgattccactaccggtggttttgaagccggtatatcaaaggatgggcagacccgtgaacacgctcttcttgctttcactcttggtgtgaagcaaatgatttttgctgcaacaagatggatgccactacacctaagtactcgaagggtaggtatgaagaaattgtgaaggaagtttcatcctatttgaagaaggttggctataacccagacaaaattccatttgttcccatctctggttttgagggagataacatgatcgagcgctctacaaatcttgactggtacaagggtcctacccttcttgaggctcttgaccaaatcaacgagcctaagaggccatcagacaagcccctccgtctaccgcttcaggatgtctacaagattggaggaattgggactgtgcctgtggggcgtgtcgagactggtgtcataaaacctggaatggttgtcacttttgcccctactggactgacaactgaagtgaagtctgtggagatgcatcatgaagctctcactgaggctcttcctggtgacaatgtgggatttaatgttaagaacgttgctgttaaggatctcaagcgtggttatgttgcctcaaactccaaggatgaccctgccaaggaggctgctaactttacatctcaagtgatcattatgaatcaccctggccagattggaaatggctatgcccctgttcttgactgccacacctcccacattgctgtcaaatttgctgagcttgttactaagattgacaggcgttctggaaaggagattgagaaggagcccaaattcttgaagaacggtgatgctggtattattaagatgattcccaccaagcccatggtggttgagactttctctgagtatcctccacttggccgtttcgctgtcagggatatgcgtcagactgtggctgttggtgtcatcaaggctgtggagaagaaggatcccagcggaggacttaataaaaacaaagtcagcattgaagaagaagtgaaccgtgcaggaagatctatccaaggaagtctattatggtgattacaagaaatggtttgctctatgtagtacttttatttttcgtcttgttaacttgtttttcggattaagtgtcaagtctgcaccgtcatctcgcaacttttgttcccaaaactgggttcttgatcgacggtggcagggctatttcttttccgtgtttatgctttgacttctgtgttttgttagaactataactatatgattttgtaagcagatagactgctgttttggttttgaaatatcaactccatgtgtttttt

SEQ ID NO: 904 - DNA, 1820 bp, Mimulus guttatus
tactcagaaatcacactctctttctgcaaatcggcggcgaaagagatcaatcctcttctctctaagtttatttttcaaggttcaacatgggtaaagaaaagtttcacatcaacattgtcgtcattggacatgtcgactccgggaaatcgaccaccactggtcacttgatctacaagctaggtggtattgacaagcgtgtgatcgagaggttcgagaaggaggctgctgagatgaacaagaggtccttcaagtacgcatgggttttggacaagcttaaggccgagcgtgagcgtggtatcaccattgatattgccttgtggaagtttgagaccacgaagtactactgcacagtcatcgatgcccctggacatcgtgatttcatcaagaacatgattactggtacctcacaggctgactgtgctgtcctcatcattgactccaccactggtggttttgaggctggtatttccaaggatggtcagactcgtgagcatgctcttcttgctttcactcttggagtgaagcagatgatctgttgttgtaacaagatggatgccaccacccccaagtactccaagggtaggtacgaggaaatcgtgaaggaggtgtcttcatacctcaagaaggttggatacaaccccgacaaaatcccattcgttcccatctctggtttcgagggagacaacatgattgagaggtcaaccaacctcgactggtacaagggcccaactcttcttgaggctcttgacttaatctctgagccaaagaggccctcggacaagccactccgtctcccacttcaggatgtctacaagattggtggtattggaacggtgcccgtcggtcgtgttgagactggtctgatcaagcctggtatgctcgtcactttcggaccaactggtctgaccactgaggttaagtccgttgagatggcaccacgagtctatgcccgaggctctccccggagacaatgttgggttcaatgtgaagaatgttgcagtcaaggatctcaagcgtgggttcgttgcatcgaactcaaaggatgaccctgccaaggaagctgctaacttcacctcccaggtcatcatcatgaaccaccctggtcagattggaaacggttatgcaccagtgctcgactgtcacacatcccacattgctgtcaagttcagggaaatcttgaccaagattgacaggcgatcgggtaaggagattgagaaggagcccaagttcctcaagaatggtgatgccggtatggttaacatgattccgaccaagcccatggtggttgagactttctcagagtaccctcctttgggtcgttttgccgttcgtgacatgcgtcagacagttgctgttggtgttatcaagagcgttgagaagaaggacccatcaggcgcaaaagttaccaaggcagctgccaagaagggagccaagtgaagaggatgtgtttcgattttggttttcatctttagtttttgtttttggtatttattatggacaattttttactttttgtatggtctgcataagtttgttgtcacgtcatctagcctcatttatgaggatagtagagtattaagcaatatggtttaaccttattgcttgatgggcgtggtgataatctttgtgtataccctccaatcgttttttacttttgagtttatgatgagtttcagacattggttgctttaaaaatcttcgtatttctgttcgtttctacttttgtttgtcttttttcttgattttgcttcatagcttagtagaatatatcttcttcatatcacaatttcatagaagattattaactaaacttgcagtta

SEQ ID NO: 905 - DNA, 1891 bp, Persea americana
cctctcctcttcagttctcggcgagtcgcttttaggtttacttcgcttcgagagctcttttgcaatcatgggtaaggagaaagttcacattaatattgtggtcattggccatgtcgactctggcaagtcgaccaccactggtcatcttatttacaagcttggaggtattgacaagcgtgtcattgagaggttcgagaaagaagcagctgagatgaacaagcgtacattcaagtatgcgtgggttcttgataagctcaaggctgaacgtgagcgtggtaattaccattgacattgctctttggaaatttgagactacaaagtactactgcactgttattgatgctcctggtcaccgtgacttcattaagaatatgatcactggtacctcccaagcagactgtgctgtccttattattgattcaaccactggtggttttgaagctggtatctccaaggacgggcaaactcgtgagcatgcattgcttgccttcacccttggtgtgaagcagatgatctgctgctgtaacaagatggacgccacaaccccaaagtactccaaggctaggtacgatgaaatcgttaaggaggtgtcttcatacctgaagaaggttggatacaaccctgagaagattccatttgttccgatctctggttttgaaggcgacaacatgattgagaggtccactaaccttgactggtacaagggcccaaccctccttgatgcacttgacttgatctccgagcccaagaggcccacagacaagccattgcgtcttccccttcaggatgtctacaaaattggtggcattggaactgttcctgtgggacgtgttgagactggtgtactcaagcccggaatggtagtcacctttggccccactggattgacaactgaagttaagtctgttgagatgcaccatgaggccctccaagaagccctacctggtgacaatgttggcttcaatgtgaagaacgttgcagttaaggatctcaagcgaggttttgtggcatcaaactccaaggatgatcctgccaaggaggctgcaaatttcacatcgcaggtcattataatgaaccaccctgggcagattggcaatggatatgctcctgtccttgactgccacacctgccacattgctgttaagtttgctgagatcctgaccaagattgacaggcgatctggtaaagagcttgagaaggagcccaagtttttgaagaacggagatgctgggtttgttaagatgattcctaccaagcctatggtggttgagactttctctgcctaccctccacttggccgttttgcagtgagggacatgcgtcagactgtagctgttggggtcattaagagtgtcgagaagaaggatcctacaggtgctaaggtaaccaagtctgctgttaagaagaagtgaactatgcagccaaatgcgggggcggtcattagagaccacaactattactacttcaaaaactccatatttttgctactatggtttggtttacagtatttagtaggttgtgttttatgtaatgctgctatttcatctccttcgctgattacccagcattgggtgctagacaggcggtggcgaggagcttttagcggtgtttcttttacttagttctttttctttatttttccctgtttcctttttatttaactgcggtgtgctgagaacataattttacttttgagtccttttaagttgcttggatttgggtggtggttctattgattgccatgttttcatgtcttgcctcggttgggtttttgcagtatgaactggtaatatgaatcttagtacatctaatgttatgttgttcccagtgtttcaaatcactttcttcgaggcatgtaaaagatttaacccttttgcatttgagtttgtaa

SEQ ID NO: 906 - DNA, 1844 bp, Beta vulgaris
ctctcctctcctcactgcggctagggttttttctctactttgaagtttctcataagataccaacatgggtaaggaaaagattcatatcagtttggtggtcattggccacgtcgattctggaaagtcgaccaccactggtcacttgatttacaagcttggtggtattgacaagcgtgtgatcgagagatttgagaaggaagctgctgagatgaacaagaggtccttcaagtatgcctgggtgcttgacaaacttaaggcagagcgtgagcgtggtattaccattgatattgccttgtggaagtttgagaccaacaagtactactgcacagtcattgatgcccccggacatcgtgactttatcaagaatatgattactggtacctcccaggctgattgtgctatcctcattattgactccaccactggaggttttgaggctggtatctccaaggatggtcaaacccgtgagcacgcacttcttgccttcacccttggtgtcaagcaaatgatttgctgctgtaacaagatggatgccaccacccccaagtactccaaggctaggtacgaggaaatcgtgaaggaagtctcttcatacctcaagaaggttggttacaacccagacaaaatcccattcgttcccatttctgggttcgagggtgacaacatgattgagaggtccaccaacctcgactggtacaagggaccaacccttcttgaggcccttgacttgatcaatgaaccaaagagaccctcagacaagccccctcgtctcccactccaggatgtgtacaagattggaggtattggaacggtgcccgttggacgtgttgagaccggtgtcttgaagcctggtatgcttgttacttttggtcctactggattgaccactgaagttaagtcagtggagatgcaccacgaatctcttccagaagctctccctggtgacaatgttggcttcaacgtcaagaatgttgctgtgaaggatctcaagcgtggtttcgttgctctgactccaagaatgaccctgccaaggaggcagccaatttcactgctcaggtgatcatcatgaaccaccctggacagattggaaatggttatgccccagtgctcgattgccacacctcccacattgctgtcaagtttgctgagcttgtgaccaagattgacagacgttcaggtaaggagattgagaaggagcccaagttcttgaagaatggtgatgctggtatggttaagatgattcccaccaagcctatggtggtggagactttctcagagtacccaccccttggtcgtttcgctgtcagagacatgaggcagactgtcgctgttggtgtcatcaagagcgtcgagaagaaggatccaaccggtgccaaggttaccaaggctgccctcaagaagaagtgaatggttttggcacctattgttgctgataatcgtttccattacaagtattatacagacttgttttttattagtagtttttgtgtgttctatttgaacttctgttttctgtgtcgtaaactcttgtcttcagcgtcttctggcacttattctcagaattgggtgctggatcgacggtggcatgattttggtctgcagtgctctgcttggtcctatgttgggcgtgtcggtttagtattctgatgtcagatagccttttgaggttgttttcatgatgtcaagttgcttttacctattatcgaactaaactttgtcaagtattgccgttccttgtttaatgttagtagtttgtttctaatatgttcttgaacttcttttttctgcatatcttatttgtttctcctatcttgtattactgttgaggttgtgtacaatcacac

SEQ ID NO: 907 - DNA, 1382 bp, Cannabis sativa
ccttcctaaacagtaacacttcacttcttcttggcggcggacttggtcaccttggcacctgatgggtccttcttctccacagccttgatgactccaacagccacggtctgacgcatgtccctcacggcgaaacgaccgagtggtgggtactcggagaaagtctcaacaaccatgggcttggtgggaaccatcttaataataccggcatctccgttcttcaaaaacttgggctccttctcgagctcctttcctgaacgcctgtcgatcttggtttgaagttcggcgaacttaacagcaatgtgagaggtgtggcaatccagcactggtgcgtaaccgttaccgatctgaccagggtggttcatgatgatgacttgggatgtgaagttggcagcttcctttgcggggtcatccttggagtttgaggcaacgaaacctctcttgagatccttgacagcaacattcttgacattgaatccgacattgtcaccaggaagagcctcgagaagagcctcgtggtgcatctcaacggacttgacctcagtagtcagaccagttgggccgaaggtgataaccataccgggcttgatgacaccagtctcaacacgtcccactggcacagttccaataccaccgatcttgtaaacatcctgaaggggtagacggaggggcttgtctgtgggcctcttgggctcgttgatgttgtcaagagcctcgagaagagttggtcccttgtaccagtcaaggttggtagacctctcaatcatgttgtcaccctcgaaaccagagatggggacgaaggcaattttgtcggggttgtatccaaccttcttcaagtatgaagaaacctccttgacgatttcatcgtacctagccttagagtacttgggggtgtattgaccttgttacaacagcaaatcatctgcttcacaccaagagtgaaagcaagcaaagcatgctcacgagtctgtccatccttggaaataccagcctcaaaacctccagtggtagagtcaataatgaggacagcacaatcagcctgggaggtaccagtaatcatgttcttgataaagtcacgatgtcctggggcatcgatgacagtgcagtagtacttggtggtctcaaacttccacaaggcaatatcaatggtaataccacgctcacgctcagccttaagcttgtccaacacccatgcgtacttgaatgaccttttgttcatctcagcagcctccttctcgaacctctcgatcacacgcttgtcaatacctccaagcttatagatcaaatgaccagtggtggtcgactttcctgagtcgacatggccaataaccacgatgttgatatgaaccttttcttttcccattctgaaaagctgaaaagtacct

SEQ ID NO: 908 - DNA, 1749 bp, Eschscholzia californica
ctcatttcttcttctccatcagcctagggtttaggcagccgttctctccacttccgaagtatcttagcatctactcgtcatgggtaaagagaaaattcatatcagtattgtcgtcattggacatgtcgactctggaaagtcgaccaccactggtcacttgatttacaagttgggaggtattgacaagcgtgttatcgaaagatttgagaaggaggctgctgagatgaacaagaggtcattcaagtatgcatgggttcttgacaagcttaaggctgaacgtgagcgtggtattaccattgatattgccttgtggaaatttgagaccaccagtactactgcactgtattgatgccccaggtacatcgtgatttcatcaagaaacatgattactggtacctctcaggccgattgtgccgtcctcatcattgactccaccactggaggtttttgaagccggtatatctaaggatggacagacccgtgagcacgctcttcttgctttcacccttggtgtcaagcagatgatctgttgttgtaacaagatggatgctaccacccccaagtactcaaaggcaaggtacgaggaaatcgttaaggaagtctcatcttaacttgaagaaggttggatacaacccagacaaaatcgcctttgttcccatttctgggtttgagggtgacaacatgattgagagatccaccaacctcgactggtacaagggaccaacccttctagatgcccttgaccaaatcaatgagccaaagagaccctcagacaagccactccgtcttccacttcaggatgtttacaagattggtggtattggaactgtgccagtgggacgtgttgagactggagtcatcaagcccggtatggttgtcacttttggccccactgggttgaccactgaggttaagtctgtggagatgcaccacgaggctctccaggaagcacttccaggtgacaatgtcggattcaatgttaagaatgttgctgtcaaggatcttaagcgtggttttgttgcctccaactccaaggacgacccagccagggaagctgctaacttcacctcccaggtcatcatcatgaaccaccctggtcagatcggtaacggatacgctccagttcttgattgtcacacctcccacattgctgtgaagttcggtgagatcctcaccaagattgacagacgatctggaaaggagctcgagaaggagcccaagtttttgaagaatggtgatgccggtatggttaagatgcttccaaccaagcccatggttgttgagacttttgccgaatacccaccccttggtcgttttgctgttagggatatgcgacagacagttgctgtgggagtcatcaagagtgttgagaagaaggatccatcaggtgccaaggtcaccaagtcagctgccaagaagaagtgaaccgtgcagttcaaccgcacagtagatttcttcgaacttcattcctccttttatcataaagacctattactttttagttgtttcgtcaaactattatgttttgtttgttgtcgatgtagctctctgccgtcaccttctatctcccgcctctatgagaactgggtgttagacagacggtggcagttgttacattgaacaaattctgtggttaatttcgtcttttgtttttcaagtcaagagtgttgaactatactgcagttggttttatagggtattgttatactgcaaagatgatgatgctttatattctagtttacaagtttt

SEQ ID NO: 909 - DNA, 1406 bp, Flaveria ramosissima
ttcttcgtcttcctccatccaccgcacaagtcgtctgcatatcaatcgttaaggatgggtaaagaaaagactcacatcagtattgttgtcattggacatgtcgactccggcaagtccacaacaactggacacttgatctacaagcttggaggaattgacaagagagtcatcgaaagattcgagaaggaggctgctgagatgaacaaaagatccttcaaatacgcctgggttcttgacaaacttaaggccgagcgtgaaagaggtatcaccattgatattgccttgtggaagtttgagacaaccaagtactactgcactgtcattgatgctcctggacatcgtgactttatcaagaacatgattacgggtacttcccaggccgactgtgcggtgcttatcattgattccaccactggtggttttgaagctggtatttccaaggatggtcagacccgtgagcacgctcttcttgctttcacccttggtgtcaagcaaatgatttgctgctgtaacaagatggatgccacaacaccaaagtactccaaggcaaggtatgatgaaattgtgaaggaagtgtcatcttacttgaagaaggtgggatacaaccctgacaaaatcccattcgttccaatctctgggttcgaaggagacaacatgattgagaggtcgacgaaccttgactggtacaagggtccaacccttcttgaagctcttgaccagatcaatgagcccaagagaccatcagacaagcccctccgtcttccacttcaggacgtgtacaagatcggtggtattggaaccgtgccagtgggacgtgttgagactggtgtgatcaagcctggtatggttgtcactttttggaccatctggattgaccactgaagttaagtctgttgagatgcaccatgaagctctgaccgaggctcttcctggtgacaatgttgggttcaacgttaagaatgttgctgtcaaggatctcaagcgtggttatgttgcgtccaactccaaggatgacccagctaagggtgctgctagcttcacctcccaggttatcatcatgaaccaccctggtcaaattggtaacggttatgcacctgttcttgattgccacacctctcacattgctgtcaagttctctgaactgttgaccaaagatcgacagacgatctggtaagaacttgagaaggagcctaaatcttaaagaatggtgatgctggtatggttaagatgcttcccaccaagccatggttgtcgagactttcgcagagtatccaccacttggaggtttgcagtcagagacatgcgtcaaacggttgctgtgggtgtcatcaagagcgttgagaagaaggacccaacaggagccaaggttaccaaggccgcagtgaagaagggagccaagtgaggtg

SEQ ID NO: 910 - DNA, 1678 bp, Gossypium raimondii
atgggcaaggaaaagactcacattaacattgtcgtaattggccatgtcgactctggaaagtcaaccaccactggccacttgatctacaagcttggaggtattgacaagcgtgtcattgaaaggtttgagaaggaagctgctgagatgaacaagaggtcattcaagtatgcttgggtgcttgacaagttgaaggctgagcgtgaacgtggtattaccattgacattgccctgtggaagtttgagaccaccaaatattactgcactgtcatcgatgcccctggacatcgtgactttatcaagaacatgattactggtacctcccaggccgattgtgctgtccttatcattgactctaccactggaggttttgaggcaggtatttccaaggatggacagacccgtgagcatgctctgcttgctttcactctcggtgtcaagcaaatgatttgagatggatgccacaacccccaaatactcaaaggctaggtatgatgaaattgtgaaggaagtgtcttcctacttgaagaaggttggttacaaccctgagaagattccttttgtccccatctctggttttgagggtgacaacatgattgaaaggtccaccaaccttgattggtacaagggtccaactcttctcgaggctcttgaccagatcaatgagcccaagagaccctctgacaagccactccgtcttccacttcaggatgtgtacaagattggaggtattggaactgtccctgtgggtcgtgttgaaactggtatcctcaagcctggtatggttgtaacctttggtccctctggattgaccactgaagttaagtctgttgagatgcaccatgagtctcttcctgaggctcttccaggtgacaatgttggcttcaatgtcaagaatgttgctgtgaaggatctgaagcgaggatatgttgcttcgaactcaaaggatgatcctgccaaggaggcagctaatttcacttcccaagtcatcatcatgaaccacccagggcagattggaaatggatatgcgcctgtccttgattgccacacgtcccacattgcggtcaagtttgcagagttggtgaccaagattgacaggcgttctggtaaggagcttgagaaggaacccaagttcttgaagaatggtgatgcaggatttgttaagatgattcccaccaaacccatggttgtggaaaccttctctgagtatcccccactgggtcgttttgctgtgagggacatgaggcagactgttgctgtcggcgttatcaagagcgtggagaagaaagatccaactggagccaaggtgaccaagtctgctgccaagaagggtgggaagtgaaccgtgcgggtttcagttgatccaaccgaactatatcatggctactacaataaaacattgcttcttattagtaggtcagccatcattggacgattagttgtgtgttttgatggtcatagttttaagtcatcaccgtcttgtagaggatgttgttcacagaactgggttcttgatagacggtggtgaggcttttgtgtttttcagagtctgctgtctgtgagagtaattataaactttgaatggtgtcttgtgttcccattatttatggcaatcagctcaggagttttaggtctggtcctgggcttttctgcttgaatttgttctatcaaacatttatat

SEQ ID NO: 911 - DNA, 1452 bp, Zea mays
cagcaaccacagcatacaaaacttatgccaaaatggaacatctcagctacgtattggaaaagcagacgctgcatcaacgacaggtcgcatcatttcttcttggcagcagccttggtcaccttggcaccggtcgggtccttcttctccacactcttgatgactccaacagcaaccgtctgtctcatgtcacggacagcaaacctacccaggggaggatactgcgagaatgtctccaccaccatgggcttggtgggaatcatcttcaccataccagcatcaccgttcttcaagaacttgggctctttctcaagctccttgccagaacgcctgtcgatcttggtaatcagctcagcaaacttgacagcaatatgggaggtatggcagtccagcactggggcatagccgttaccgatctggccagggtggttcatgatgatgacctgggaggtgaagctggcagcctccttggcagggtcatccttggagttggaggccacataaccacgcttgatatccttcaccgcgacattcttcacgttgaagccaacgttgtcaccaggaagggcctcctgaagagcctcatggtgcatctcaacagacttcacctcagtagtcaggccagttggaccaaaggtgacaaccataccaggcttgatgacaccagtctccacacgaccaactggcacagttccaataccaccaatcttgtacacatcctggagggggagacgcaggggcttgtctgagggtctcttgggctcggtgatctgatcaagagcctcaagcagggttgggcctttgtaccagtcaaggttggtggacctctcaatcatgttgtcaccctcaaaaccagagatgggaacaaatgcaatcttatcagggttgtacccaactttcttgaggtaagatgagacttccttcacaatctcatcataacgtgccttggagtatttgggatccttagagcataccttgttgcagcagcaaatcatctgcttcactccaagtgtgaacgcaaggagagcatgctcacgtgtctggccatccttggagataccagcctcaaaaccaccagtggtggagtcaatgataaggacagcacagtcagcctgggaggtaccagtgatcatgttcttgataaagtcacggtgtccaggggcatcaataacggtgcaatagtacttggtggtctcaaacttccacagagcaatatcaatggtgatacccctctcacgctcagccttgagcttgtcaagcacccaagcatacttgaaggatcgcttgttcatttcagcggcctccttctcaaacctctcgatcacacgcttgtcaatgcctccaagcttgtagatcaggtggccggtggttgtcgacttgccagagtcgacgtggccaataaccacaatgttgatgtgagacttctccttacccatggctggaggcgaagcttaa

SEQ ID NO: 912 - DNA, 1323 bp, Secale cereale
gccgcctcctctcctcggctccttctccttcattcgagtttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcccaagtactcgaaggcccgttatgaggaaattgtcaaggaagtctcttcgtacctgaagaaggtcggctacaaccctgacaaggttcccttcgtcccatctctgggtttgaggtgacaacatgattgagacggtccaccaaccttgactggtacaagggccctaccctgcttgaggcgcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacgtttggtcccactggtctgacaactgaggtcaagtctgttgagatgcaccacgagtccctcctggaggcgcttcctggtgacaacgttggcttcaacgtcaagaatgttgctgtgaaggatctgaagcgtgggtttgttgcatccaactccaaggatgaccctgccaaggaggccgccaacttcacctcccaggtcatcatcatgaaccaccctggtcagattggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacagttgctgttggtgtcatc

SEQ ID NO: 913 - DNA, 1985 bp, Ricinus communis
ataatgaactaaaagaaaatagaagtggaaaaactgacatttcttaaaaagccaaagtaactccagtaaggaaccctagttctatttgctagtataaatacaagcatctctttctaggtatttttcctcttactactcccactctattactgctgttagggtttataccggttcctgcaggcgcctcaactatcctcttttctggtcaatttagatatctataatgggtaaggagaagattcacatcagcatcgtggtcattggacatgtcgactctggcaagtccaccaccactggacatctcatctacaagctcggaggtattgacaagcgtgtgattgagaggttcgagaaggaggctgctgagatgaacaagaggtcattcaagtatgcttgggtgctggacaagcttaaggctgagcgtgagcgtggtatcaccattgatattgccttgtggaaattcgagaccaccaagtactactgtactgtcattgatgctcctgggcatcgtgactttattaagaacatgattactggtacttcacaggctgactgtgctgttcttatcattgattccactactggtggttttgaagctggtatttctaaggatgggcagacccgtgagcatgctcttcttgcttttacccttggtgtcaaacaaatgatttgctgctgcaacaagatggacgccactactcccaagtactctaaggccaggtacgatgaaattgtcaaggaagtttcatcctatcttaagaaggtgggatataaccccgacaagattcctttcgttcccatctctgggttcgaaggtgacaatatgattgagaggtccaccaaccttgactggtacaagggtccaaccctacttgaagctcttgaccagatcaatgagccaaagaggccctcagacaaacctctccgtctcccacttcaagacgtatacaagattggtggtattggaactgttcctgtgggtcgtgtagagactggtgtcctcaagcctggtatggttgtgacctttggacccagtgggttgacaactgaaattaagtcagttgagatgcatcacgaggctctccaggaggccctccctggcgacaatgttggatttaacgtgaagaatgttgctgtgaaagatttgaagagaggttatgttgcatcaaactccaaggatgatcctgccaaggaagctgccaacttcacatcccaggttatcatcatgaaccaccctggccagattggaaatggatatgctccagtcttggactgccacacctcccacattgctgtgaagtttgctgagatcttgaccaagatcgatcgccgatctggcaaggagcttgagaaggagcctaagttcttgaagaatggtgatgctgggtttgtaaagatgattccaaccaagcccatggttgtcgagactttctctgagtaccctccgttgggacgttttgctgtgcgggacatgcgtcagactgttgctgtgggtgttattaagagcgtcgagaagaaggacccgagtggtgctaaggttacgaagtctgctgccaagaagggagggaaatgaatattgcgatccccaaattctattgatgctattaagaacattttatgctattattccagtcccttaaaatgtttaattagtaattatattttgagttttgggtgttcattttccagttgcagtgcccagcactgggtgcttgacaggcggtggagacacatttatttaaggatttatggcatggttttgtaattttgttgtaactgcttgagtttgacagttgatactgaatctctcatttatactctttttcctatttcttctagcctctcttttctcttttgaattcgatattggccattggtttctttcattaaaattatctgttgataattgttacttgtgaattcccctctcaacattctggcagagatggcgggcctcctgttcttaatgccaatatcgaatgtag

SEQ ID NO: 914 - DNA, 1829 bp, Ricinus communis
gctagtataaatacaagcatctctttctaggtatttttcctcttactactcccactctattactgctgttagggtttataccggttcctgcaggcgcctcaactatcctcttttctggtcaatttagataatctataatgggtaaggagaagattcacatcagcatcgtggtcattggacatgtcgactctggcaagtccaccaccactggacatctcatctacaagctcggaggtattgacaagcgtgtgattgagaggttcgagaaggaggctgctgagatgaacaagaggtcattcaagtatgcttgggtgctggacaagcttaaggctgagcgtgagcgtggtatcaccattgatattgccttgtggaaattcgagaccaccaagtactactgtactgtcattgatgctcctgggcatcgtgactttattaagaacatgattactggtacttcgcaggctgactgtgctgttcttatcattgattccactactggtggttttgaagctggtatttctaaggatgggcagacccgtgagcatgctcttcttgctttcacccttggtgtcaagcaaatgatttgctgctgcaacaagatggacgccactactcccaagtactctaaggccaggtacgatgaaattgtcaaggaagtttcatcctatcttaagaaggtgggatacaaccccgacaaaattcctttcgttcccatctctgggttcgaaggtgacaatatgatcgagaggtccaccaacctggactggtacaagggtccaaccctacttgaagctcttgaccagatcaatgagccaaagaggccctcagacaaacctctccgtctcccacttcaagacgtatacaaaattggtggtattggaactgttcctgtgggtcgtgtagagactggtgtcctcaagcctggtatggtggtgacctttggacccagtggattgacaactgaaattaagtcagttgagatgcatcacgaggctctccaggaggccctccccggcgacaatgttggatttaacgtgaagaatgttgctgtgaaagatttgaagagaggttatgttgcatcaaactccaaggatgatcctgccaaggaagctgccaacttcacatcccaggttatcatcatgaaccaccctggccagattggaaatggatatgctccagttttggactgccacacctcccacattgctgtgaagtttgctgagatcttgaccaagatcgatcgccgatctggcaaggagcttgagaaggagcctaagttcttgaagaatggtgatgctgggtttgttaagatgattccaaccaagcccatggttgtcgagaccttctctgagtaccctccgttgggacgttttgctgtgagggacatgcgtcagactgttgctgtgggtgttatcaagagcgtggagaagaaggacccgagtggtgctaaggttacgaagtctgctgccaagaagggagggaaatgaatattgcggtccacaaattcaattgatgctattaagaacattttatgctattattccagtcctttaaaatgtttaattagtaattatattttgagttttgggtgttcattttccagttgcagtgcccagcactgggtgcttgacaggcggtggagacacatttatttaagaatttatggcatggttttgtaattttgttgtaactgcttgagtttgacagttgatactgaatctctcatttatactcgttttcctatttcttctagcctctcttttctcttttgtattcgatattggccattggtttctttcattaaaattatctgttgataattgttgctt

SEQ ID NO: 915 - DNA, 1869 bp, Olea europaea
cttttagtgagcggctagggttttaacagaagtctctctctgtgagctctttctaagcggttttagacattcatcatgggtaaggagaaggttcacattaacattgtggtcattggtcatgttgactccggaaagtctaccactaccggtcacttgatctacaagctcggtggaattgataagcgtgtcattgaaaggttcgagaaggaggctgctgagatgaacaagaggtcatttaagtatgcttgggtgctcgacaagctcaaggctgagcgtgagcgtggtattaccattgatattgccttgtggaagttcgagaccaccaagtactactgcactgtcatagatgctcctggacatcgtgactttatcaaaaacatgattactggtacctcacaggctgactgtgccgtcctcatcatcgactccaccactggtggctttgaagcgggtatctccaaggatggtcagacccgtgagcatgctttgcttgctttcacccttggtgtcaagcagatgatttgctgctgcaacaagatggatgccaccacgccaaaatactccaaacctagatatgatgaaattgtgaaggaagtttcttcctacatcaagaaggttgggtacaatcctgacaagattccatttgtccccatttctggttttgagggtgacaacatgattgagaggtccaccaacctcgactggtacaagggcccaaccctgctagaagctcttgaccagattctggagcccaagaggccctcagataagcctcttcgactcccgcttcaggatgtatacaagattggtggtattggtactgtcccagtcggtcgtgtggagactggtgtcctcaagcctggtatggttgtgaccttcggtccctctgggttgaccactgaagttaagtctgttgagatgcatcatgaagcccttcaggaggctctccctggagataatgttggtttcaacgtgaagaatgttgctgtcaaggatctcaagcgtggttacgtggcttcgaactccaaggatgatcctgctaagggagctgctaactttacctcccaggtcatcatcatgaaccaccctggtcagattggaaatggatatgccccagtgctggattgccacacctctcacattgctgtaaagtttgctgagctccagactaagattgataggcgatctggtaaggagcttgagaaggagcccaagtttttgaagaatggtgatgctggtctcgtgaagatgattccaaccaagcctatggtggtggagactttctccgagtacccacctcttggtcgttttgctgttagagacatgcgtcagaccgtcgccgttggagtcatcaagaatgtggataaaaaggatccaactggtgccaaggtgaccaaagctgctgccaagaagggtgccaagtgaaccgtttgtgctaatgttcattcgattgcaagagtactttattattacaaactatggcataactttgtcttcgtcactgtcgttttagttggtcagttattttacgtagtacattgtggtactctgtcttttacgtttggttgccgttcccagaactgggtgcttgacaggcggtggcgcagcctacgtatttgaagagtaagttttccctcatttccgtttgttttgccctttgaggtgctctggtttatcctagcggctcaagagttttgtgtttcgtgtcctcctctacaattgtaatagatctattctgaatttgtcttgattcttgttaccattctgcgcatgattatttatgtggctcaatcttcatttacatcggttggatatttttggttgatcatcggttggatatttttggttgatcccataattttaatgaaa

SEQ ID NO: 916 - DNA, 1734 bp, Olea europaea
cgtgtctttactctcgtgctctctgcggctaggattttaacaaagtttttatttctcttttttagatattcgttatgggtaaggagaaggttcacattaacattgtggtcattggccatgtggactctggaaaatcgaccaccactggtcacttgatctacaagcttggtggtattgacaagcgtgtcattgaaaggttcgagaaggaggctgctgagatgaacaaaaggtcatttaagtatgcctgggtgcttgacaagctcaaggctgagcgtgagcgtggtattaccattgatattgccttgtggaagtttgagaccaccaagtactactgcactgtcattgatgctcctggacatcgtgactttatcaagaacatgattaccggtacctcacaggctgattgtgctgtcttgatcattgattccaccactggtggttttgaagctggtatctccaaggatggtcagacccgtgagcatgctttgcttgcttttaccctcggtgtgaagcagatgatttgctgctgcaacaagatggatgccaccacaccaaaatactccaagccgagatatgatgaaattgtgaaggaagtttcttcttatatcaagaaggttgggtacaatcccgacaagataccattcgtccccatttctggttttgagggtgacaacatgattgagaggtctaccaacctcgactggtacaagggcccaaccctgctagaagcactcgaccagattctggagcccaagaggccctcggacaagcctcttcgtctcccacttcaggatgtctacaagattggtggtattggtactgtcccggtgggtcgtgtggagactggtgtcctgaagccaggtatggttgttacttttggtccctctggcttgaccactgaagttaagtctgttgagatgcaccacgaagcccttcaggaggctctccctggtgataatgttgggttcaatgtcaagaatgttgctgtcaaggatctcaagcgtggttatgtggcttccaactccaaggatgatcctgctaagggagctgctagctttacctcgcaggtcatcatcatgaaccatcctggtcagattggaaatggatatgctcctgtgcttgattgccacacctctcacattgctgttaagtttgctgaactccaaactaagattgacaggcgatctggtaaggagcttgagaaggagcccaagtttttgaagaatggtgatgctggtattgttaagatgattccaaccaagcccatggtggtggagactttctctgagtacccacctcttggtcgttttgctgttagggatatgcgtcagactgttgctgttggagtcatcaagaatgtggacaagaaggatccaaccggtgccaaggtgaccaaagctgctgccaagaagggtgccaagtgaaccgataatggtaatgtttgttcaatttctagggaacattattattataaactatggcataactttattttctatactgttggttttgttggtctgttattttacacagtaagttgtgatactctgccttgtaagtttggtagccattcccagaactgggtactcgacaggcggtggcacaggagtaagttttcattcctttgtgaggttttccctttgaggcgctcagatttattctagcggctcaagagttttgtgttgtgtgtccttgtcgacaattataataaatatattctgaacttgtggtgct

SEQ ID NO: 917 - DNA, 1774 bp, Populus trichocarpa
cctatctaccttctcactctcacatttctttctctttactatcttttccagcggccagggttttagcatctctcttcagctcaaaactaagatttcataatgggtaaagagaagactcacatcaacatcgtggtcattggccatgttgactctggaaagtcgaccaccactggccacttgatttataagcttggaggtattgacaagcgtgtcatcgagaggttcgagaaggaagctgctgagatgaacaagaggtcattcaagtatgcctgggtgctcgacaagctcaaggctgagcgcgagcgtggaattaccattgatattgccttgtggaagtttgagaccaccaggtactactgcactgtcattgatgcccctggacatcgtgactttatcaagaacatgattactggaacttcccaggctgactgtgccgtgcttatcattgattccaccactggtggtttcgaagctggtatctccaaggatggccagacccgtgagcacgcactccttgccttcacccttggtgtgaagcaaatgatctgctgctgtaacaagatggacgccaccactccaaagtactccaaggcaaggtatgatgaaattgtcaaggaagtgtcctcctacttgaagaaggtcggctacaaccctgacaagattccctttgtcccaatttctggatttgagggtgacaacatgattgagaggtccaccaaccttgactggtacaagggcccaacactcctggatgccctggaccagatccaggagcccaagaggccctcagacaagcccctccgtctcccgcttcaggacgtgtacaagattggtggtatcggaactgtcccagtgggtcgtgttgaaactggtgtcatcaagcccggcatggttgtcacattcggtccaactggactgagtactgaagtcaagtctgttgagatgcaccacgaggctctcctagaggctcttcctggtgacaatgtcgggttcaatgttaagaatgtagctgttaaggatctgaagcgtggttatgtggcctcaaactccaaggacgatcctgccaaggaggctgccaacttcacctcccaagttatcatcatgaaccatcctggacagatcggaaacggttacgctccagtccttgactgccacacctgtcacattgctgtgaagtttgctgagatcctcaccaagattgacaggcggtctggtaaggaactggagaaggagcccaagttcctgaagaacggtgatgctggtatgatcaagatgattcccaccaagcccatggtggtggagactttctcagcgtatcctccacttggtcgttttgctgtgagggacatgcgccagaccgttgctgtgggagttatcaagaacgtggagaagaaggatccctctggtgctaaggtgaccaaatctgctgccaagaagggtgccaagtaatcattgtgttgtgcaattactggtttgtttcttgttaattgtccctgagctgtgtgtcatgagaattgtagttttattttgtggaatcttgttctaaaattttggagattgtatcatgtttctagattcattatcggctcgtgaaatttaggtctcgagcatttggacactaagaactccatgtcatgtttttgtttatgggcgttgaatttacattagttgtctgcccgcctgctcatatattcagtcttctttctagttttataccctttcctttctgtctgcttatattcagttgtcgtaaacttgtcgatctctttcctgt

SEQ ID NO: 918 - DNA, 1594 bp, Ambrosia trifida
aaccacttacatcaatcacaaagaaatctaaaaatgggtaaggaaaagattcatatcagcattgtcgtcattggtcatgtcgactccggtaagtcgaccacaactggtcatctcatctacaagttgggtgggattgataagagggtgatcgagaggtttgagaaagaagctgctgagatgaacaagaggtccttcaagtatgcatgggttcttgacaaactgaaggctgagcgtgaacgtggtaccaccattgatatcgctctgtggaagtttgagaccactaagtattactgcactgttattgatgctcccggacatcgtgatttcattaagaacatgattactggtacttcccaggctgattgtgctgttctgattattgactccaccactggtggttttgaagctggtatttccaaggatggtcagacccgtgaacacgctctgcttgccttcactcttggtgtgaagcaaatgatctgctgctgtaacaagatggatgcaaccactcccaagtactcaaaggcaagatatgatgaaattgtgaaggaagtgtcatcctacctgaagaaggtcggttacaacccagacaaaattccattcgtgcccatctctggatttgagggtgacaatatgattgagaggtctaccaaccttgactggtacaagggtccaacccttcttgaagctcttgaccagatcaacgagcctaagagaccctcagacaagccacttcgtctcccacttcaggacgtgtacaagatcggtggtattggaactgtgccagtgggacgtgttgagactggtgtgatcaagcctggtatggttgttacctttggaccatctgggttgaccactgaagttaagtctgttgagatgcaccatgaagctttacaggaggctctccctggtgacaacgttgggttcaatgtcaagaacgttgcggtcaaggatctgaaacgtggttacgttgcatccaactcaaaggatgaccctgctaagggtgctgcaagtttcacctcccaagtcatcatcatgaaccaccctggtcaaatcggaaacggttatgctccggttttggattgccacacatctcacattgccgtcaagttttctgagctgttgaccaagatcgacagacggtctggaaaagagctggagaaggagcccaaatttttaaagaatggtgatgctggtatggttaagatgcttccgacaaagcccatggttgttgagacctttgctgagtacccaccactcggtcggtttgctgttcgtgacatgcgtcagactgttgctgttggtgttatcaagagcgttgacaagaaggacccaactggagctaaggtgaccaaggctgcagtgaagaagggagctaaatgaaacggtttgagtggttttatattttatgaagtttttatcgtattttggaactattttcatatttggttaagaatttttggtaattggtctttctggtgcttgcactgctgtactctagcctcacttgtgaggatgggtggaggtattgagcaactttgtagttgcttgatgacggcggtgtaagttatccagaggccagcttttgttggtt

SEQ ID NO: 919 - DNA, 1620 bp, Arabidopsis lyrata
taaccatgggtaaagagaagtttcacatcaacatcgtggtcattggccacgtcgattctggtaaatcaaccaccactggacacttgatctacaagttgggaggtattgacaagcgtgtcattgagaggttcgagaaggaggctgctgagatgaacaagaggtccttcaagtacgcatgggttttggacaaacttaaggctgagagagagcgtggtatcaccattgacattgctctctggaagtttgagaccaccaagtactactgcacagtcattgatgctcctggtcatcgtgatttcatcaagaacatgatcactggtacctcccaggctgattgtgctgtccttatcattgactccaccactggtggttttgaggctggtatctccaaggatggtcagacccgtgagcatgctctccttgctttcacccttggtgtcaagcaaatgatctgctgttgtaacaagatggatgccaccacccccaagtactccaaggccaggtacgatgaaatcatcaaggaggtgtcttcctacttgaagaaggttggttacaaccccgacaaaatcccgtttgtgcccatctctggattcgagggagacaacatgattgagaggtccaccaaccttgactggtacaagggaccaactcttcttgaggctcttgaccagatcaacgagcccaagaggccatcagacaagccccttcgtctcccacttcaggatgtctacaagattggtggtattggaacggtgccagtgggacgtgttgagactggtatgatcaagcctggtatggtcgtgacctttgctcccacagggttgaccactgaggtcaagtctgttgagatgcaccacgagtctcttcttgaggcacttcccggtgacaatgttgggttcaatgttaagaatgttgccgtgaaggatcttaagagagggtacgtcgcctccaactcaaaggatgaccctgccaagggagcagccaacttcacctcccaggtcatcatcatgaaccaccctggtcagattggtaacggttacgcccctgtcctcgattgccacacctctcacattgcagtcaagttctctgagatcttgaccaagattgacaggcgttctggtaaggagattgagaaggagcccaagtttttgaagaatggggatgccggtatggttaagatgactccgaccaagcccatggttgtggagaccttctctgagtacccaccccttggacgttttgcggtgagggacatgaggcagactgttgcagtcggtgtcatcaagagtgttgacaagaaggacccaaccggagccaaggttaccaaggctgccgtcaagaagggtgcgaagtgaattcccagcctcaaaactatatccgcagatgaatccaaggactattttagttttttcactttagtttggtatttggtcgcttattacagcttcgtttcttctccgtcagagctcaattcccggaactgggttcttgatcggaggtggcggagttacttggcactcaagcgtcctgtttggttcttttgttttgttttttgattatgaacctttttaaagatttggttatatgatattgtgatattcccgcggatattatcttctc

SEQ ID NO: 920 - DNA, 1662 bp, Arabidopsis lyrata
tagggtgcgctctcatatttctcacactttcgtagccgcaagcctcctctcagattcttatttgcagctatgggtaaagagaagtttcacattaacattgtggtcattggccatgtcgactctggaaaatcgaccacaactggtcacttgatctacaagcttggtggtattgacaagcgtgtcatcgagaggttcgagaaggaagctgctgagatgaacaagaggtccttcaaatacgcatgggtgttggacaaacttaaggccgagcgtgagcgtggtatcaccatcgatattgctctctggaagttcgagaccaccaagtactactgcacagtcattgatgcccctggacatcgtgatttcatcaagaacatgattactggtacctcccaggctgattgtgctgttcttatcattgactccaccactggaggttttgaagctggtatctctaaggatggacagacccgtgagcacgctcttcttgctttcacccttggtgtcaagcagatgatttgttgctgtaacaagatggatgccactacccccaaatactccaaggccaggtacgatgaaattatcaaggaggtgtcttcatacctgaagaaggttggatacaaccctgacaaaatcccatttgttcccatctctggattcgagggagacaacatgattgagaggtccaccaaccttgactggtacaagggaccaactctccttgaggctcttgaccagatcaacgagcccaagaggccatcagacaagccccttcgtctcccacttcaggatgtctacaagattggtggtattggaacggtgccagtgggacgtgttgagactggtatgatcaagcctggtatggttgttacctttgctcccacagggttgaccactgaggttaagtctgttgagatgcaccacgagtctcttcttgaggcacttcccggtgacaatgttggattcaatgtcaagaatgttgctgtcaaggatctcaagagaggatacgttgcctctaactccaaggatgacccagctaagggtgctgccaacttcacctcccaggttatcatcatgaaccaccctggtcagattggtaacggttatgccccagttctcgattgccacacctctcacattgcagtcaagttctctgagatcttgaccaagattgacaggcgttctggtaaggagattgagaaggagcccaagtttttgaagaatggtgacgctggtatggttaagatgaccccaaccaagcccatggttgttgagactttctccgagtacccaccattgggacgttttgctgttagggacatgaggcagaccgtggctgttggagttatcaagagcgtggacaagaaggacccaactggagccaaggtcaccaaggctgcagtcaagaagggagctaaatgatgagactttcgttatgatggactctcttatggttttctttggttcttaaaactttgatggcatttgagcctttttttttctctttatttctgtgactttcttctctcttcctcctttttggatatctctgagactttttattatggttttcaattatgcagtttccggataattttgcttacaagtttatttagggtttgtgttacaaaattattgtctttgtcctttaatgccttgtttttt

SEQ ID NO: 921 - DNA, 1720 bp, Arabidopsis thaliana
caacgctataaataaaaccactctcgttgctgattccatttatcgttcttattgaccctagccgctacacacttttctgcgatatctctgagatttgttgacagtctctaaccatgggtaaagagaagtttcacatcaacattgtggtcattggccacgtcgattctggaaagtcgaccaccactgggcacttgatctacaagttgggtggtattgacaagcgtgtcattgagaggttcgagaaggaggctgctgagatgaacaagaggtccttcaagtacgcatgggttttggacaaacttaaggctgagcgtgagcgtggtatcaccattgacattgctctctggaagttcgagaccaccaagtactactgcactgtcattgatgctcctggccatcgtgatttcatcaagaacatgatcactggtacctcccaggctgattgtgctgtccttatcattgactccaccactggtggttttgaggctggtatctccaaggatggtcagacccgtgagcacgctctacttgctttcacccttggtgtcaagcagatgatctgctgttgtaacaagatggatgccactacccccaagtactccaaggccaggtacgatgaaatcatcaaggaggtgtcttcctacttgaagaaggttggttacaaccccgacaaaatcccatttgtgcccatctctggatttgagggtgacaacatgattgagaggtccaccaaccttgactggtacaagggaccaactctccttgaggctcttgaccagatcaacgagcccaagaggccgtcagacaagccccttcgtctcccacttcaggatgtctacaagattggtggtattggaacggtgccagtgggacgtgttgagactggtatgatcaagcctggtatggttgtgacctttgctcccacaggattgaccactgaggtcaagtctgttgagatgcaccacgagtctcttcttgaggcacttccaggtgacaacgttgggttcaatgttaagaatgttgctgtcaaggatcttaagagagggtacgtcgcatccaactccaaggatgaccctgccaagggtgctgctaacttcacctcccaggtcatcatcatgaaccaccctggtcagattggtaacggttacgccccagtcctggattgccacacctctcacattgcagtcaagttctctgagatcttgaccaagattgacaggcgttctggtaaggagattgagaaggagcccaagttcttgaagaatggtgatgctggtatggtgaagatgactccaaccaagcccatggttgtggagaccttctctgagtacccaccacttggacgtttcgctgtgagggacatgaggcagactgttgcagtcggtgttatcaagagtgttgacaagaaggacccaaccggagccaaggttaccaaggctgccgtcaagaagggtgcgaagtgaaccatcctcaaaactctatctgccgcaggtgaatcaaaggacagtgttagttttattacaatagtttggtatttggtcgcgtgtctgtgttcttgtttcgttttctccccgtcagagcgttgttctcgtaattgggttcttgatcggaggtggcggatctacacacacattcttcctgttttttgctttttatttgttttctcattttgaactgttttaaaatttctgttatatgaatgaatgttttccctgcggtt

SEQ ID NO: 922 - DNA, 1807 bp, Arabidopsis thaliana
ctataaatacaaacttgtttacccttccaatttatttctctacttgtccacttttctacagccgcatcatccttctcccttgtgcgatatcgtttgcgtgagatttgtctgaaaagtagctaaccatgggtaaagagaagtttcacatcaacattgtggtcattggccacgtcgattctggaaagtcgacaaccactggacacttgatctacaagttgggtggtattgacaagcgtgtgatcgagaggttcgagaaggaggctgctgagatgaacaagaggtccttcaagtacgcatgggtgttggacaaacttaaggctgagcgtgagcgtggtatcaccattgacattgctctctggaagttcgagaccaccaagtactactgcactgtcattgatgctcctggtcatcgtgatttcatcaagaacatgatcactggtacctcccaggctgattgtgctgtccttatcatcgactccaccactggtggttttgaggctggtatctccaaggatggtcagacccgtgagcacgctctccttgctttcacccttggtgtcaagcagatgatctgctgttgtaacaagatggatgccactacccccaagtactccaaggccaggtacgatgaaatcatcaaggaggtgtcttcctacttgaagaaggttggttacaaccccgacaaaatcccatttgtgcccatctctggatttgagggtgacaacatgattgagaggtccaccaaccttgactggtacaagggaccaactctccttgaggctcttgaccagatcaacgagcccaagaggccgtcagacaagccccttcgtctcccacttcaggatgtctacaagattggtggtattggaacggtgccagtgggacgtgttgagactggtatgatcaagcctggtatggttgtgacctttgctcccacaggattgaccactgaggtcaagtctgttgagatgcaccacgagtctcttcttgaggcacttccaggtgacaacgttgggttcaatgttaagaatgttgccgtgaaggatcttaagagagggtacgtcgcctccaactccaaggatgaccctgccaagggtgctgctaacttcacctcccaggtcatcatcatgaaccaccctggtcagattggtaacggttacgccccagtcttggattgccacacctctcacattgcagtcaagttctctgagatcttgaccaagattgacaggcgttctggtaaggagattgagaaggagcccaaattcttgaagaatggtgatgctggtatggtgaagatgactccaaccaagcccatggttgtggagaccttctctgagtacccaccacttggacgtttcgctgttagggacatgaggcagactgttgcagtcggtgttatcaagagtgttgacaagaaggacccaaccggagccaaggttaccaaggctgcagttaagaagggtgcaaagtgaactcgaatcctcaaaactctatccgcagatgaatcaaaaaacaatattagtttctttactttagtttggtatttggtcgcgtgttatagcttcgtttcttctccatcggaactctgttcccggaactgggttcttgatcggaggtggcggagctactttgcacctattttgcttttgaattgttatcaattttgaacctatttggagattcggttatatgatgtgattttccgaggatattctctctttttttgttgcgtgtatcacattcgaattcagtctcttggataacttgtggaaaaacttataacttcaagaaaaaccttataaac

SEQ ID NO: 923 - DNA, 1869 bp, Arabidopsis thaliana
gattcaccactataaataaactcgaatcccaaacatagctttattccttgcttcatttttcgtcaccctagccgctttactctcttgcgatatctctgagatttgtttgacagtctctaaccatgggtaaagagaagtttcacatcaacattgtggtcattggccacgtcgattctggaaagtcgaccaccactggacacttgatctacaagttgggtggtattgacaagcgtgtcattgagaggttcgagaaggaggctgctgagatgaacaagaggtccttcaagtacgcatgggttttggacaaacttaaggctgagcgtgagcgtggtatcaccattgacattgctctctggaagttcgagaccaccaagtactactgcactgtcattgatgctcctggccatcgtgatttcatcaagaacatgatcactggtacctcccaggctgattgtgctgtccttatcattgactccaccactggtggttttgaggctggtatctccaaggatggtcagacccgtgagcacgctctacttgctttcacccttggtgtcaagcagatgatctgctgttgtaacaagatggatgccactacccccaagtactccaaggccaggtacgatgaaatcatcaaggaggtgtcttcctacttgaagaaggttggttacaaccccgacaaaatcccatttgtgcccatctctggatttgagggtgacaacatgattgagaggtccaccaaccttgactggtacaagggaccaactctccttgaggctcttgaccagatcaacgagcccaagaggccgtcagacaagccccttcgtctcccacttcaggatgtctacaagattggtggtattggaacggtgccagtgggacgtgttgagactggtatgatcaagcctggtatggttgtgacctttgctcccacaggattgaccactgaggtcaagtctgttgagatgcaccacgagtctcttcttgaggcacttccaggtgacaacgttgggttcaatgttaagaatgttgctgtcaaggatcttaagagagggtacgtcgcatccaactccaaggatgaccctgccaagggtgctgctaacttcacctcccaggtcatcatcatgaaccaccctggtcagattggtaacggttacgccccagtcctggattgccacacctctcacattgcagtcaagttctctgagatcttgaccaagattgacaggcgttctggtaaggagattgagaaggagcctaaattcttgaagaatggtgatgctggtatggtgaagatgactccaaccaagcccatggttgtggagaccttctctgagtacccaccacttggacgtttcgctgtgagggacatgaggcagactgttgcagtcggtgttatcaagagtgttgacaagaaggacccaactggagccaaggttaccaaggctgcagtcaagaagggtgccaagtgaactctgaacatcaaaactctttccgctgatgaaatgaaggactattttagtttctttactttagtagtttggtatttggttggttgtttgtgttaccgcttcgtttattctccgtcggagctcaattctcggaattgggttcttgatcggaggtggcggaggtacttggcactcgagcttcctgtttatttcttttgttttgtgttatgattttgaacctttttggatattcggttatatgatatttgtgtcattcctgcggatattatcttatcttatcaacttaagtctgtttttcttctctaaaattcaacgatcagcctctgaagtttcttacatggtaaaattgtaatctagaactttaaacaacattggagaaacaagtctatatcagttt

SEQ ID NO: 924 - DNA, 1679 bp, Arabidopsis thaliana
tagggtgcgctctcatatttctcacattttcgtagccgcaagactcctttcagattcttacttgcagctatgggtaaagagaagtttcacattaacattgtggtcattggtcatgttgattctggaaaatcgaccacaactggtcacttgatctataagcttggtggtattgacaagcgtgtcatcgagaggttcgagaaggaggctgctgagatgaacaagaggtccttcaagtacgcatgggtgttggacaaacttaaggccgagcgtgagcgtggtattaccatcgatattgctctatggaagttcgagaccaccaagtactactgcacagtcattgatgccccaggacatcgtgatttcatcaagaacatgattactggtacctcccaggctgattgtgctgttcttatcattgactccaccactggaggttttgaggctggtatctctaaggatggtcagacccgtgagcacgctcttcttgctttcacccttggtgtcaagcagatgatttgctgttgtaacaagatggatgccaccacccccaaatactccaaggctaggtacgatgaaatcatcaaggaggtgtcttcatacctgaagaaggtcggatacaaccctgacaaaatcccatttgtgccaatctctggattcgagggagacaacatgattgagaggtcaaccaaccttgactggtacaagggaccaactcttcttgaggctcttgaccagatcaacgagcccaagaggccatcagacaagccccttcgtcttccacttcaggatgtctacaagattggtggtattggaacggtgccagtgggacgtgttgagactggtatgatcaagcctggtatggttgttacctttgctcccacagggttgaccactgaggttaagtctgttgagatgcaccacgagtctcttcttgaggcacttcccggtgacaatgttggattcaatgtcaagaatgttgctgtcaaggatcttaagagaggatacgttgcctctaactccaaggatgatccagctaagggtgccgccaacttcacctcccaggtcatcatcatgaaccaccctggtcagattggtaacggttacgccccagttctcgattgccacacctctcacattgcagtcaagttctctgagatcttgaccaagattgacaggcgttctggtaaggagattgagaaggagcccaagtttttgaagaatggtgacgctggtatggttaagatgaccccaaccaagcccatggttgttgagactttctccgagtacccacctttgggacgtttcgctgttagggacatgaggcagaccgttgctgttggtgttattaagagcgtggacaagaaggacccaactggagccaaggtcaccaaggctgcagtgaagaagggtgccaaatgatgagactttcgttatgatcgactctcttatggttttctttggttcttaaaactttgatggcgtttgagcctttttcttttttctctttatttctgtgactttctctctccctcctttttggatatctctgagactttttattatggttttcaattatgcagtttccggataattttgcttgaaacttatttaggagttgtgttacaaagttgctgtctttctttgttcttgtttaaacaatcattcagagatcaacccaa

SEQ ID NO: 925 - DNA, 1858 bp, Theobroma cacao
ggaggacccttgaaatccaacggcgaggagagaaaccctaaactcaaaacaagaactatgtcggctaaaactcgctttaaagccacagctcttcctccagtctgcgttcctcaacctctctttcgatcaatctccaaggcggctcttccttgtttcttcatttctttcgacaaggtttgtttcccagtgaatcagaatgggtaaggaaaaggttcacattagcatcgtggtcatcggccacgtcgattctggtaagtcgaccaccaccggtcacttgatctacaagctcggtggtatcgacaagcgtgtgatcgagaggttcgagaaggaagctgctgagatgaacaagaggtcgttcaagtatgcttgggtgcttgacaagctcaaggccgagcgtgagcgtggtattaccatcgatatcgccttgtggaagttcgagaccaccaagtactactgcacagtgatcgatgctcctggacatcgtgactttatcaagaacatgatcactggtacctcacaggctgactgtgctgtcttgattattgattccaccactggtggtttcgaggctggtatttccaaggacggtcagactcgtgagcacgctttgcttgcctttacccttggtgtcaagcaaatgatttgctgctgcaacaagatggatgccactacccctaagtactccaaggctcggtatgatgaaattgtgaaggaagtctcttcttacttgaagaaggtgggttacaacccagataaaattccatttgttcccatttccggtttcgagggtgacaacatgattgaaaggtctaccaaccttgactggtacaagggccctactcttcttgaggctcttgaccagatcaatgagcccaagaggccctccgacaagcccctccgtctcccacttcaggacgtgtacaagattggtggtattggaactgtcccagtcggtcgtgttgagactggtatcttgaagcctggtatggttgtgacctttggtccttctggtcttaccactgaagttaagtctgttgagatgcaccacgaagctctccaggaggctctccctggtgacaatgtagggttcaatgtgaagaatgttgctgttaaggatctcaagcgtggtttcgttgcttctaactccaaggatgatcctgccaaggaggctgccagcttcacctctcaggtcatcatcatgaaccaccccggccagattggtaatggttatgccccagtcctcgactgtcacacctcccacattgctgtcaagttttctgagttgctgaccaagattgaccggcgatctggcaaggagcttgagaaggaacccaagttcttgaagaatggtgatgccggtatggtgaagatggttcccaccaagcccatggttgtggagacattctctgagtacccaccattgggacgttttgctgtgagggacatgcggcagactgtggctgttggtgttattaagaatgttgagaagaaggatccaacaggtgccaaggtcaccaagtctgcagctaagaagggtggaaagtgaacaacgcaacagctctattctcttggcgtttgggcgcaaggagtgttctatcctggttatagttttaagaaactggttattctcagtctttcaaaagttttgcatgtcgttatatgtattttcttgcctttgaatttgagtagcgattttcagaattgggtacttgataggcggtggcattcttagtactttcgttttacctgttttgtggaggattaaaaattgcgatgctttggtttgcctaagcatctttagacgttttgtgtcagtttttgcggaactatcattaatattttgttctgtttctatgcc

SEQ ID NO: 926 - DNA, 1917 bp, Ricinus communis
gaaaatgaactacaagaaaatagaagcggaaaaactgacatttcttaaaaagccaaagtaactccagtaaggaaccctagttctatttgctagtataaatacaagcatctctttctaggtatttttcctcttactactcccactctattactgctgttagggtttataccggttcctgcaggcgcctcaactatcctcttttctggtcaatttagataatctataatgggtaaggagaagattcacatcagcatcgtggtcattggacatgtcgactctggcaagtccaccaccactggacatctcatctacaagctcggaggtattgacaagcgtgtgattgagaggttcgagaaggaggctgctgagatgaacaagaggtcattcaagtatgcttgggtgctggacaagcttaaggctgagcgtgagcgtggtatcaccattgatattgccttgtggaaattcgagaccaccaagtactactgtactgtcattgatgctcctgggcatcgtgactttattaagaacatgattactggtacttcgcaggctgactgtgctgttcttatcattgattccactactggtggttttgaagctggtatttctaaggatgggcagacccgtgagcatgctcttcttgctttcacccttggtgtcaagcaaatgatttgctgctgcaacaagatggacgccactactcccaagtactctaaggccaggtacgatgaaattgtcaaggaagtttcatcctatcttaagaaggtgggatacaaccccgacaaaattcctttcgttcccatctctgggttcgaaggtgacaatatgatcgagaggtccaccaacctggactggtacaagggtccaaccctacttgaagctcttgaccagatcaatgagccaaagaggccctcagacaaacctctccgtctcccacttcaagacgtatacaaaattggtggtattggaactgttcctgtgggtcgtgtagagactggtgtcctcaagcctggtatggtggtgacctttggacccagtggattgacaactgaaattaagtcagttgagatgcatcacgaggctctccaggaggccctccccggcgacaatgttggatttaacgtgaagaatgttgctgtgaaagatttgaagagaggttatgttgcatcaaactccaaggatgatcctgccaaggaagctgccaacttcacatcccaggttatcatcatgaaccaccctggccagattggaaatggatatgctccagttttggactgccacacctcccacattgctgtgaagtttgctgagatcttgaccaagatcgatcgccgatctggcaaggagcttgagaaggagcctaagttcttgaagaatggtgatgctgggtttgttaagatgattccaaccaagcccatggttgtcgagaccttctctgagtaccctccgttgggacgttttgctgtgagggacatgcgtcagactgttgctgtgggtgttatcaagagcgtggagaagaaggacccgagtggtgctaaggttacgaagtctgctgccaagaagggagggaaatgaatattgcggtccacaaattcaattgatgctattaagaacattttatgctattattccagtcctttaaaatgtttaattagtaattatattttgagttttgggtgttcattttccagttgcagtgcccagcactgggtgcttgacaggcggtggagacacatttatttaagaatttatggcatggttttgtaattttgttgtaactgcttgagtttgacagttgatactgaatctctcatttatactcgttttcctatttcttctagcctctcttttctcttttgtattcgatattggccattggtttctttcattaaaattatctgttgataattgttgctt

SEQ ID NO: 927 - DNA, 1705 bp, Cirsium arvense
attttcctacatctatcttgagagcttgtctgcagatatttcgctaagatgggtaaggaaaagattcatatcagcattgttgtcattggacatgtcgactccggcaagtctacaaccactggtcacttgatctacaagcttggaggtattgacaagcgtgtgatcgaacgtttcgagaaggaagcagctgagatgaacaaaaggtctttcaaatacgcatgggtgcttgacaaacttaaggccgagcgcgaacgtggtattaccattgatattgccttgtggaagtttgagactaccaagtactactgcacagtcattgatgcccctggacacagggatttcattaagaacatgattactggtacctctcaggcagattgtgccgtccttattatcgactcaaccactggaggttttgaggccggtatttccaaggatggtcagacccgtgagcacgctcttcttgctttcacccttggtgtcaagcaaatgatttgctgttgtaacaagatggatgccaccacaccaaaatactccaagtctaggtatgaggaaattgtcaaggaagtttcttcatacttgaagaaggttggatacaacccagacaaaatcccatttgtgccaatctctggtttcgaaggagacaacatgattgagaggtcgaccaaccttgactggtacaagggtccaacccttcttgatgctcttgaccagatcaacgagcccaagagaccatcagacaagcccctccgtctaccacttcaggatgtttacaagattggtggtattggaactgtgcctgttggacgtgttgaaactggtgtgatcaagcctggtatggttgttacctttggaccatctgggttgaccactgaagttaagtcagttgagatgcaccacgaagctcttcttgaggctctccctggtgacaatgttggattcaatgttaagaatgttgctgtgaaggatcttaagcgtgggtatgtcgcatccaactccaaggatgacccagctaaaggtgctgctagtttcacctctcaggttatcatcatgaaccaccctggtcagatcggaaatggttatgcaccagttcttgattgccacacctcccacattgctgtcaagttccaagaactattgaccaagatcgacagacgatcaggaaaagaaattgagaaggagcctaagttcttgaagaatggagatgctggtatggttaagatgattcccaccaagcccatggttgttgagactttttcagagtacccacctcttggaaggtttgctgtgagagacatgcgtcagacggtggctgttggagttatcaagagtgttgacaagaaggatccaacgggagctaaggtgaccaaggccgcagtgaagaagggagccaagtgatatgatgaaagtgattgtgttttgattattatggtgtttttatgttttctgtcgtcttttcatttactagttttgaagaaccttattacattttgttgaagagttttggtattgcagacttttgttgtgggttaaatttatagtggtctaccgcaatgagtttgttgttggagtcggtaaaacaatttcatatctgttatccaacctttttattttacatttcctcatatttatttttattgctcctgttctcttttgtagttcttctgtttgcaattgcaggtattactatcttggagttggtaag

SEQ ID NO: 928 - DNA, 1513 bp, Cleome spinosa
tcttgacaagtagtcatgggtaaggaaaaggttcacatcaacattgtggttattggacatgtcgactctggaaaatcgaccaccactggtcacttgatctacaagttggggggtatcgacaagcgtgtgatcgagaggtttgagaaggaagctgctgagatgaacaagaggtccttcaagtacgcctgggtgttggacaagctcaaggctgagcgtgagcgtggtatcaccattgatatagccctgtggaagttcgagaccaccaagtactactgcactgtcatcgatgctcctggacaccgtgactttatcaagaacatgatcactggtacctcccaggctgactgtgctgtcctcatcattgactccaccaccggtggttttgaggccggtatctccaaggacggtcagacccgtgagcacgccttgcttgctttcaccctcggtgtcaagcagatgatctgctgctgcaacaagatggatgccaccacccccaagtactccaaggctaggtacgatgaaatcgtgaaggaagtctcttcctacctgaagaaggttggttacaacccggacaagatccccttcgtccccatctctggttttgagggtgacaacatgattgagaggtccaccaacctcgactggtacaagggtccgacccttctcgaggctcttgaccagatcaacgagcccaagaggccttccgacaagcccctacgtctccctctccaggatgtctacaagatcggtggtatcggaactgtccctgtgggtcgtgtcgagactggtgtactcaagcccggtatgttagtgacctttgctccctctggactgaccactgaggtcaagtctgtcgagatgcaccacgaggctctccaggaagctctccctggtgacaatgtagggttcaacgtcaagaacgttgcagtgaaggatctcaagcgtggatacgtcgcatcaaactcaaaggatgacccggccaaggaagcagccagcttcacctcacaggtcatcatcatgaaccaccccggtcagatcggtaacggatatgccccagtcctcgactgccacacctcccacatcgccgtcaaatttgcagagatattgacaaagatcgacaggcgttctggtaaggagctggagaaggagcccaagttcttgaagaacggagatgcaggaatggttaagatggttccgaccaagcccatggtggtggagaccttctccgagtacccaccgcttggacgatttgctgtccgtgacatgaggcagaccgttgcggttggtgtcatcaagaacgtcgagaagaaggacccgacgggtgctaaggtcaccaaggccgcagccaagaagggtgccaagtgagagaagtttattgccgtttgaaagagtcggttttcgccgttgagttgttaggccgtactctctgtttttgtgtgttgctggaccgatgcagttttgcgaactatgtcatggttatattctgttaccttttttaaaatatttacatctt

SEQ ID NO: 929 - DNA, 1997 bp, Coffea canephora
cgaggtgtgaaaaaatgtaaaataaacaaatcaaacaaaattcctgactcaccgagacaccgaccctaaatgggctgcgttttgctcgggtctccattgcctcctctccaagaaacgccgccattaactaaaatacaagggtattttcgtcaaacagggcccaaagaagccctagaccaggctcgcatcctttcttgcctataaaaacgcaaagaaaacccctcaaaccctgccttccattttgtttcccttaattttttcgactctctgcggcagctctctctcgcctcctgtcttcgagaagttttcagatttttagcacttcagaatgggtaaggaaaaggttcatatcaacattgtggtcattggtcacgtcgactctggaaagtcgaccactactggtcacttgatctacaagcttggaggaattgacaagcgtgtgattgagaggtttgagaaagaagctgctgaaatgaacaagaggtcattcaagtatgcttgggtgcttgacaagcttaaggctgagcgtgaacgtggtatcaccattgatattgccttgtggaagtttgagaccacaaagtactactgcactgtcattgatgctcctggacatcgtgactttatcaagaacatgattactggtacttctcaggctgattgtgctgtccttatcattgactccaccactggtggttttgaagctggtatttctaaggacggtcagacccgcgagcatgctttgcttgctttcacccttggtgtcaagcaaatgatttgctgctgcaacaagatggatgccaccactcccaagtactccaaggcacgttatgatgaaattgtgaaggaagtgtcttcctacttgaagaaggtcggatacaatcctgacaaaataaactttgtccctatctctggatttgagggagacaacatgattgagaggtctaccaatcttgactggtacaagggcccaaccctccttgaggctcttgaccagatccaggagcccaagaggccttcagacaagccactccgtctcccacttcaggatgtgtacaagattggtggcattggaaccgtccctgtgggacgtgttgaaacaggtgttctcaagcctggtatggttgtgacctttggtccaactggtctgacaactgaagttaagtctgttgagatgcaccatgaagctcttcaagaggcacttcctggtgacaatgttggtttcaatgtgaagaacgttgctgtgaaggatctcaagcgtggttttgttgcttccaactccaaggatgacccagctaagggagcttccagctttacctcccaggtcatcatcatgaaccacccaggccaaattggcaatggatatgcccctgtccttgattgccacacttctcacattgctgtcaagttctctgagatcgtgaccaagattgacaggcgatctggcaaggagcttgagaaggagcccaagttcttgaagaatggtgatgctggttttgtcaagatgattcccaccaagcccatggttgttgaaactttctcagagtaccctccccttggtcgttttgctgttagggacatgcgacaaactgttgctgttggtgttatcaaggctgttgacaagaaggatcctactggtgccaaggtcaccaaggctgctgctaagaagggtgccaaatgaaccgtgcaggttcatgctggttggccctcaaatgaaatctactactacaataaattgtgtcatgcaaacttttcaagtgctgcttcagtagttttgtgtatgtgttatttgttgtgtcgtagttttctgccctgtatgctggttagcctctgtcagaattgggtgcttgacagacggtggcagatcctacagaactgagtctttgtgatttctgcttttggatgtttgtggtttgaggtgctttggaatgtattactataattccaggcagctcaagagttttgtggtttgccttccaaggataatatactactataat

SEQ ID NO: 930 - DNA, 1812 bp, Gossypium hirsutum
ctcttcctccgagccgttaggttgtatcgttttagttttaagtctcttattttttgaaagttcctagttaatactacataatgggtaaggagaaggttcacatcaacattgttgtcattggccatgttgactctgggaagtcaaccacaacgggtcacttgatctacaagcttggaggtattgacaagcgtgtgatcgagagattcgagaaggaagctgctgagatgaacaaaaggtcattcaagtatgcctgggtgctcgacaagttgaaggctgagcgtgagcgcggtataaccattgatattgccttgtggaagtttgagacaaccaagtactactgcactgtcattgatgctcctggacatcgcgacttcattaagaatatgattacgggtacttctcaagctgactgtgctgtccttatcattgactccacaactggaggttttgaagctggtatttccaaggatgggcagacccgtgagcatgctctccttgccttcactcttggtgtcaagcaaatgatttgctgctgcaacaagatggatgccacaacccccaagtactcaaaggcaaggtatgatgaaattgttaaggaagtttcttcctacctgaagaaggttggttacaaccctgagaagattccattcgtccccatctctggttttgagggtgacaacatgattgagaggtccaccaacctcgattggtacaagggtccaaccctccttgaggctcttgaccagatcaatgagcccaagagaccctccgacaagcccctccgtctcccacttcaggatgtctacaagatcggtggtattggaactgtcccggtgggtcgtgttgaaactggtacccttaagcctggaatggttgttacattcggaccttctggattgaccactgaagttaagtctgttgagatgcatcatgaagctcttcaagaggctcttcctggtgacaatgttgggttcaacgtgaagaatgttgctgtcaaggatctcaagcgtggatttgttgcctccaactccaaggatgatcctgccaaggaggcagccaacttcacctcccaagttatcatcatgaaccacccagggcagattggaaatggctatgcaccggtcctagattgccacacctcccatattgctgtcaagtttgcagagctcttgaccaagattgacaggcgatctggtaaggagcttgagaaggagcctaagttcttgaagaatggtgatgctggtatgattaagatggttccgaccaagcccatggttgtcgaaaccttctccgcgtaccctccacttggacgttttgccgttagggacatgagacagactgttgctgttggtgtgatcaagagtgtggagaagaaggacccatctggagccaaggtgaccaagtctgccgccaagaagggtggcaagtgaactttggtttagtcagtttttgttttgtgagatccgtaattaattccttgagtatttggtttttgctttttagacgatgagattttcagacaacatggttgtgtgttgaagtttttacttgagagttaacttgcaactgatgtttcactacagataagaaaatgagtggacttcaagcttctatcagaacgcatccttctttagcctcagagcttttgtttcgcttcttttagtgatagaaaaacatccttaaaaagaaaaattcaatcttcataaatggctgttcttaccgatttcaaagcgcttggtgtttcatcatcatagatggttattcaccatggatttgcaggaaacattaatgatgaggataaatgggtagttg

SEQ ID NO: 931 - DNA, 2283 bp, Gossypium hirsutum
atgggtaaggagaaggttcacatcaacattgttgtcattggccatgtcgactctgggaagtcaaccacaacgggtcacttgatctacaagcttggaggtattgacaagcgtgtgattgagaggttcgagaaggaagctgctgagatgaacaaaaggtcattcaagtatgcctgggtgcttgataagttgaaggctgagcgtgagcgtggtatcaccattgatattgccttgtggaagtttgagacaaccaagtactactgcactgtcattgatgctcctggacatcgcgacttcattaagaatatgattacgggtacttctcaagctgactgtgctgtccttatcattgactccacaactggaggttttgaagctggtatttccaaggatgggcagacccgtgagcatgctctccttgccttcactcttggtgtcaagcaaatgatttgctgctgcaacaagatggatgccacaacccccaagtactcaaaggcaaggtatgatgaaattgttaaggaagtttcttcctacctgaagaaggttggttacaaccctgagaagattccattcgtccccatctctggttttgagggtgacaacatgattgagaggtccaccaacctcgattggtacaagggtccaaccctccttgaggctcttgaccagatcaatgagcccaagagaccctctgacaagcccctccgtctcccacttcaggatgtctacaagatcggtggtattggaactgtccctgtgggtcgtgttgaaaccggtacccttaagcctggaatggttgttacattcggaccttctggattgaccactgaagttaagtctgttgagatgcatcatgaagctcttcaagaggctcttcctggtgacaatgttgggttcaacgtgaagaatgttgctgtcaaggatctcaagcgtggatttgttgcctccaactccaaggatgatcctgccaaggaggcagccaacttcacctcccaagttatcatcatgaaccacccagggcagattggaaatggctatgcaccggtcctagattgccacacctcccatattgctgtcaagtttgcagagctcttgaccaagattgacaggcgatctggtaaggagcttgagaaggagcctaagttcttgaagaatggtgatgctggtatgattaagatggttccgaccaagcccatggttgtcgaaaccttctccgcgtaccctccacttggacgttttgccgttagggacatgagacagactgttgctgttggtgtgatcaagagtgtggagaagaaggacccatctggagccaaggtgaccaagtctgccgccaagaagggtggcaagtgaactttggtttagtcagtttttgttttgtgagatccgtaattaattccttgagtatttggtttttgctttttagacgatgagattttcagacaacatggttgtgtgttgaagtttttacttgagagttaacttgcaactgatgtttcactacagataagaaaatgagtggacttcaagcttctatcacaaaaaaaaaaatcggcattgtaaaagcaaagaaaacatatatatgtcaaacacacaaatagctttgattattcaaacactgttcacctccactgtggcgttgtaataggagctttcaacacaactccaacttaacctatacacccaaaatgctacaaagctttcaccacttcaaactataatagtaacataaatatcaaagggctggcaacaacaacaacaaacaaccgggacagagccatgacggtcaacagcttctaccaaatgatttctactcgtagatccaagggtgaaggctgctctgccagttaacagggcattcagggaaccaaagggcgatttccttccttgcactctcgacggaatcactcccatggatcacattcctcccaatgtcaattgcaaagtcaccacggattgttcccggagcagattcagctgggtttgtggctccgataatcttgcgacctgtggtaacaacattcttaccttcccaaatcatagcaacgaccggaccggagataatgtactctacgagcccattaaagaagggttttgcagacaggtcagcatagtgcttctcggcaaaagatcgatccacactgatgagcttcaaccctttcaaattgaagcctttcttctcaaatctgccgatgatttcaccaaccaggcctctttggaccccatcaggcttgatcatgatgaatgtttgctccatcttctcttcttttctagtctgtctgctct

SEQ ID NO: 932 - DNA, 1350 bp, Cucumis sativus
atggggaaagagaagactcacattaacattgtggtcattggccatgtcgactctgggaaatctaccaccaccgggcatttaatctataagcttggtggtattgacaagcgtgtcattgaaaggtttgagaaggaagctgctgagatgaacaagaggtccttcaagtatgcttgggtgttggacaagcttaaggctgaacgtgaacgtggtattaccattgatattgctttgtggaagtttgaaaccaccaaatactactgcaccgttattgatgctcctggacatcgtgacttcattaagaacatgattactggtacctcacaagctgattgtgctgttctcattattgattccactactggtggttttgaagctggtatttctaaggatggtcaaacacgtgagcatgctttgctcgcgtttactctcggtgtcaagcagatgatttgctgctgcaacaagatggatgccaccacccccaagtactccaaggcaaggtatgatgaaattgtcaaggaagtttcttcctacctcaaaaaggtcggatacaaccctgacaaaatcccctttgttcccatctctggttttgaaggagacaacatgattgagaggtcgaccaaccttgactggtacaagggtccaactctccttgaggctcttgacttgatccaggagcccaagaggccctcagacaagccactccgtcttccacttcaggatgtgtacaagatcggtggtattggaactgtaccagttggtcgtgttgagactggtgtcctcaaacctggaatggtggtcacttttggcccttctggattgaccactgaagtcaagtctgttgagatgcaccacgaatctctacccgaggccgttcctggtgacaatgtgggattcaatgtgaagaatgttgctgtaaaggatctcaagcgtggtttcgtcgcttccaactcaaaggatgaccctgccagggaggctgccaacttcacttctcaagtcattatcatgaaccaccctggacaaattggcaatggttatgctccagtgcttgattgccacacctctcatattgcggtgaaatttgccgagattctaaccaaaatcgacaggcgatcaggtaaggaacttgagaaggaacccaagttcttaaagaatggtgatgcaggtatgattaagatgattcccaccaaacctatggtggtggaaaccttctctcagtaccctcctcttggacgtttcgccgtaagagacatgagacagacagttgctgttggtgtcatcaagtccgtcgaaaagaaggatccaagtggtgctaaggttactaaatccgcagccaagaagggtggaaagtga

SEQ ID NO: 933 - DNA, 1544 bp, Fraxinus spp
cggccgggggcctcgctcttgatagaaatcagaacgctctctgcagtcggcgggtgagagatttttctatactacattcgaagctttctttttaaaagtaaaacatgggtaaggaaaagattcacattagcattgtggtcattggccacgtcgactctggaaagtcaaccaccactggccatttgatctacaagcttggtggtattgacaaacgtgttattgaaaggttcgagaaggaggctgctgagatgaacaagaggtcattcaagtatgcctgggtgctcgacaagctcaaggctgagcgtgaacgtggtattaccattgatattgccttgtggaaattcgagaccaccaaatattactgcacagttatcgatgctccaggacatcgtgactttatcaagaacatgattactggtacttcacaggctgactgtgctgtccttatcattgactctaccactggtggtttcgaagctggtatttccaaggatggtcagacccgtgagcatgcgttgcttgccttcacccttggtgtcaagcaaatgatttgctgctgcaacaagatggatgccactacgcctaaatactcaaagtctaggtatgatgaaattgtgaaggaagtgtcatcctacatcaagaaggtcggatacaaccctgacaagatcccatttgtccccatctctggttttgagggtgacaacatgattgagaggtccaccaaccttgattggtacaagggcccaaccctcctcgatgctcttgaccagattcaggagcccaagagaccctcagacaagcctctccgtctcccactgcaggatgtctacaagattggtggtattggaactgtccccgttggccgtgttgagacgggtgttatcaagcctggcatggttgtcaccttcggcccaactggtttgacaactgaagtcaagtctgttgagatgcaccatgaggccctccaggaggctctccctggtgacaatgttgggttcaacgtcaagaatgttgcagtgaaggatctcaagcgtggttatgttgcctccaactccaaggatgaccctgccaagggtgctgccagcttcacttcccaggtcatcatcatgaaccaccctggtcagatcggaaatggatatgccccagtgctcgactgccacacatcccacattgctgttaagtttgctgagctccagaccaagatcgacaggcgttctggtaaggagctggagaaggagcccaaattcttgaagaacggtgatgctggtcttgttaagatgattcccaccaagcccatggttgtggagacttttgcagagtatccacctcttggtcgttttgctgtgagggatatgcgccagacagttgcagttggtgtgatcaagagcgtggataagaaggatccaaccggtgcaaaggtcaccaaagctgcggctaagaagggtgccaagtgaagaaatttcgtgttattggttaattacattatctattttcaaagacatcttttgctagttttgattattatatggtttttcctgataatc

SEQ ID NO: 934 - DNA, 1637 bp, Olea europaea
caatctaaactctttctctctctgcagtcggcggcgagagatctgtctacactaccttcaaagtcttctttctaagagttcaacatgggaaaggaaaaggttcacattaacatcgtggttattggtcatgtcgactctggaaagtccaccaccactggccatttgatctacaagcttggtggtattgacaagcgtgtcattgaaaggtttgagaaggaggctgctgagatgaacaagaggtcattcaagtatgcctgggtgcttgacaagctcaaggctgagcgtgaacgtggtatcaccattgatattgccttgtggaaattcgagaccaccaagtattactgcacggttattgatgctccaggacatcgtgactttatcaaaaacatgattactggtacttcacaggctgactgcgccgtccttatcattgactctaccactggtggcttcgaagctggtatttccaaggatggtcagacccgtgagcatgctttacttgccttcacccttggtgtcaagcaaatgatttgctgctgcaacaagatggatgccaccacacctaaatactcaaagcccaggtatgatgaaattgtgaaggaagtgtcatcctacatcaagaaggttggatacaaccctgacaagatcccatttgttcccatctctggttttgagggtgacaacatgattgagaggtctaccaaccttgattggtacaagggcccaaccctcctcgaagctcttgaccagattctggagccaaagaggccctcagacaagcccctccgtctcccacttcaggacgtctacaagattggtggtattggaactgttcctgttggccgtgtggagactggtgttctcaagcctggtatggttgtcacctttggcccatctggtttgacaactgaggtcaagtccgttgagatgcaccatgaagcccttcaggaggctcttcctggtgacaatgttgggttcaacgtcaagaatgttgccgtcaaggatctcaagcgtggttacgttgcttccaactccaaggatgaccctgccaagggtgctgccagcttcacttcccaggtcatcatcatgaaccaccctggtcagatcggaaatggatatgccccagtgctcgactgccacacatcccacattgctgttaagtttgctgagctccagaccaagatcgacaggcgttctggtaaggagctggagaaggagcccaagttcttgaagaacggtgatgctggtcttgttaagatgattcccaccaagcccatggttgtggagactttcgcagagtacccacctcttggacggtttgctgtgagggatatgcgccagacagttgctgttggtgtgatcaagagcgtggacaagaaggatccaaccggtgccaaggtcaccaaagctgctgctaagaagggtgccaagtgaagaaatttcatgttatcgattattcacattagctattttcaagacatcttttgcatttttgattattatggtttttcctgatgctctatctggattgccatttcttgttttggtttatcatgagttgtaagacctatttcaacatcttttaatttatgtttttcttccgaagtcatagtggcatttgaattttagctggatac

SEQ ID NO: 935 - DNA, 1867 bp, Populus trichocarpa
cacccccccatttgctactctctgcctatcatctctttcgcggctaaggtttaagcgaaactttctgcagtttaacactaagacttaagcatgggtaaagagaagactcacatcaacatcgtggtcattggccatgtggactctggaaagtcaaccaccactggccacttgatctacaagcttggaggtattgacaagcgtgtcattgagaggttcgagaaggaagctgctgagatgaacaagaggtcattcaagtatgcctgggtgctcgacaagctcaaggctgagcgcgagcgtggaattaccattgatattgccctgtggaagtttgagaccaccaggtactactgcactgtcattgatgcccctggacatcgtgactttatcaagaacatgattactggaacttcccaggctgactgtgccgtgcttatcattgattccaccactggtggtttcgaagctggtatctccaaggatggccagacccgtgagcacgctcttcttgcttttaccctcggtgtgaagcaaatgatatgctgttgtaacaagatggatgccaccactccaaaatactccaaggcaaggtatgatgaaattgtcaaggaagtgtcctcctacttgaagaaggttggttacaaccctgacaagattccctttgtcccaatctctggatttgagggtgacaacatgattgagaggtccaccaaccttgactggtacaagggcccaacactcctggatgccctcgaccagatccaggagcccaagaggccctcagacaagcccctccgtctcccacttcaggatgtgtacaagattggtggtatcggaactgtcccagtgggtcgtgttgaaactggtgtcatcaagcccggcatggttgtcacattcggtccaactggactgagtactgaagtcaagtctgttgagatgcaccacgaggctctcctagaggctcttcctggtgacaatgtcgggttcaatgttaagaatgtagctgttaaggatctgaagcgtggttttgtggcctcaaactccaaggacgatcctgcgagggaagctgccaacttcacctcccaagttatcatcatgaaccatcctggacagatcggaaacggttacgctccagtccttgactgccacacctgtcacattgctgtgaagtttgctgagatcctcaccaagattgacaggcggtctggtaaggaactggagaaggagcccaagttcctgaagaacggtgatgctggtatgatcaagatgattcccaccaagcccatggtggtggagactttctcagcgtatcctccacttggtcgttttgctgtgagggacatgcgccagaccgttgctgtgggagttatcaagagcgtggagaagaaggatccctctggtgctaaggtgaccaaatctgctgccaagaagggtgccaagtgaaccgtgcgagttggtgcactaagaagctttaataaaaatcaagagtgggttcttgttactggtccatttcttggatgtctatctgtttattatgagaactgtagtcttaagtcatcaccttcattgcaaggcttttgttcacagaactgggttcttgataggcggtggcgtggtttcggtcttgattttttttccgagtcattgttgtgtctcccatgttgagaattttaatctgtttttattttcacttgctctgctcaggagttaagtattttgctgttatgttaagtacccttgaatactttttaccattttacttgtcgagtttttgttcgtctgcttagtttctacgtatgcctttgtagaagagtgatattctgaatgttttttctattgcctgtctctcaaggtttgaactgcaatttag

SEQ ID NO: 936 - DNA, 1553 bp, Helianthus annuus
gagctagtttgcagataattcgttaaggatgggtaaggaaaagattcatatcagcattgtcgtcattggtcatgtcgactccggcaagtccacaaccacaggtcaccttatctacaagttgggtggtattgacaagcgtgtgatcgaaagattcgagaaggaagctgctgagatgaacaagaggtccttcaaatacgcatgggtgctcgacaaacttaaggccgagcgtgaaagaggtatcaccatcgatatcgccctgtggaagtttgagaccaccaagtactactgcaccgtcattgatgctcctggacatcgtgatttcattaagaacatgattaccggtacttcccaagctgactgtgctgttcttatcattgactccaccactggtggttttgaggctggtatttccaaggatggtcagacccgtgagcacgctcttcttgctttcacccttggtgtcaagcaaatgatctgctgctgtaacaagatggatgccaccacaccaaagtactcgaaggcgaggtacgatgaaattgtcaaggaagtttcatcctacttgaaaaaggtcggatacaaccccgacaaaatcccattcgtgccaatctctggttttgagggagacaacatgattgagaggtccaccaaccttgactggaacaagggtccaacccttcttgaagctcttgaccaaatcaatgagcccaagagaccctcagacaagccccttcgtctcccacttcaggatgtgtacaagatcggtggtattggaactgtgccagtgggacgtgttgagactggtgtgatcaagcctggtatggtggttacctttggaccatcagggttgaccactgaagtcaagtccgttgagatgcaccacgaagctcttcaagaggctctccccggtgacaacgtcgggttcaacgtcaagaacgttgcagttaaggatctcaagcgtggttacgttgcatcaaactccaaggatgatcctgctaagggtgccgccagtttcacttcccaggttatcatcatgaaccaccctggccagatcggtaacggttacgccccggttctcgattgccacacctcgcacattgccgtcaagttctctgaactcttgaccaagatcgacagacgatctggtaaggagctcgagaaggagcccaagttcttgaagaacggagacgccggtatggttaagatgcttcccaccaagcccatggttgtggagacctttgctgagtacccaccacttggtcggtttgccgtgagggacatgcgtcagacggttgctgtgggtgttatcaagagtgttgacaagaaggacccaaccggagcgaaggtgaccaaggctgcagccaagaagggagccaagtgagggggtggtttgtgttttggtttatggagtattttatggttttctgtcgtttggtttactagtttattttgttgaagagttttgttatttgatccttgaagctttcattattgtgcaagttttatgggttacagacttttgttgtgggttaaattattatagtaatcatgagttg

SEQ ID NO: 937 - DNA, 1544 bp, Helianthus annuus
gggatcttatctttctcctcttcttgagagcttgtttgcatataattcattaaggatgggtaaggaaaagattcatatcagcattgtcgacattggacatgtcgactctggcaagtccacaaccacaggtcaccttatctacaagttgggtggtattgacaagcgtgtgatcgaaagattcgagaaggaagctgctgagatgaacaaaaggtccttcaaatacgcatgggtgctcgacaaacttaaggccgagcgtgaaagaggtatcaccatcgatattgccctgtggaagttcgagaccaccaagtactactgcaccgtcattgatgctcccggacatcgtgatttcattaagaacatgattactggtacttcccaagctgactgtgctgtcctcatcattgactccaccactggtggttttgaggctggtatttccaaggatggtcagacccgggagcacgctcttcttgctttcacccttggtgtcaagcaaatgatctgctgctgtaacaagatggatgccaccacaccaaagtactcgaaggcaaggtacgatgaaattgtcaaggaagtttcatcctacttgaaaaaggtcggatacaaccctgacaaaatcccattcgtgccaatctctggttttgaaggagacaacatgattgagaggtccaccaaccttgactggtacaagggtccaacccttcttgaagctcttgaccaaatcaacgagcccaagagaccatcagacaagccccttcgtctcccacttcaggatgtgtacaagatcggtggtattggaactgtgccagtgggacgtgttgagactggtgtgatcaagcctggtatggttgttaccttcggaccatcagggttgaccactgaagtcaagtccgttgagatgcaccacgaagctcttcaagaggctctccccggtgacaatgtcgggttcaacgtcaagaacgttgcagttaaggatctcaagcgtggttacgttgcatcaaactccaaggatgatcctgctaagggtgccgccagtttcacttcccaggttatcatcatgaaccaccccggccagatcggtaacggttacgccccggttctcgattgccacacctcccacattgccgtcaagttctctgaactcttgaccaagatcgacagacgatctggtaaggagctcgagaaggagcctaagttcttgaagaacggagatgccggtatggttaagatgcttcccaccaaacccatggttgtcgagacctttgctgagtacccaccacttggtcggtttgccgtgagggacatgcgtcagacggttgctgtcggtgttatcaagagtgttgacaagaaggacccaactggagctaaggtgaccaaggctgcagccaagaagggagccaagtgagagggtggtttgtgttttggtttatggagtattttatggttttctgtcgttttgtttactagttttgaactttattttgttgaagagttttgttatttgatccttgaagctttcattattgtgcaagttttatgggtta

SEQ ID NO: 938 - DNA, 1706 bp, Eutrema halophilum
ctagctcgctcttttcttcatcctagccgcaacactcttctttctgcgaatatcgctgagatttatttgacaagcagtcatgggtaaagagaagtttcacatcaacatcgtggtcattggtcatgtcgactccggaaagtcaaccaccactggtcacttgatctacaagctcggtggtattgacaagcgtgtgattgagaggttcgagaaggaagctgctgagatgaacaagaggtcattcaagtacgcgtgggtgctggacaaacttaaggccgagcgtgagcgtggtatcaccattgacattgctctctggaaattcgagaccaccaagtactactgcacagtcattgacgcacctggacatcgtgatttcatcaagaacatgattactggtacctcccaggctgattgtgccgtcttgatcattgactccaccactggtggtttcgaggctggtatctccaaggatggtcagacccgtgagcacgctcttcttgctttcacactcggtgtcaagcagatgatttgctgctgtaacaagatggatgccactacccccaaatactccaagggcaggtacgaggaaattgtcaaggaggtgtcctcctacctgaagaaggttgggtacaaccctgacaaaatcccattcgtccccatctctgggttcgagggagacaacatgattgagaggtccaccaaccttgactggtacaagggaccaacccttcttgaggctcttgaccagatcaacgagcccaagaggccatcagacaagcccctccgtctcccactccaggatgtgtacaagattggtggtattggaacggtgccagtgggtcgtgttgagaccggtatgctcaagcccggtatggttgtgacctttgctccctctggtctgaccactgaggtcaagtctgttgagatgcaccacgagtcccttttggaggctctgccaggtgacaacgttgggttcaatgtgaagaatgttgctgtgaaggatttgaagcgtggttacgttgcctccaactcaaaggacgaccctgccaagggagcagccaacttcacctcccaggtcatcatcatgaaccaccctggtcagattggtaacggttacgccccggtgctcgactgtcacacctctcacattgctgtcaagttctctgagatcttgaccaagattgacaggcgttctggtaaggagctcgagaaggagcccaagttcttgaagaatggtgacgccggtatggtgaagatgactccgaccaagcccatggtggtggagaccttctctgagtacccacctcttggacgttttgctgtgagggacatgaggcagactgttgcagtcggtgtcatcaagagcgttgacaagaaggacccaaccggtgccaaggtgaccaaggctgccgtcaagaagggtgcaaaatgaactaccatcagcaaaactcaatcaaccgcagatgaatcaaagaacaatgttactttttttactttagtttgttattttgtcgcttgtctgtgtagaagtttccttttgcctccgtcaaagctcggttctcggaattgggttcttgaccggaggtggcggagcttctttccactcaagcttcctgtttttggcttttcttttgcttgcgagttctgaactatttttggagattctcttattatgaatttggtgatattcctgcggttattgtcttgtc

SEQ ID NO: 939 - DNA, 1693 bp, Eutrema halophilum
cctagcctttctttcttctcttttgccgcaatccttctctccctattcagtatcggttagctgagatttacttgacaagcagccatgggtaaagagaagtttcacatcaacatcgtggtcattggccatgtcgactccggaaagtcaaccaccactggtcacttgatctacaagctcggtggtattgacaagcgtgtgattgagaggttcgagaaggaagctgctgagatgaacaagaggtcattcaagtacgcgtgggtgctggacaaacttaaggccgagcgtgagcgtggtatcaccattgacattgctctctggaaattcgagaccaccaagtactactgcacagtcattgacgcacctggacatcgtgatttcatcaagaacatgattactggtacctcccaggctgattgtgccgtcttgatcattgactccaccactggtggtttcgaggctggtatctccaaggatggtcagacccgtgagcacgctcttcttgctttcacactcggtgtcaagcagatgatttgctgctgtaacaagatggatgccactacccccaaatactccaagggcaggtacgaggaaattgtcaaggaggtgtcctcctacctgaagaaggttgggtacaaccctgacaaaatcccattcgtccccatctctgggttcgagggagacaacatgattgagaggtccaccaaccttgactggtacaagggaccaacccttcttgaggctcttgaccagatcaacgagcccaagaggccttcagacaagcccctccgtctcccactccaggatgtgtacaagattggtggtattggaacggtgcctgttggtcgtgttgagaccggtatgctcaagcccggtatggttgtgacctttgctccctctggtctgaccactgaggtcaagtctgttgagatgcaccacgagtcccttttggaggctctgccaggtgacaacgttgggttcaatgtgaagaatgttgctgtgaaggatttgaagcgtggttacgttgcctccaactcaaaggacgaccctgccaagggagcagccaacttcacctcccaggtcatcatcatgaaccaccctggtcagattggtaacggttacgccccggtgctcgactgtcacacctctcacattgctgtcaagttctctgagatcttgaccaagattgacaggcgttctggtaaggagctcgagaaggagcccaagttcttgaagaatggtgacgccggtatggtgaagatgactccgaccaagcccatggtggtggagaccttctctgagtacccacctcttggacgttttgctgtgagggacatgaggcagactgttgcagtcggtgtcatcaagagcgttgacaagaaggacccaaccggtgccaaggtgaccaaggctgccgtcaagaagggtgccaagtgaactgcttcaatcgaccaaactctatccgcagatgaatcaaagaaccatgttacttttttcaccttagtttgttattttgttgcttgtttgtgttacagtttcgtttcttcgccgtccaagcgtcgttctcggaattgggttcttgaccggaggtggcgagttctactttgcaccttagcttgtctttttcgtctcattttatatctgttctgaactattttaagaattttcattaatggatatcgtaacatttgctact

SEQ ID NO: 940 - DNA, 1741 bp, Eutrema halophilum
tgctctttcttcaccatagccgctacactttattctttttgcgatatctctgaaatttacttgacaagcagccatgggtaaagagaagtttcacatcaacatcgtggtcattggccatgtcgactccggaaagtcaaccaccactggtcacttgatctacaagctcggtggtattgacaagcgtgtgattgagaggttcgagaaggaagctgctgagatgaacaagaggtcattcaagtacgcgtgggtgctggacaaacttaaggccgagcgtgagcgtggtatcaccattgacattgctctctggaaattcgagaccaccaagtactactgcacagtcattgacgcacctggacatcgtgatttcatcaagaacatgattactggtacctcccaggctgattgtgccgtcttgatcattgactccaccactggtggtttcgaggctggtatctccaaggatggtcagacccgtgagcacgctcttcttgctttcacactcggtgtcaagcagatgatttgctgctgtaacaagatggatgccactacccccaaatactccaagggcaggtacgaggaaattgtcaaggaggtgtcctcctacctgaagaaggttgggtacaaccctgacaaaatcccattcgtccccatctctgggttcgagggagacaacatgattgagaggtccaccaaccttgactggtacaagggaccaacccttcttgaggctcttgaccagatcaacgagcccaagaggccttcagacaagcccctccgtctcccactccaggatgtgtacaagattggtggtattggaacggtgcctgttggtcgtgttgagaccggtatgctcaagcccggtatggttgtgacctttgctccctctggtctgaccactgaggtcaagtctgttgagatgcaccacgagtcccttttggaggctctgccaggtgacaacgttgggttcaatgtgaagaatgttgctgtgaaggatttgaagcgtggttacgttgcctccaactcaaaggacgaccctgccaagggagcagccaacttcacctcccaggtcatcatcatgaaccaccctggtcagattggtaacggttacgccccggtgctcgactgtcacacctctcacattgctgtcaagttctctgagatcttgaccaagattgacaggcgttctggtaaggagctcgagaaggagcccaagttcttgaagaatggtgacgccggtatggtgaagatgactccgaccaagcccatggtggtggagaccttctctgagtacccacctcttggacgttttgctgtgagagacatgaggcagactgttgcagtcggtgtcatcaagagcgttgacaagaaggacccaaccggtgccaaggtgaccaaggctgccgtcaagaagggtgccaagtgaactaccatctgcaaaactctatcatccgcctttgaaacaaaagacaatgttagcttttttgctttagtttggtatttggtcgcttgtttgtgttacagcttcgtttcttctccgtcaaagcgctcttctcgtaattgggttcttgaccggaggtggcgttgctacgtcgcactctagcttcttctttttttcgtttcgtttgttttcccgtcatgaactattttggagattttgtttaatgaatatcgtgacattcctgcggatattttcttgcatcagtggtaaaatgtcttccaattcttgggtcaatttctctct

SEQ ID NO: 941 - DNA, 2568 bp, Eutrema halophilum
aaaaaataagaaagccaaaacgcgcaagggcaaattggtaaactagaacccaaagaatatgcgaaaaccctagaactcgaagctataagtaccctgatctgttccatttttagggtgcgctctcatttagctctctctcaatttcgtagccgcaagactcctctcagattcttacttgctgctatgggtaaagagaagtttcacatcaacatcgtggtcattggccatgtcgactccggaaagtcgaccactactggtcacttgatctacaagctcggtggtattgacaagcgtgtgatcgagaggttcgagaaggaagctgctgaaatgaacaagaggtcattcaagtacgcatgggtgttggacaaacttaaggccgagcgtgagcgtggtatcaccatcgatattgctctctggaagttcgagaccaccaagtactactgcacagtcattgacgcacctggacatcgtgatttcatcaagaacatgattactggtacctcccaggctgattgtgccgtcttgatcattgactccaccactggtggtttcgaagctggtatctctaaggatggtcagacccgtgagcacgctcttcttgctttcacccttggtgtcaagcagatgatttgctgctgtaacaagatggatgccactacccccaaatactccaagggtaggtacgaggaaattgtcaaggaggtgtcttcctacctgaagaaggttggatacaaccctgacaaaatcccattcgtccccatctctgggttcgagggagacaacatgattgagaggtccacgaaccttgactggtacaagggaccaactctccttgaggctcttgaccagatcaacgagccaaagaggccatcagacaaacccctccgtctcccacttcaggatgtctacaagatcggtggtattggaacggtgccagtgggtcgtgtggagactggtatgctcaagcccggtatggttgtgacttttgctccttcaggtttgaccactgaggttaagtccgttgagatgcaccacgagtccctccttgaggcgcttccaggtgacaatgttgggttcaatgttaagaatgttgctgtcaaggatcttaagcgtgggtacgttgcatccaactccaaggatgatcctgccaagggtgctgctaacttcacttcccaggtcatcatcatgaaccaccctggtcagatcggtaacggttacgccccagtgctcgattgccacacctctcacattgcagtcaagttctctgagatcttgaccaagattgacaggcgttctggtaaggagctcgagaaggagcccaagtttttgaagaatggtgatgctggtatggttaagatgactccgaccaagcccatggttgttgagactttctccgagtatccaccattgggacgtttcgctgtcagggacatgaggcaaaccgtggctgttggtgttatcaagagcgtcgacaagaaggacccaaccggtgccaaggtcaccaaggctgcagtcaagaagggagccaaatgatgagtcttctctcggcttttggttttctctgcttttaaaaaaaactttgatggcgtttgagccttttctttttttttctctcttattttctgcgactctcttctctctacctcctttttggatatcgctgagactattatggttttcaattatgcagttttttggataattttgcctaaagtttgttagtatttcgttgtgctacaaaatttattttcattgaatgtccattaaggtgcgtttttactgctcacagttcaaacgcatccatatcatgctctttagatctgttgtgttttgaagtaagaagaagagttacatggtaaaaaacccaactgttagaaacctttaatacaacaaatcaaagcttatggagcagttatccaacaaataagctcagaactaaaaaccaaaagaagaggataaggccaaaagaggcagcaaatcatcacaccaacgacaaataaacgtgtaaacaaacgactgtgaaaacaaccaggaatatttttttaacgatttttccagctacaagaaattgttgatctgcagttttacaagaaacataacacactgagatcttaaaaaaaggtttggatttctgtaacactaagcagctttagctgtatgagaagaaacgctccagaaccctagatcttggaataaagcaactagatctctaacatcttcgttctctcgaagccatagctcatcaaatctctccacacccatttcttcttcaccgtgactcctcgactcatctttgccttctgatctcattctcttcttcatccccttccttctcttgtcatgatctgccattctgcaacatatatatggagagagagagagacaaaaagtcaaataaacagagagatctcaatcgagagagagaagagatgaacggaaacagttttactctttggagacagagaatttctgagcgatcccagagatgcagagagggaagccatagtttccacttagagttgtcgagagcattcttctctctgtaaattcagaatttgagatcttgtt

SEQ ID NO: 942 - DNA, 1659 bp, Triphysaria pusilla
tctctcactaagaatcggtgttcgagagagtttatcctgctaatatattttccaagaattttgtttctagttcaacatgggtaaagagaagtttcatatcaacattgtggtcattggtcatgtcgactctgggaagtcaaccaccactggtcacctgatctataagttgggaggtattgacaagcgtgtgattgagaggtttgagaaggaggctgctgagatgaacaagaggtcattcaagtatgcgtgggtgctagacaagctcaaggctgagcgtgagcgtggtatcaccattgatattgctctgtggaagtttgagaccaccaagtactactgcacagtcattgatgctcctggtcaccgtgactttatcaagaatatgattactggtacctctcaggctgactgtgctgtccttatcattgactccaccactggtggttttgaagctggtatttccaaggatggtcagacccgtgagcacgctctgcttgctttcaccctcggtgtcaagcaaatgatctgttgttgtaacaagatggatgccaccacaccaaaatactcgaaatctaggtttgatgagatcgtgaaggaggttgcttcctacctgaagaaggttggatacaaccctgacaaaatcaactttgtccccatttctggttttgagggagacaacatgattgagaggtctaccaaccttgactggtacaagggcccaactcttttggaggctcttgacatgatctctgagcccaagaggccatcggacaagcccctccgtctgccccttcaggatgtttacaagattggtggtattggaactgtgcctgttggtcgtgtggagactggtattatcaagcctggtatgcttgttaccttcggcccaactggtttgaccactgaggtcaagtctgttgagatgcatcacgagtccatgcccgaggctcttcctggtgacaatgttgggttcaatgtcaagaatgttgctgtcaaggatctcaagcgtgggtttgttgcctcaaactccaaggatgaccctgccaaggaggctgctaacttcacctcacaggtcatcatcatgaaccaccctgggcagattggacagggatatgccccagtgcttgattgccacacttcacacattgctgtcaagtttgccgagcttgtgaccaagattgacagacgatctggcaaggagcttgagaaggagcccaagttcttgaagaatggtgatgctggtatggttaagatgattccgactaagcccatggttgtggagacgtttgctgcatacccacctcttggacgttttgccgttagggacatgaggcagactgttgctgttggtgtcatcaagagcgttgagaagaaggatccatcaggtgccaaggtgaccaaggctgcagtgaagaagggtgccaagtgaagatatttttccattgagtttcagattttgatcgcatggttcagtcttgtttgttttcttttgtcggaccattttagttttattgtcgagttcagacttatgttttgtttgaatttactatgtgttttagatccttttgtgatgctaaactctgtgccttttaatttatcttgttttgagttataaaacaaatcatccatgcttacataatatttgctgtggttttgttcttg

SEQ ID NO: 943 - DNA, 1768 bp, Triphysaria pusilla
ttatccaacggcccatcagaaaccctaatcacactgaacacacactcgtcttcagctccattataaaggttctatatccgcctctcttcttctttctcattctcggaatttatactctctaccacagaatcggcgtaagagagtgtttactccggctaatcttgcatccaagtattctatttcaagttcgacatgggtaaagagaagtttcacatcaacatcgtggtcattggccatgtcgactctgggaagtcaaccaccaccggtcatttgatctataagttgggaggtatcgacaagcgtgtgattgagaggtttgagaaggaggctgctgagatgaacaagaggtcattcaagtatgcgtgggtgctagacaagctcaaggctgagcgtgagcgtggtatcaccattgatattgctctgtggaagtttgagaccaccaagtactactgcacagtcattgatgctcctggtcaccgtgactttatcaagaacatgattactggtacttctcaggctgactgtgctgtcctcatcattgactccaccactggaggttttgaagctggtatttctaaggatggtcagacccgtgagcatgctctgcttgctttcactcttggtgtcaagcagatgatctgctgttgtaataagatggacgccaccacaccaaaatactcaaaatctaggtttgatgagatcgtcaaggaagtggcttcctacctgaagaaggttggatacaaccctgacaaaatcaactttgtccccatttctggtttcgagggagacaacatgattgagaggtccaccaaccttgactggtacaagggaccaactctcttggaggctcttgacatgatctcagaacccaagaggccatctgacaaaccactccgtctcccacttcaggatgtttacaagatcggtggtattggcactgtgcctgttggtcgtgtggagactggtatcatcaagcctggtatgcttgtcacctttggcccaactggtttgactactgaggtcaagtccgttgagatgcatcatgagtccatgccagaggcgcttcccggagacaatgttggttttaatgtcaagaatgttgccgtcaaggatcttaagcgtgggtttgttgcttcaaactccaaggatgaccctgcgaaggaggctgccaactttacctcacaggttatcatcatgaaccaccctggccagattggtcaaggctatgctccagtgctcgattgccacacctcccacattgctgttaagtttgcagagctggtgaccaagattgacaggcgatctggtaaggaacttgagaaggagcccaagttcttgaagaacggtgatgctggtatggttaagatgattccgacaaagcccatggttgtggagacgtttgctgcgtacccacctcttggacgttttgccgttagggacatgaggcagactgttgctgttggtgtcatcaagagtgtggagaagaaggatccatcaggtgccaaggtgaccaaagctgctgtgaagaaaggtgccaagtgaagacttttttccagtgataactccatttcagattttgattgcataattaagtttgcttgtattctcttttttgaaccattttaattttctttttgaggtgaagacagatctgtttcttgttatgtttacttgtgttttagatatttagatgagtggcaaaactcggtgggttttaattttgaaaaacttctgcttttgttttaactataatatcataagtgcttcc

SEQ ID NO: 944 - DNA, 1571 bp, Valeriana officinalis
tttcaatttcgttcctagctattcataatgggcaaagagaaggttcacatcaacattgttgtcatcggccatgttgactctggcaagtcaacaacaactggccatctaatctacaagcttggaggcattgacaagcgtgtgattgagagatttgagaaggaggctgctgagatgaacaagcgttcgttcaagtacgcctgggtgctcgacaagctcaaggccgaacgtgaacgtggtatcacaatcgatatcgctctctggaaatttgagaccacaaaatactactgcacggtcatcgatgcccctggtcatcgcgactttatcaagaacatgattactggaacttcacaggctgattgtgccgtccttatcatcgactccactactggaggctttgaagctggtatttcaaaggacggtcagactcgcgaacatgctctgctcgcttttacacttggtgttaggcaaatgatctgttgctgcaacaagatggatgctacaaccccgaagtactcgaaggcaaggtacgatgaaattgtgaaggaagtttcttcgtatctgaaaaaggttggatacaaccctgaaaaggttccttttgtccccatctctggttttgagggcgataacatgattgagaggtccacgaacctcgactggtacaagggtccaactctgctcgaagctcttgacatggtcagtgagccaaaacgaccttctgacaagcccctgcgtctccctctccaggatgtttacaagattggtggcatcggtactgttccagtgggccgtgttgaaaccgggatcatcaaacctggtatgattgtcacttttggtcctactggtttgactactgaggtcaagtcagttgaaatgcatcacgagtctctgttggaggctcttcccggtgacaatgtagggtttaatgtcaagaatgttgctgtgaaagatctcaagcgtggattcgttgcttcgaattccaaagatgatccagcaaaagaggctgccaactttacttctcaggttatcatcatgaaccaccctggtcagattggaaacgggtacgcccccgttcttgactgccacacgtcccacattgcagtcaagtttggtcagatattgaccaagattgacaggaggtcagggaaggagctggagaaggaacccaagtttctgaaaaacggagatgcaggaataatcaagatgcttccgaccaagcctatggtggtggagactttctctgaatatcctccactcggtcgttttgcagtgagggatatgaggcagacggtggctgttggagttatcaagagtgtggagaagaaggacccaactggtgccaaggtcaccaaagctgctgctaaaaagactggaaagtgaatcgcacgggttagccatcggtctttcatggctgatggttttggttttagtttgaataaaagcggtgaagacttggttcgtgtttttaaagtcttcattgggaatttaagtagaagttttgtgtttttgtctttgtcgggctcctggtcacagaattgggttcttgaccgtcggtggcagggccttttgtttag

SEQ ID NO: 945 - DNA, 1369 bp, Setaria italica
gcgcatcatttcttcttggcggcagccttggtaaccttggcgccggtcgggtccttcttctccacgctcttgatgactcccacagcaactgtctgtctcatgtcacggacagcgaagcgaccaagaggagggtactcagagaaggtctccaccaccatgggcttcgtgggaatcatcttcaccataccagcatcaccgttcttcaggaacttgggctccttctcaagctccttaccggatcgcctgtcgatcttggtaatgagctcagcaaacttgacagctatgtgggaggtgtggcagtccagcactggggcgtagccgttgccgatctgcccagggtggttcatgatgatgacctgggaggtgaagctggcagcctccttggcagggtcatccttggagttggaggccacgaacccacgcttgagatccttgacagcaacgttcttcacgttgaagccaacgttgtcaccaggaagggcctcctggagagcctcgtggtgcatctcaacagacttcacctcagtagtcaggccagttggaccaaaggtgacaagcataccaggcttgatgataccggtctcaacacggccaacagggacggttccaataccaccaatcttgtacacatcctgaagggggagacgcaggggcttgtccgaaggcctcttgggctcgttgatctggtcaagagcctcgagcagggttgggcccttgtaccagtcaaggttggtggacctctcaatcatgttgtcaccctcgaaaccggagatggggacgaaggcaatcttgtcagggttgtaacccaccttcttcaggtaggaggagacttccttaacaatctcatcataacgggccttggagtacttgggagtggtggcataagaatttctgtattataccttgttgcagcagcagatcatctgcttgactccaagagtgaaagcaaggagagcatgctcacgggtctggccatccttggagataccagcctcaaaaccaccagtggtggagtcaatgatgaggacagcacagtcagcctgggaggtaccagtgatcatgttcttgatgaagtcacggtgtccaggggcgtcaatgacggtacagtagtacttggtggtctcgaacttccacagggcaatatcaatggtgatacccctctcacgctcagccttgagcttgtcaagcacccatgcatacttgaaggaccgcttgttcatctctgcagcttccttctcgaacctctcgatcacacgcttgtcgatacctccaagcttgtagatcaggtggccggtggtggtcgacttgccagagtcgacgtggccaatgaccacaatgttgatgtgggacttctccttacccatggctg

SEQ ID NO: 946 - DNA, 1385 bp, Ambrosia trifida
ttttctctagagctcctttgcatacactttgttaaggatgggtaaggaaaagattcatatcagtattgtcgtcattggacatgtcgactccggcaagtccacaaccacaggacaccttatctacaagttgggaggtatcgacaagcgtgtgatcgaaagattcgagaaggaagcagctgagatgaacaaaaggtccttcaaatacgcctgggtgcttgacaagcttaaggccgagcgtgaaagaggtatcaccatcgatatcgccttgtggaagttcgagacaactaagtactactgcactgtcattgatgcccctggacatcgtgatttcattaagaacatgattactggtacttcccaagctgattgtgctgttcttatcatcgattccaccactggtggttttgaggccggtattccaaggacggtcagacccgtgagcacgctcttcttgctttcacccttggtgtcaagcaaatgatctgctgctgtaacaagatggatgccaccacaccaagtattccaaggctaggtacgatgaaattgtcaaggaagtgtcatcttacttgaagaaagttggatacaaccccgacaaaatcccattcgtgccaatctctggatttgagggagacaacatgattgagaggtcgaccaacctcgactggtacaagggaccaacccttcttgaagctcttgaccagatcaatgagcccaagagaccctcagacaagcccctccgtctgccacttcaggacgtgtacaagatcggtggtattggaactgtgccagtgggacgtgttgagactggtgtgatcaagcctggtatggttgttacctttggaccatctgggttgaccactgaagttaagtctgttgagatgcaccacgaagccctccaagaggctctccccggtgacaatgttgggttcaacgtcaagaacgttgctgttaaggatctcaagcgtgggtacgtcgcatccaactccaaggatgatcctgccaagggtgctgccagtttcacatcccaggttatcatcatgaaccaccctggccagatcggtaatggttacgccccggttcttgattgccacacctcccgcattgctgtcaagttctctgaacttttgactaagatcgacagacgatccggtaaggagcttgagaaggagcctaagttcttgaagaacggagatgccggtatggttaagatgcttccaaccaagcccatggttgtcgagacctttgctgaatacccaccacttggtcggtttgctgtgagagacatgcgtcagacggttgcagtcggagtcatcaagagcgttgataagaaggacccaaccggagccaaggtgacaaaggccgcagcgaagaagggagccaagtga

SEQ ID NO: 947 - DNA, 1381 bp, Ricinus communis
taattgaactctcattttcctcccttcttggcggcagacttggtgaccttagctccgcttgggtccttcttctcaacactcttgataacacccactgcaacagtttggcgcatgtccctaacagcaaaccgacccaatggagggtactcggagaaggtctcaacaaccatgggcttggttggaatcatcttcacgaaaccagcatcaccattcttcaagaatttgggctccttctcaagctccttaccggatcgacgatcaatcttcgttaggatctcagcaaacttcacagcaatgtgggaggtatgacagtccaacactggagcatatccatttccaatctgaccaggatggttcatgatgatgacttgggatgtgaagttggctgcctcctttgctggatcgtccttggagtttgaagcaacaaaacctctcttaagatccttgacagcaacattcttaacattgaaaccaacattgtcaccagggagggcctcctggagtgcctcgtgatgcatttcaaccgacttaacttcagttgtcagtccactgggtccaaaggtcacaaccataccaggcttgaggacaccagtctccacacgacccactggaactgttccaataccaccaatcttgtaaacgtcttgaagtgggagacgaagaggcttgtctgtgggcctctttggctcattgatctggtcaagagcttcaagtagggttggtcccttgtaccagtcaaggttggtggacctctcgatcatgttgtcaccttcgaagccagagatgggaacgaaaggaattttatcggggttgtatccgaccttcttcaggtaagaggaaacctccttgacaatttcatcatacctggccttggagtacttgggaatggttaatttcaccttgttgcagcagcaaatcatttgcttgacaccgagggtgaaagcaaggagagcatgctcacgggtctgaccatccttggaaataccagcttcaaaaccaccagtggtggaatcaataatcagaacagcacagtcagcctgtgaggtaccggtaatcatattcttgataaagtcacgatgtccaggtgcatcaatgacggtgcagtagtacttggtggtctcaaacttccacaaggcaatatcaatggtgataccacgctcacgctcggccttaagcttgtcaagcacccaagcatacttgaatgacctcttgttcatctcagcagcttccttctcgaatctctcaataacccgcttgtcaatacctcccaacttatagatgagatggccagtagtagttgactttccagagtcgacatggccaatgaccacaatgttgatgtgaaccttctccttacccattattgatgcctaaaactgaa

SEQ ID NO: 948 - DNA, 1766 bp, Vitis vinifera
tgggcagccaaaatttgatccaaatattacctgaaagcagttataaataaatactgataaaacggaggataaattcataccaaacacaaaatgatgctaaaaagcaatgtaccgaaatccaagatcctgacaataaacagaaattgaaattgtttatcaaccaaatgaagcaactcatctgagtactgtaaagtgaccaaaacaataaacggcagctatagcttccaccttctatcaagcacccaggtctgcgtccttgcaagtgaaattagagaactgaaatgaaaatctccagagctgtacccaaaactgccaaaatcaacaaaacaaaatcgaaaacaaataacaccaattaaagacataactagtctatctaggataaatatcctcaaaggcacatttcacttcttctttgctgcagacttggtgaccttggctccagatggatccttcttctccacgctcttgatgactccaacagcaacagtttgacgcatgtcacgaacagcaaaacgaccaagtgggggatactcggagaaagtctccaccaccatgggcttggtgggaatcatcttaacaaaccctgcatcaccattcttcaagaacttgggctctttctcaagctccttgccagatcgcctgtcaatcttggtcagtatctcagcaaacttaacagcaatgtgggaggtgtggcagtccagaacaggggcatagccatttccgatctgacccgggtggttcatgatgatgacctgggaggtgaagttggctgcctccttagcagggtcatccttggagtttgaggcaacaaacccacgcttgagatccttcacagcaacgttcttcacgttgaagccaacattgtcaccaggcaaagcctctgggagagactcatggtgcatctcaacagacttgacttcagttgtcagtccagaggggccaaaggtcaccaccataccgggcttcaggacaccagtctccacacgtcccactgggacagttccaatcccaccaatcttgtacacgtcctgaagagggagtcgcagtggcttgtctgtgggcctcttgggctcattgatcatgtccagggcctcaagaagagttgggcccttgtaccagtcaaggttggtagacctctctatcatattgtcgccctcaaagccggagatggggacaaatggaatcttatcagggttgtatccaaccttcttcaggtaggaagaaacttccttcacgatttcatcgtaccttgccttggagtactttggtgttctcaccttgttacagcagcaaatcatctgcttcacaccaagggtgaaagcaagcagtgcatgctcacgggtttgtccatccttggagataccggcttcaaaaccaccagtggtggaatcaataatgagaacagcacagtctgcctgtgaggtaccagtaatcatgttcttgatgaagtcccgatgaccaggagcatcaataacagtgcagtagtacctggtggtctcaaacttccacaaggcaatatcaatggtgataccacgttcacgctcagccttcagtttgtccaacacccaggcatacttgaaggaccgcttgttcatttcagctgcctccttttcaaacctctcgataacacgcttgtcaatacctccaagcttgtagatcaagtgaccagtggtggtcgacttgccagagtcgacatggccaatgacgacaatgttgatgtgaaccttctccttacccattatgaatttttagcagaaaaactgaaa

SEQ ID NO: 949 - DNA, 1656 bp, Papaver somniferum
attcggagcctttcaatctcgatttcaaatctcagtcaatttctaagaattcaatatgggtaaagagaaagttcatatcaacattgtcgtcattggacatgtcgactctggaaaatcgaccaccgactggtcacttgatctacaagctaggaggtatcgacaagcgtgtgatcgaaagattcgagaaggaggctgctgagatgaacaagaggtcattcaagtacgcatgggttcttgacaagcttaaggctgaacgtgagcgtggtattaccattgatattgccttgtggaagtttgagaccacaaagtactactgcacagttattgatgctcctggacatcgtgatttcatcaagaacatgattactggtacctctcaggctgattgtgctgtccttatcattgactccaccactggaggttttgaggctggtatctctaaggatggacagactcgtgagcacgctcttcttgctttcacccttggtgtcaagcagatgatctgttgttgtaacaagatggatgccaccacccccaagtactcaaagggtaggtacgaagaaattgtaaaggaagtctcttcatacttgaagaaggttggatacaacccagacaaaattgccttcgtcccccatctctggtttcgagggagacaacatgattgagaggtccaccaaccttgactggtacaagggaccaactcttcttgatgctcttgacaacatctctgagcctaagagacccacagacaagccccttcgtcttccccttcaagatgtttacaagattggaggtattggaactgtgccagtgggacgtgttgaaactggtttcatcaagcctggtatggttatcacttttggacccactgggttgactactgaagttaagtctgtggagatgcaccacgaggctctcctagaagctcttccaggtgacaatgttgggttcaatgtcaagaatgttgctgtgaaggatctgaagcgtggtttcgtcgcttcaaactccaaggatgaccctgctaaggaagcagccaacttcacctcccaggtcatcatcatgaaccatcctggacagatcggcaacggttatgccccagtcctcgactgtcacacatctcacattgctgttaagttctctgaaactcctcaccaagatcgacaggcgatctggaaaggagctcgagaaggagcccaagttcttgaagaatggtgatgctggtattattaagatgcttccaaccaagcccatggttgttgagaccttctctcagtacccacctcttggacgtttgctgttagggacatgaggcagacagttgctgttggtgtcatcaaggaagttgagaagaaggacccatcaggagccaaggttaccaagtctgctatcaagaagaatgaagtgtgcttttaactagagggatggtgctaggaggatcatcaggagggacttgtctttgcttcattattattagtcagtttcgtttttgctttttgttggttaggtatctctgcagtctctgtttgttattgtctttgttttgtttgtgtcatccggtacgtgtcgtaaaccgtacgggtggtcgttgtacgaggcgggtcgggcgaacgaaggaagtagtttggtcgtgtcgtctagttaggtaaggtttaaccg

SEQ ID NO: 950 - DNA, 1401 bp, Sorghum bicolor
caagaaaccaggaaccatggatatgcaggatcatcatcatttcttcttggcagccgccttggtcaccttggctcccgtcgggtccttcttctccacgctctttatcacaccgaccgcaaccgtctgcctcatgtcacgaacagcgaagcgccccagtggaggatactccgagaaggtctccaccaccatgggctttgtggggatcatcttgacgaagccggcatcaccattcttaaggaacttgggggcgctctccagctccttgcccgaccgccggtcgatcttggtgagcagctccgagaacttgacggcgatgtgggaggtgtggcagtccagcaccggggcgtagccgttgccgatctgcccggggtggttcatgatgatcacctgcgcggtgaagctggcagcctccttggcggggtcgtccttggagttggaggccacgtagccacgcttcaggtccttgaccgccacgttcttgacgttgaagccgacgttgtcgccgggaagcgcctcctgcatcgactcgtggtgcatctccaccgacttgacctccgtcgtcaggcccgtggggccaaaggtgaccaccatgccgggcttaatgaggccggtctccacacggcccaccgggacggtgccgatgccgccgatcttgtacacgtcctgcaggggaaggcgcaggggcttgtccgagggccgcttgggctcgttaatctggtccagcgcctcaaggagggtggggcccttgtaccagtccaggttcgtagacctctcgatcatgttgtcaccctcgaacccagagatgggcacgaaggggatcttgtccgggttgtaccccaccttcttgaggtaggaacccacttccttgacgatctcgtcgtaccgagccttggagtacttgggggtgatttttaccttgttgcagcagcagatcatctgtctgacaccaagagtgaaagcaaggagtgcgtgctcacgggtctggccgtccttggagataccagcctcaaagccaccagtggtggagtcaatgatgagcaccgcacaatcagcctgggaggtgccggtgatcatgttcttgatgaagtcacggtgcccaggagcgtcgatcacagtgcagtagtacttggtggtctcaaacttccacagggcaatgtcaatggtgatgcccctctcgcgctcggccttgagcttgtcaagcacccaggcgtacttgaaggacctcttgttcatctcggcagcctccttctcaaacctctcgatgacacgcttgtcgatgcctccaagcttgtagatgaggtggccggtggtggtggacttgccggagtcaacatgaccaatgaccacaatgttgatgtgaaccttctccttccccatggcaacgggaccagctgactagct

SEQ ID NO: 951 - DNA, 1601 bp, Valeriana officinalis
tctgccgctgctctgtaagagagagagaaagcttctcatagcaatcttcgttcaaggttcctttactgctcaaaatgggaaaagaaaagtttcacatcaacattgtggtcattggccatgtcgactctggaaaatcgaccaccactggtcacttgatctacaagcttggaggtattgacaagcgtgtgatcgagaggttcgagaaggaagctgctgagatgaacaagaggtctttcaaatacgcatgggtcctagacaagcttaaggctgagcgtgaacgtggtatcacaattgatattgctttgtggaagtttgagaccaccaagtactactgcacagtcatcgatgctcctggacatcgtgattttattaagaacatgattactggtacctcgcaagctgattgcgctgttctcatcatcgattccaccactggtggttttgaagctggtatctctaaggatggtcagacccgtgaacatgctctccttgctttcacccttggtgttaagcaaatgatttgctgctgtaacaagatggatgccacaacccaaaatactccaaggctaggtacgatgaaatcgtgaaggaggtttcttcatacttgaagaaagttggttacaacccagacaaaattgcttttgttcccatctctggattcgaaggtgacaacatgattgagcgctccaccaacctcgactggtacaagggaccaactcttctcgaggctcttgacatgatctctgagccaaagaggccgtcagacaagcccctccgtctcccacttcaggacgtctacaagattggaggcattggaactgtgccagttggaagggttgaaaccggagttatcaagcccggtatggtcgtgacttttggtccaactgggttgaccactgaggtcaagtcagttgaaatgcaccatgaatctttgctcgaggctcttcccggtgacaacgtcgggttcaatgtcaagaatgttgctgttaaggatttgaagagaggatacgttgcttccaactccaaggacgatccggccaagggtgcagccagtttcacttcccaggtcatcatcatgaaccacccaggtcagatcggtaacgggtacgccccggttctcgattgccacacatcccacattgctgtcaagtttggcgagatcttgaccaagattgaccgaaggtctggaaaggagatcgagaaggagcccaagttcttgaagaacggagatgcaggcatggtgaagatgcttccgaccaagcccatggttgttgagaccttctcagagtacccaccgctcggaagatttgctgtcagggatatgcgtcagacggttgctgttggtgtgatcaaggctgttgacaagaaggacccaaccggagccaaggtgaccaaggcagcagtgaagaagggtgctaagtaagctggtcttttgttcaagtatgctacttttattatgtgttttcttattaagtagttttttttttggtagaaacagttttgattatggttgatttgagggtttctattactactctgtagaaatggagacttccttttcagctgtatcttttatctgcttttatttttgagtttactga

SEQ ID NO: 952 - DNA, 1297 bp, Triticum aestivum
taaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggccttcaagtacgcctgggtgcttgacaagctgaaggccgagcgcgaaaagggtatcaccattggatattgccctgtggaagtttgagaccaccaagtactactgcaccgtcattgatgcccctggtcaccgtgacttcatcaagaacatgatcaccgggtacctcccaagctgactgtgctgtgctcatcatcgactccaccactggtggttttgaggctggtatctcgaaggacggccagacccgtgagcacgccctccttgctttcactcttggagtgaagcagatgatctgctgctgcaacaagatggatgccaccactcccaagtactcgaaggcccgttatgaagaaatcgtcaaggaagtctcttcgtacctgaagaaagtcggctacacctgagagttcccttcgttcccatctctgggtttgagggtgacaacatgattgagaggtccaccaaccttgactggtacaaaggccctacccttcttgaggctcttgaccagatcaatgagcccaagaagccctcagacaagcccctgcgtcttccccttcaagatgtttacaagattggtggcattggaactgtgcctgttggccgtgttgagactggtgtcatcaagcctggtatggttgttacctttggtcccactggtctgacaactgaagttaagtctgttgagatgcaccatgagtctctcctggaggcgcttcctggtgacaacgttggcttcaacgtcaagaacgttgctgtgaaggatctgaagcgtgggtttgttgcatccaactccaaggatgaccctgccaaggaggcggccaacttcacctcccaggtcatcatcatgaaccaccctggtcagatcggcaatggctacgccccagtgctggactgccacacctcccacattgctgtcaagtctgctgagctggtgaccaagatcgacaggagatctggtaaggagctggaggcgctgcccaagttcctgaagaacggagacgctggcatcaccaagatgattcccaccaagcccatggctgtggagaccttcgccacctaccctcctcttggccgcttcgctgtgcgtgacatgagacaaacggttgctgttggcgtcatcaagggcgtggagaagaaggaccccacc

SEQ ID NO: 953 - DNA, 1846 bp, Prunus mume
gctggtgccgagggcatgttcgtaaacacggagaaattgctctgttatataaacacactgaaaccctattcacttctcacgcctctgcatctgtgcctctttcaccctcactatcactctctcgtcgctagggttttagcgcagcgatctctttccagcttttataatgggaaaagaaaagattcacattaacattgtggtcattggccatgtcgactctgggaagtctaccaccactggccatttgatctacaagcttggaggtattgacaagcgtgtgattgagaggttcgagaaggaggcagctgagatgaacaagagatcattcaagtatgcctgggtgcttgacaagctcaaggctgagcgtgaacgtggtattaccattgatattgccctctggaagtttgaaactaacaagtactactgcactgtcattgatgctccaggacatcgtgacttcattaagaacatgattactggaacttcccaggctgactgtgctgtcctcattattgactccaccactggaggttttgaagctggtatttccaaggacggtcagactcgtgagcatgctctcctagctttcacccttggtgttaagcaaatgatttgctgctgcaacaagatggatgctaccactccaaagtactcgaaggcaaggtatgatgaaattattaaggaagtctcatcctatctgaagaaggttggctacaacccagacaagatcccctttgttcctatctctgggtttgagggtgacaacatgattgagaggtctaccaaccttgactggtacaagggtcctacccttcttgaggcccttgacttgatcaatgagcccaagaggccctcagacaagcccctccgcctcccacttcaggatgtctacaagattggtggcattggtaccgtccctgttggacgtgttgaaactggtatcatcaagcctggtatggttgtgacctttggcccttctggactgacaactgaagttaagtctgtggagatgcaccatgaagctcttacggaggctcttccaggagacaatgttggcttcaacgtgaagaatgtcgcagtcaaggatctcaagcgtggttttgttgcctcgaattctaaggaggatccagccagggaggcagccaacttcacttcccaagtaatcatcatgaaccaccccggccagattggaaatggctatgcccctgtgctggattgccacacctcccacattgcagtcaagttcaatgagattctaaccaagattgacagacgatccggcaaggagctcgagaaggagcccaagtttttgaagaatggtgatgctggatttgttaagatgattcctaccaagccaatggtggtggagaccttctccgagtatcccccacttggtcgtttcgctgtccgggacatgcgacagactgttgctgtgggagtgatcaagagtgtggagaagaaggatccaagtggagccaaggtgaccaaatctgcagcaaagaagaagtgaattgtgcgctttgagaaggattacaataaagcatgggttgttgctactagtttttctggtaggtgcttaggtgtcgtctgtcttgttggttataatttcaagtctcctccgtcgtctcttggctgctgttctcagaactgggtgctcgatcggcggtggcggggttataatctggcgtcgttttgctgttttgttttgtggttttaattcgtgtcagttgtggtgtgtttagaatttgttgctatactttgctcggatcttgttgcctttaaaaaaaatatataattagtattgactcataattgcgtcaaattttgagtggtttcattatatttc

SEQ ID NO: 954 - DNA, 1888 bp, Abies balsamea
ggccggatttgtctattgtctacgtcgcggagagcgaagaaggggagaagctctgcaattctttcttcgtcgagaaggcgaagctgctttctgtctagcattcttcgagtttcttcattccagggatagttgtttttgataaccatgggcaaagaaaagactcacatcaacattgtggtcattggacatgtcgactctggcaagtccaccactactggccatcttatttacaagctaggtggtattgacaagcgtgtgatcgagcgttttgagaaggaagctgctgagatgaacaaaaggtcattcaagtatgcttgggtgcttgacaagcttaaggctgagcgtgaacgtggtatcactattgacattgctctctggaagtttgagaccaccaagtactactgcaccgtcattgatgcacctggacatcgtgactttatcaagaacatgattactggtacctcgcaggccgattgtgctgttttgattattgattctaccaccggaggttttgaagctggtatttctaaggatgggcaaaccagagaacatgcacttttggctttcactcttggagtgaggcagatgatctgttgttgtaacaagatggatgcgaccacacctaagtactccaaggcccgttatgaagaaatcgtaaaggaagtgtcatcatacctaaagaaggttgggtacaaccccgataaaattccctttgtccccatctctggatttgaaggagataacatgattgagcgatccaccaaccttgattggtacaagggcccaaccctattggatgcccttgatcagttgtctgagcctaagaggccatctgacaaaccccttcgattgccactacaagatgtgtacaagattggtggtattggaactgtgcccgtcggacgtgttgaaacgggtgttattaagcctggtatggttgtaaccttcggtcctactgggctgacaactgaagttaagtctgtagaaatgcatcatgaagccctgctagaggcagcacccggtgacaatgtcggcttcaacgtgaagaacgttgcagtcaaagatttgaaacgtgggtttgttgcttctgattctaagaacgaccctgcaaaggaagcagctaacttcacggctcaggtgatcatcatgaaccaccctggacagattggaaatggctatgctcctgtgttggactgccacacctcgcacattgctgtcaagtttggtgaaattttgaccaaggttgataggcgatctggtaaagaacttgagaaggagcccaaattcctcaagaatggagatgctggtttcgttaagatgattccctcgaagcccatggttgtggagacattcgccgagtatcctccattgggtcgttttgccgtgagagacatgcgtcaaacggtcgctgttggagtcatcaaggctgttgagaaaaaagaacctactggtgccaaggtcacaaaggctgcggccaagaagggaaaatgaaatttggttttaccaagtacttatgtgcagagggtagaggtgcatgtataccatattgcaacgtggtgtagatgcttgtctcactctgttgcacgagatttggtagttagggggttgacagctcggcgcatgcagacatgggttcttgacaggcggtggcagcatattcaaaatgctttttattgttccaagttatagtaatctgggcgggtttagtataactttgtgggtgagggtagagtactgtatcttattttttagatcattgctaccgaaatttaattgcggattttatgtttgtgcgtttttgaagactttgtgttgagtaaagatacgagaatattgtgttaactattttttcaatttcatgtctgttctttctcaatatacatattaa

SEQ ID NO: 955 - DNA, 1782 bp, Amorphophallus konjac
ccaccttctttactcgaggtctccgaggggcggcggcagcagcggcagcagcctttcttgattcatccgtcataagcaatcatggggaaggaaaaggttcacatcaacattgttgttatcggccatgtcgactctgggaaatcgaccaccactggccatctcatctacaagcttggtggcattgacaagcgtgtgattgagaggtttgagaaggaggctgccgaaatgaacaaaaggtcgttcaagtatgcctgggtccttgataagctcaaggctgagcgtgagcgtggtatcaccattgatattgccctctggaagtttgagaccacaaagtactactgcactgtcattgatgctcccggacaccgtgacttcatcaagaacatgattactgggacttctcaggccgattgtgctgttctcattattgactccacaactggtggctttgaagctggtatttcaaaggatggacaaacccgtgaacatgccctgctggcattcactcttggggtcaagcagatgatttgctgttgcaacaagatggatgcaactacacctaagtactccaaggctcggtatgatgaaattgtcaaggaagtgtcctcttacctcaaaaaggttggatataaccctgataagatcccgtttgtccccatctctggatttgagggtgataacatgattgagaggtccaccaacctggattggtacaagggtcctactctcctggaggctcttgacttgatccaggagcctaagaggccctttgacaagcccctccgactcccactccaagatgtctacaagattggtggtattggaaccgtccctgttggtagggttgaaactggtgttctgaagcctggtatggttgtcacctttggtccttccggattgacaactgaagtcaagtctgttgagatgcaccatgaggctctcccggaagctcttcccggagataatgtgggcttcaatgttaagaatgtggctgtcaaggatctcaagcgaggttttgtcgcctcaaactccaaggaagaccctgcaaaggaggccgccaacttcacttctcaggtcatcatcatgaaccaccctgggcagattggcaacggctatgcgcctgtgctcgactgccacacatcccacattgccgtcaaattctcagagattcttaccaagatcgacaggcggtcaggtaaggagcttgagaaggagcccaaattcctgaagaacggtgatgctggttttgtgaagatggttcccaccaagcccatggttgtggagaccttctctgagtacccaccccttggacgctttgccgtgagggacatgcgccagactgttgctgtcggtgtgatcaagagtgtggagaggaaggatcccaccggggccaaggttaccaagtctgctgcgaagaagaagtgaaccgacttggggagccggttgcagaactgggttcttgacaggcggtggcgagacttccaggattttgttggcttttattgtgttctgtcatgtggtctatttgactagtttgacgtcattttgctgtgaggtaaaaaaaacttcggaggctgttgagagtttttagttcctttgctcttgagcagcccaaacgggcattaattggttaaatattaaagactgctatttcttatttcattctcaggctttactcctctttatacacgtttctagaagagggtctgtttctgtacgtgttccgtggtctgtcatttattagagcgagattgcacacctagttttaccttaaggcttaag

SEQ ID NO: 956 - DNA, 1735 bp, Malus domestica
cagcctataaataagtcacgttgcgcctcacaaaccctacgctttcatttctcactgcctctgccgctctcgcttgaaccaagagtttgagcttccagatctctgaggtaaattaacatgggtaaagagaagtttcacatcaacatcgtggtcattggccatgtcgactccggcaagtcgaccaccactggtcatcttatctacaagcttggaggtattgacaagcgtgtgattgagaggttcgagaaggaagctgctgagatgaacaaaaggtcattcaagtatgcctgggtgcttgacaagcttaaggccgagcgtgagcgtggtatcaccattgatatcgccttgtggaagtttgagaccacaaagtactactgcacagtcattgatgctccgggacatcgtgatttcattaagaacatgattactggaacatcacaggctgactgtgctgtcctcatcattgactccaccactggtggtttcgaagctggtatttccaaggacggacagacccgtgagcatgctcttcttgctttcaccctcggtgtgaagcagatgatttgctgctgtaacaagatggatgccaccactcctaagtactctaaggcaaggtacgaagaaatcgtgaaggaagtttcatcctacctgaagaaggttgggtacaaccccgacaaaatcgcctttgttcccatctctgggtttgagggtgacaacatgattgagaggtccaccaaccttgactggtacaagggaccaacccttcttgaggctcttgaccagatcaacgagcccaagagaccctcagacaagcccctccgtcttcctcttcaggatgtgtacaagattggtggtattggaactgtgccagtgggacgtgtagagactggtatcgtcaagcctggtatggttgtgacttttgggccaactggtctgaccactgaagttaagtcagttgagatgcatcacgaggctcttcaggaggcactccccggtgacaatgtcgggttcaatgttaagaatgttgctgtgaaggatctcaaacgtggtttcgtcgcatccaactccaaggatgaccctgccaaggaggctgccaactttacagcccaggttatcatcatgaaccaccctggtcagatcagtaacggatatgccccagttctggattgccacacttctcacattgccgtgcggttcggtgagatccttaccaagattgacaggaggtctggaaaggagattgagaaggagccaaagtttttgaagaacggagatgcaggtatggtgaagatgcttcccaccaagcccatggttgtggagaccttctctgagtacccaccattgggtcgctttgctgttcgtgacatgcgccagactgttgctgtcggtgttatcaagagcgttgagaagaaggaccccagcggtgccaaggtgaccaagtctgctgccaagaagaagtgaacaatggccagtactcaaatttacacagacgcaaaagtatggttttatgagacgaactcatattagttgtgtggttccaagtggtttagtcggtttagtttgtaattgttttaattccggtctgatgttttcattctcgattgtccactgcctgaattgggtgctggacaggcggtggtgacgcatatagtgtaacaacctattttaaatttgtgtacaaatttacgaaaatgcccttgtgggtttataaacgtgcccatggttttcttttcca

SEQ ID NO: 957 - DNA, 1662 bp, Artemisia annua
tttcacatctgtgccgcttcttcatcttctaaagcaaaccagcaagcttaatcatgggtaaggaaaaggttcacatcagtcttgttgtcattggccatgttgactccggaaagtcaaccacaacaggtcacttgatctataagctaggaggaattgacaagcgtgtgattgaaagattcgagaaagaggctgctgagatgaacaagcgttcattcaagtacgcctgggtgttggacaagctcaaggcagagcgtgaacgtggtatcaccattgatattgcattgtggaaatttgaaaccacccgttactactgtactgtcattgatgctcctggtcaccgtgactttatcaagaacatgatcactggaacgtcccaggctgactgtgctattcttattattgactcgacaactggtgggtttgaagctggtatttccaaagatggacagactcgtgagcatgctttgcttgccttcactcttggtgtcaagcaaatgatctgttgttgcaataagatggatgctacgacaccaaagtactcaaaagctaggttcgatgaaattgtgaaggaagtgtcttcatacctcaaaaaggttggatacaaccctgacaaagtcccatttgtcccaatctctggttttgagggtgataacatgattgagaggtcatccaacctggactggtacaagggcccaactctacttgaagcacttgaccagattaacgagccaaagagaccatcagacaagccactccgtcttccactccaggatgtctacaagattggtgggattggaactgtgccagtgggacgtgttgaaactggtatgatcaagcctggtatggtagtcacttttggcccaagtggtttgaccactgaagtcaagtctgttgagatgcaccatgaatcactactggaagcattgccaggagataatgttggtttcaatgttaagaatgttgctgtgaaggatctcaagcgtggttacgttgcttccaactctaaggacgaccctgcaaagggtgcagctagctttacttcacaggtcattatcatgaaccatccgggtcaaattgggaatggttatgcacctgtgcttgattgtcacacttctcacattgctgtcaagtttggcgagattttgaccaagattgacagaaggtctggtaaggagctcgagaaggagcctaagtttttgaagaatggtgatgctggtatggtgaagatgcttccaactaagcctatggtggttgagacttttgctgagtatcctccattgggtcggtttgctgtgagggatatgcgtcagactgttgctgttggtgtgatcaagagcgtggataagaaggatccaactggtgccaaaatcaccaaagctgctattaagaagaaatgaactgtttccattaagaatctggttttgagtttgaactctttgttttcttttcataagttttgtcttgttggtttgtgttgcttccgctcagccccattcttaggaatggtggttctgttattcttccgagttcatacctgggtgcttgacaggcggtggcgtagatgtgtctgttttggtgtctgagtcattagtccttacattgaaacatttgaatttaatggtttacttggttttatgattttatctatatcttttattgttc

SEQ ID NO: 958 - DNA, 1632 bp, Euonymus alatus
acactcttctctcaaatgtcctcctctaccatttctctctgagtccttctagtaagtctgcgagagggactcagtcgatcgttcttctcgagttctacttgtcagctacagctagaattacataatgggtaaggagaagactcacataaacattgtggtcattggccacgtcgactctggaaagtcgacaaccactggacacttgatttataagcttggtggcattgacaagcgtgttattgagagatttgagaaggaagctgctgagatgaacaagaggtcattcaagtatgcctgggtgttggacaaactcaaggctgagcgcgaacgtggtatcaccattgatattgctctgtggaagtttgagaccacaaagtactactgcactgtcattgatgctcctggtcatcgtgactttattaagaatatgatcactggtacctcacaggctgactgtgctgtcctcattattgactccaccactggtggttttgaagctggtatttccaaggatggccagacccgtgagcatgcattgcttgcttttacccttggtgtgaaacaaatgatctgttgctgcaacaagatggatgccacaacccccaaatactcgaaggctaggtatgaggaaattgtgaaggaagtttcttcctacttgaagaaggttggttacaaccctgacaagatcccatttgttcccatctctggttttgagggtgacaacatgattgagagatctaccaaccttgactggtacaagggaccaaccctccttgacgctcttgaccagatctcggaacccaagaggccctcagacaagcccctccgtctccctcttcaggatgtttacaagattggtggtattggaactgtcccagtcggacgtgttgagactggcgtcctgaagcctggtacggtggtgacctttggtcctactggactcacaactgaagttaaatctgttgagatgcaccacgaggctctccaggaggccttgccaggtgacaatgtcggtttcaatgtcaagaatgttgctgtgaaggatctgaagcgtggttttgttgcttctgactccaaaaatgaccctgctaaggaggctgccaacttcacctctcaggtcatcatcatgaaccaccctgggcagattggaaatggctatgccccagtccttgattgccacacatcccacattgctgttaagtttgctgagatattgaccaagattgacaggcgatctggtaaggagcttgagaaggagccaaaatttttgaagaatggtgatgcaggaatggtgaagatgattccaaccaagcctatggtggtggagaccttctctgcgtaccctcctcttggtcgttttgctgtgagggatatgcgccagactgtggctgtgggtgtcatcaagagtgttgataagaaggaagcatctgccgccaaggtcaccaagtctgctgctaagaagaagtgaaagtcagatgtgttttagttgatttctattatctagtgtagttttgttttgttatattttccgtggaagttttgtcatttgtggacatcttcggtctttgtttcttggttgtattatcagtcattaatgtcgtacgatgatgcgttatgaacattgctgagttt

SEQ ID NO: 959 - DNA, 1896 bp, Euonymus alatus
ccggggatggaaaaacataggcaacaaaaccacctataagactacacgaacccttcttctctccacactcttcacttctcttaccgttcatttcttgcgcggctagggttttagctaagctcttttaagtttgaaggtaagacttgacaatgggtaaagagaagattcacatcagcattgtggttattggccatgtcgactctggtaagtcaacaactactggccacttgatctacaagcttggaggcattgacaagcgtgttattgagagatttgagaaagaagctgctgagatgaacaagagatcattcaagtatgcctgggtgctcgataagcttaaagctgagcgtgaacgtggtatcaccattgatattgccttatggaagtttgagaccaccaagtactactgcactgtcattgatgcccctggacatcgtgacttcattaagaacatgattactggtacctcccaggctgactgtgctgttctgattattgactccactactggaggttttgaagctggtatctcgaaggacgggcagactcgtgagcatgctcttcttgcctttactcttggtgtcaaacaaatgatttgctgctgcaacaagatggatgccaccacgccaaagtactcaaaagctagatatgaggaaattgtcaaggaagtttcgtcctacctaaagaaggttggatacaaccctgataagattccatttgtccccatatctggatttgagggtgataacatgattgagaggtccaccaaccttgattggtacaagggtccaacccttcttgatgcccttgaccaggtcagtgaacccaagagacccacagacaagccactccgcctcccacttcaagatgtatataagattggtggaattggaactgttccagtgggccgtgttgagactggtatcctcaagcctggtatggttgttacctttggtccctctgggttgacaacggaagttaagtctgtggagatgcaccatgaagctttgcaagaggctcttcctggggacaatgtcggtttcaatgtgaagaatgttgctgtcaaggatctcaagcgtggttttgttgcctcaaattctaaggatgatcctgccaaggaggctgctaacttcactgcccaagttattattatgaatcacccagggcaaattggaaatggttatgcccccgtgcttgattgccacacttcccacattgcagtcaagtttgctgagttgcttaccaagattgacaggcgatctggcaaggagcttgagaaggagcccaaattcttgaagaatggtgatgctgggttcgtgaagatgattcccaccaagcccatggtagtggaaaccttctctgagtaccctccattgggtcgttttgctgtcagggacatgcgtcagactgttgctgttggtgtcatcaaagctgtggaaaagaaggatcctactggagccaaggtgacaaaatctgctgtcaagaagggcaagtgaatcgtgctgactggcagtagccgtagagaagtttatcatcaaaagtacaataaagactgggttcttgtccagatttcatcgactggatgtttactgctttattttgatggttctagttttaagtcatctccatcatcgcgttcgtactgttcgcagaactgggtactggaccgacggtggcgtggttattttctttttttgtgtgtcgtctgttgagttttgtcatgtcgaacctggactatgttgctactgtttcctaagctttgttcctttgttggacagagtgggtattttatctgcattttaccatttatatctagtatgcgtgttaaaattgtggatctctctctgcttattgtggcttatttgaacttgttgaagttgatttttagtttatgta

SEQ ID NO: 960 - DNA, 1565 bp, Euphorbia peplus
atctaagatgggtaaagagaagattcatatcagtattggggtcattggacatgtcgactctggcaagtccaccactactggacatttgatctataagcttggaggtattgacaagcgtgtgattgaaagatttgaaaaggaagctgctgaaatgaacaaaaggtcattcaagttcccctgggtgcttgacaagcttaaggctgatcgtgagcgtggtatcaccattgatattgccttgtggaagtttgagaccactaagtactactgcactgttattgatgctcctggacacagggactttatcaagaacatgattactggaacttctcaggctgactgtgctgttcttatcattgattccactactggtggttttgaggctggtatctcaaaggatggtcaaacccgtgagcatgctctccttgctttcaccctcggtgtcaagcaaatgatctgttgctgtaacaagatggatgcaacaactcccaagtactctaaggccaggtacgaggaaattgtcaaggaagtgtcttcctacctcaagaaggttggatacaaccctgacaaaattccattcgtgccaatctctggattcgaaggtgacaatatgattgagagatcaaccaacctcgactggtacaagggacccactttgcttgatgcacttgaccagatcaatgagccaaagaggccatcagacaagccccttcgtctacctcttcaggacgtgtacaagattggaggtattggaactgtgccagtgggtcgtgtggagactggtatcatcaagccgggtatggtggtgacctttggacccagtggactgaccactgaagttaagtcagttgagatgcatcacgaggctctacaggaggctcttccaggtgacaatgtggggttcaatgtgaagaatgtggcagtgaaggatcttaagagaggtttcgttgcatccaactctaaggatgacccagccaaggaagcagccaacttcacatctcaggttattatcatgaaccaccctggccagattggaaacgggtatgctccagtcttggattgccacacctcccacattgctgtcaagttctctgagatcctgaccaagattgatcgccggtctggaaaggagctagagaaggagccaaagtttttgaagaatggagatgcaggtatgattaagatgattccgaccaagcctatggtggtagagaccttcgctgagtaccctcctttgggacgttttgctgtgagggacatgagacagactgttgctgttggtgtcattaagagtgtggagaagaaggacccatccggagccaaggtcaccaagtctgctgccaagaagaagtgagatttttctccatgatttgtttaccattgatgacatttttgagtaccaagtcttggtatctttgctatgtttaatagttttgctttatgttaagtgtactctactgctctttcattttgacatttaggctttttgaatgcagtaattttcttggtataccattttgtggtggatattgagttctgaaaaaaaattgagttaattctgtttgctt

SEQ ID NO: 961 - DNA, 1803 bp, Linum usitatissimum
cattagggcctggggaagcgaggctcccttcttcgtccttgcctcataacgctcttctcttttgacactgcgactgtggaggagctagcttcactatcaacaatccgtcttctgagtttctgcgcctactgctaccatgggtaaagagaaggttcacatcaacattgtggtcattggccacgtcgactctggaaagtcgaccaccactggtcacttgatctacaagttgggaggtattgacaagcgtgtgattgagaggttcgagaaggaagctgctgagatgaacaagcgttcattcaagtacgcatgggtgttggacaagctcaaggctgagcgtgagcgtggtattaccattgatattgctctctggaagttcgagaccaccaagtactactgtacagtcattgatgcccctggacatcgtgatttcatcaagaacatgatcactggtacttcccaggctgattgtgccatccttatcatcgactccaccactggtggttttgaggctggtatctccaaggatggacagacccgggagcatgctctgcttgccttcacccttggtgtgaagcagatgatctgttgctgtaacaagatggatgctaccacacccaagtactccaagtccaggtttgatgaaatcgtgaaggaagtttcatcctacttgaagaaggtcggatacaaccctgacaaaatcccattcgtgcccatctctggattcgagggtgacaacatgattgagaggtctaccaacctcgactggtacaagggaccaaccctccttgaggctcttgaccaaatcaacgagcccaagaggccctcagacaagcccctccgtctgccacttcaggatgtgtacaagatcggaggtattggaactgtgccagtgggacgtgttgagactggtgtcctgaagcctggtatggttgttaccttcggcccaactggtctgaccactgaagtcaagtctgtggagatgcaccacgaagctctccaggaggctcttccaggagacaacgttgggttcaacgttaagaatgttgctgtgaaggatatcaagcgtgggtatgttgcatccaactccaaggatgacccagccagggaagctgccaacttcacctcccaggttatcatcatgaaccaccctgggcagatcggcaacggatatgcaccagtgctggattgccacacctcccacattgccgtcaagttctcagagatcctgaccaagattgacaggcgatctggtaaggagctggagaaggagccaaagttcttgaagaacggtgatgctggtatggtgaagatgattcccaccaagcccatggttgtggagactttctcccagtacccacctttgggtcgttttgcagtgagggacatgcgtcagactgttgccgtcggcgtcatcaagagtgtggagaagaaggacccgtccggtgcaaaggtcaccaagtctgctgccaagaagaaatgaggagtttcacttgtgctcaagtgttggtttagtttaccgtttctgtttctgctgtcgccgtcgtcgtcgtccagaactgtgttggtattttgttgcgtttttaaattgggatgttgaatcaagttttgtgaacgattacaatttcggatggttgatgctaagtatctgtttgagcagttgagactttttactatatttctgtcttattcctttctttactcttctgcattttggaatcatgtttacctgaatagcatttgcttactatttcaaaccaacatcatgtcacctgtatggtgaacttgatattcagagctcctccc

SEQ ID NO: 962 - DNA, 1595 bp, Linum usitatissimum
gcgtttcttcattcattcacagtcctgcgcttgagtgaattcactatgggtaaggaaaaggttcatatcaacattgtggtcattggacatgtcgactctggcaagtccaccaccactggtcacttgatctacaagctaggaggtattgacaagcgtgtcattgagaggttcgagaaggaagctgctgagatgaacaagaggtcattcaagtacgcatgggtgttggacaagcttaaggctgagcgtgagcgtggtatcactattgatattgctctgtggaagttcgagaccactaagtactactgcactgtcatcgatgcacctggacatcgtgatttcatcaagaacatgattactggtacctcacaggctgactgtgccatccttattattgactccaccactggtggttttgaagctggtatctccaaggatgggcagacccgtgagcatgctcttctggccttcacccttggtgtgaagcagatgatctgctgctgtaacaagatggatgccaccactcccaagtactcgaagtccaggttcgatgaaatcgtcaaggaagtttcatcctacttgaagaaggtcggatacaaccctgacaaaatcccattcgttccgatctctggtttcgagggtgacaacatgattgagaggtcaaccaaccttgactggtacaagggcccaacccttcttgaggctctggaccagatcaacgagcccaagagaccctcagacaagcccctccgtctgccacttcaggatgtgtacaagatcggtggtattggaactgtgccagtgggacgtgtggagactggagtcctcaagcctggtatggtcgtcaccttcggccctactggtctgaccactgaagtcaagtccgtcgagatgcaccacgaagctctgcaggaggctcttccaggtgacaacgttggtttcaatgttaagaatgttgcagtcaaggatatcaagcgtggctacgttgcttccaactccaaggatgaccccgccagggaagctgccaacttcacatctcaggtcatcatcatgaaccaccctggtcagattggaaacggatatgctccagtcctggattgccacacctcccacattgctgtgaagttctctgagatcctcaccaagattgacaggcgatctggtaaggagcttgagaaggagcccaagtttttgaagaatggtgatgcaggtatggtgaagatgatcccaaccaagcccatggttgtggagactttctcccagtaccctcctcttggacgttttgccgtcagggacatgagacagactgttgcagtgggagtcatcaaaagcgtcgagaagaaggacccatctggtgccaaggtcaccaagtctgcagccaagaagaaatgatgtggtgcagtttgagaaaacggttgctgttttaagtgtttttagagttctatttctgtcatgtctctggacaattgtgtttgtttctgtgtttcggaatttttgtgaacggattacagtatcggatggttttggatggatgtgtgtttctaataggatgatgatatttcgctatacatctgcgcccatggtattatttcgttgtg

SEQ ID NO: 963 - DNA, 1396 bp, Ipomoea batatas
tccttctctctctttccctgcatctcgatatcgtttttattaaatagaatgggtaaggagaaggttcacattaacattgtggtcattggccatgtcgactctggtaagtcgaccactactggtcacttgatctacaagcttggaggaattgacaagcgtgttattgagaggtttgagaaagaagctgctgagatgaacaagaggtctttcaagtatgcctgggtgcttgacaagctcaaagctgagcgtgagcgtggtatcaccattgatattgccttgtggaaatttgagaccaccaagtactactgcactgtcattgatgcccctggacatcgtgactttatcaaaaacatgattacgggtacctcacaggcagactgtgctgtcctcattattgactccaccactggtggttttgaggctggtatttccaaggacggacagacccgtgagcatgctttgcttgctttcacccttggtgtgaggcaaatgatttgctgctgtaacaagatggatgccaccacccccaaatactctaaggctaggtatgatgaaattgtgaaggaagtctcatcctacatgaagaaggtgggatacaaccctgaaaagattccatttgttcccatctctggttttgagggtgacaacatgattgagaggtcaaccaaccttgactggtacaagggaccaactctccttgaggctcttgacatgatccacgagcccaagaggccatctgacaagcccctccgacttccacttcaggatgtgtacaagatcggtggtattggaactgtccctgtgggtcgtgtggagactggtatcctgaagccgggtatggttgttacatttggaccttctggtcttaccactgaagttaagtctgttgaaatgcaccacgaagcccttcaggaggcacttcccggtgacaatgttgggttcaatgtgaagaatgttgctgtgaaggatctgaagcgtggttatgttgcctcgaactccaaggatgaccctgccaaaggagctgctaacttcacctctcaggtcatcatcatgaaccaccctggacagatcggtaatggatatgctccggtgctggactgccacacctcccacattgcagtcaagtttgctgaacttttgaccaagattgatagacggtctggtaaggagctggagaaggaacccaagttcctgaagaatggtgatgctggtatggtgaagatgattcccaccaagcccatggttgttgaaaccttctctgagtacccaccacttggtcgttttgctgtgagggacatgagacaaacggttgcagttggtgttatcaagaatgttgacaagaaggatccaactggtgccaaggtcaccaaggctgcccagaagaagaagtgagcat

SEQ ID NO: 964 - DNA, 1729 bp, Ipomoea nil
tcttattcctctcagcgttctccagtccagagtcctctccgtctctctctttccctgcatctcgttattgattttattgaatagaatgggtaaggagaaggttcacattaacattgtggtcattggccacgtcgactctggtaagtcgaccactactggtcacttgatctacaagcttggaggaattgacaagcgtgttattgagaggtttgagaaagaagctgctgaaatgaacaagaggtcattcaagtatgcctgggtgcttgacaagctcaaagctgagagggaacgtggtatcaccattgatattgccttgtggaaatttgagaccaccaagtactactgcactgtcattgatgcccctggacatcgtgactttatcaaaaacatgattactggtacctcacaggcagattgtgctgtcctcatcattgactccaccactggtggttttgaggctggtatttccaaggatggacagacccgtgagcatgctttgcttgctttcacccttggtgtgaggcaaatgatttgctgctgtaacaagatggatgccactacccccaaatactcgaaggccaggtacgatgaaattgtgaaggaagtctcatcctacatgaagaaggtgggatacaaccctgacaagattccatttgttcccatctctggttttgagggagacaacatgattgagaggtcaaccaaccttgactggtacaagggaccaaccctccttgaggcacttgacctgatccatgagcccaagaggccatctgacaagcccctccgacttccacttcaggatgtgtacaagattggtggtattggtactgtccctgtgggtcgtgtggagactggtgtcctgaagcccggtatggttgttacatttggaccttctggtcttaccactgaagttaagtctgttgaaatgcaccacgaagcccttcaggaggcacttcctggtgacaatgttgggttcaatgtgaagaacgttgctgtgaaggatcttaagcgtggttatgttgcctcaaactctaaggatgacccagccaaaggagctgcgagcttcacctctcaggtcatcatcatgaaccaccctggacagatcggtaatggatatgctcctgtgctggactgccacacctcccacattgcagtcaagtttgctgagcttttgaccaagattgatagacggtctggtaaggagctggagaaggagcccaagttcctgaagaatggtgatgctggtatggtgaagatgcttcccaccaagcccatggttgttgaaaccttctctgagtacccaccacttggtcgttttgctgtgagggacatgagacaaacggttgcagttggtgttatcaagaatgttgacaagaaggacccaactggtgccaaggttaccaaggctgctcagaagaagaagtgagcatgtgttgctattgaatctcttctttaaaggactatctttttttatctgcttttgttatttaaattttgataaacttttaagactttctgatatagccctttgtaagactttttattatatggctctagttgctcattccattgtgccctgccttgcaaccaatgattcttatagtgggagcaattttgtgtttacttggttgcttaacgggcagtgatggaagcttatctggatgccatttatttatactcgtctactgttttagatatgtgcagacttttgtcggttaaaacagtt

SEQ ID NO: 965 - DNA, 1648 bp, Lolium multiflorum
cccctgcccgccgccgccgctgctgcttcgacctcttcgccttctcgggagctcaagcgagttaacagctccagcagccatggggaaggagaagattcacatcagcattgtggtcattggacatgtcgactccggcaagtccacgaccactggtcacctgatctacaagcttggaggcatcgacaagcgtgtgatcgagaggttcgagaaggaagctgctgagatgaacaagaggtccttcaagtacgcctgggtgcttgacaagctcaaggccgagcgtgagaggggtatcaccatcgatatcgccctgtggaagtttgagaccaccaagtactcctgcaccgtcattgatgctcctggtcaccgtgacttcatcaagaacatgatcactggtacctcccaggctgattgtgctgtgcttatcattgactccaccactggtggttttgaggctggtatctccaaggatggccagacccgtgagcatgctctccttgctttcacccttggagtgaagcagatgatctgctgctgcaacaagatggatgccaccacccccaagtactccaagggccgttacgaggaaatcgtgaaggaggtctcctcatacctgaagaaggtcggctacaaccctgacaaggtcccatttgtccccatctctgggttcgagggtgacaacatgattgagaggtccaccaaccttgactggtacaagggccccaccctccttgaggctcttgaccagatcaacgagcccaagaggccctcggacaagcccctgcgtcttcccctccaggacgtttacaagattggtggcattggaactgtgccggtggggcgtgttgagacaggtgtgatcaagcctggccagctcgtcacctttggcccaactgggctgaccactgaggtcaagtctgtggagatgcaccacgagtctatgcttgaggctggtccaggtgacaatgttggcttcaacgtcaagaatgtggctgtgaaggatatcaagcgtgggtatgtggcctccaatgccaaggacgacccagccaaggaggctgccagctttgttgcccaggtcatcatcatgaaccaccctggtcagatcggcaacggctacgccccagtgctggactgccacacatcccacatcgccgtcaagttctctgagatccagaccaaggttgacaggcgatctggtaaggagattgaggccttccccaagttcctcaagaacggcgatgctggtttcgtgaagatgattcccaccaagcccatggtggtggagaccttcgcccagtaccctccccttggtcgctttgctgtgcgcgacatgaggcagaccgtcgctgttggtgtgatcaagagcgtggagaagaaggatcccactggcgccaaggtgaccaaggctgccgccaagaagaaatgagatgatgcctggtggttgtctgctactacacccgcagtagtggtggtggtatatcgtgatgttaggagtgttagtgtgtttgggaacttgccccgttttgtcgagtttggttatgtgcgcgtcgagcagcctttgtgctgcttatcattctatcttctgtttgtgttggtgaactattggcatgctatgttcggttacagttgctactttatatatagcaggtca

SEQ ID NO: 966 - DNA, 1513 bp, Lolium multiflorum
gactctggcaagtcgacgaccactggtcacctgatctacaagcttggaggcattgacaagcgtgtgatcgagaggttcgagaaggaagctgctgagatgaacaagaggtccttcaagtatgcgtgggtgcttgacaagctcaaggctgagcgtgagagaggtatcaccatcgatatcgctctctggaagttcgagacaaccaagtactactgcactgtcattgatgcccctggacaccgtgatttcatcaagaacatgatcaccggtacctcccaggctgactgtgctgttctcatcattgactccaccactggtggttttgaggctggtatctccaaggatggccagacccgtgagcatgctctccttgctttcacccttggtgtgaagcagatgatctgctgctgcaacaagatggatgccaccactcccaagtactcgaagagccgttatgaagaaattgtgaaggaagtctcatcctacctgaagaaggttggctacaaccctgagaaggtcccatttgtccccatctctggttttgagggtgacaacatgatcgagaggtccaccaaccttgactggtacaagggcccaaccttgcttgaggctcttgaccagatcaacgagcccaagaggccctcagacaagcccctgcgtcttccccttcaggacgtttacaagattggtggcattggaactgtgcctgttggccgtgttgagactggtaccatcaagccaggcatggtggtcacctttggtcccactggtctgaccactgaggtcaagtctgttgagatgcaccatgagtctctcctggaggcgctccctggtgacaatgttggcttcaatgtcaagaatgttgctgtgaaggatctcaagcgtgggtttgtggcatccaactccaaggatgaccctgccaaggaggctgccagtttcacctcccaggtcatcatcatgaaccaccctggtcagatcggcaatggctacgccccagtgcttgactgccacacctcgcacattgctgtcaagtttgctgagctggtcaccaagattgacagacgatctggtaaggagattgagaaggagcccaagttcctgaagaatggtgatgctggtattgtgaagatgattcccaccaagcccatggtcgttgagaccttcgccacttaccctcctcttggtcgctttgctgtgcgtgacatgagacaaacagttgctgttggtgtcatcaagggtgtggagaagaaggacccaaccggtgccaaggtgaccaaggctgctgccaagaagaaatgaggcatcttatagttggtcctttcagttgatatatatctagatctctttttgttcctgtggtgatgcggtaagggtagttgttattcagcgtttagctctgtctgcaatgtgctcttgtaccgtttaaaacactgtcctgttatttgagctttgtggaaacctggaggatgtgtaagactcggtttgtgtttttatgggctgtggaatgtgattcggt

SEQ ID NO: 967 - DNA, 1482 bp, Pennisetum glaucum
gtggtcattggccatgtcgactctggcaagtcgaccaccactggccacctgatctacaagcttggaggtattgacaagcgtgtgatcgagaggttcgagaaggaggccgcagaaatgaacaagaggtccttcaagtatgcgtgggtgcttgacaagctgaaggctgagcgtgaaagaggtatcaccatcgacattgccctgtggaagttcgagaccaccaagtactactgcacggtcatcgatgcccctggtcaccgtgacttcatcaagaacatgatcaccggcacctcccaggctgactgcgctgtcctcatcattgactctaccactggtggttttgaggctggtatctctaaggatggccagacccgtgagcatgctctccttgctttcactcttggagtgaagcagatgatctgctgctgcaacaagatggatgccaccactcccaagtactccaaggcccgttatgatgagattgttaaggaagtctcctcgtacctcaagaaggtgggttacaacccagacaagattgccttcgtccccatctctggtttcgagggtgacaacatgattgagaggtccaccaaccttgactggtacaagggcccaaccctgcttgaggctcttgaccagatcaacgagcccaagaggccttccgacaagcccctgcgtctcccccttcaggacgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcctggtgacaatgttggtttcaatgtgaagaacgttgctgtgaaggatctcaagcgtggttatgtggcctccaactccaaggatgaccctgccaaggaggctgccagcttcacctcccaggtcatcatcatgaaccaccctgggcagatcggcaatggctatgccccagtgctggactgccacacctcccacattgctgtcaagtttgctgagcttgtcaccaagatcgacaggcggtctggtaaggagctcgagaaggagcccaagtttctgaagaacggtgatgctggtatggtgaagatgattcccacgaagcccatggttgtggagacattctctgagtacccccctcttggtcgctttgctgttcgtgacatgaggcagacggttgctgttggtgtcatcaagagcgtcgagaagaaggatcccactggtgccaaggttaccaaggctgctgccaagaagaaatgaggggtctgagggttattgtcgtcgtagtagtcctagtgcggttttgaggttttgttaggccattgttcttgcagcagggccttgcagttccacgcgactgtaatttctgctggcaatgcgctctactgtctggtgtctatgtaaacgctactgttatttggttgtggt

SEQ ID NO: 968 - DNA, 1837 bp, Elaeis guineensis
tacgcggggcccaaaaccctcgttagagctcctggccgtctgtctctctcgagcgccggcactccgctaggttattattcgtgccttagttgttggttgcagctatcatggggaaagaaaaggttcacattaacattgtggtcattggtcatgtcgactctggtaagtcgaccaccactggccatctcatttacaagcttggtggtattgacaagcgggtgattgagaggtttgaaaaggaagctgctgaaatgaacaagaggtcattcaagtatgcctgggtcctagacaaacttaaggctgagcgtgagagaggaattaccattgacattgctctctggaaatttgagaccactaagtactactgcactgttattgacgctcctggacaccgtgacttcatcaagaacatgattactggtacttctcaggctgattgtgctgttcttatcattgactcgaccactggtggttttgaagctggtatttcaaaggatggtcagacacgtgagcatgccttgcttgctttcactcttggggtgaaacagatgatttgctgctgtaacaagatggatgcaacaacccccaaatactcaaaggccaggtatgatgaaattgtgaaggaagtttcttcttacctcaagaaggtgggctacaacccagagaaaatcccttttgttcccatctctggattcgagggtgataatatgattgagcggtccaccaacctggattggtacaagggtcccacccttcttgaggcccttgacatgatcctggagccgaagaggccctcggacaagccccttcgccttccacttcaggatgtctacaagatcggaggtattggcactgttccagttggacgagttgaaactggtatcctcaagcctggtatggttgttacctttggtccctcaggtttgacaactgaagtcaagtcagttgagatgcaccatgaagccctccaggaagctctccctggtgacaacgtgggcttcaatgtgaagaacgttgctgtcaaggatctcaagagaggttatgttgcatcgaactcaaaggacgatcctgccaaggaggctggcagcttcacttctcaggtcatcattatgaaccatcctggtcagattggcaatggctatgcccccgtccttgattgccacacctcacacattgctgttaagtttgctgagatcctcaccaagattgacaggcgatctgggaaggagcttgagaaggagcccaaattccttaagaatggtgatgctggttttgtgaagatgattccaaccaagcccatggttgtggagactttttctgcgtatccaccacttggtcggtttgctgtgagggacatgcgccagactgtggctgtgggagtcatcaagagtgtcgagaagaaggatccaactggtgctaagattaccaaggctgctgcaaagaagaagtgaaacatgcgttctgaatgggttgtggccagaggctctgggaaattagtagttaatagtgttgctttgatttttcatgttgtttgctataggtattggtcgatgccattatctctatttggcagttggttgcagaactgggtgcttgataggcggtggtggagacccttgtggttttgtggagtcccatggggttttggtgtgtctttatttctgtgattttggtttacatcatatctattgttgcattgagacttttctccaaagctgcttcggagtttttaggtctgcttctgagcagctcggatagttttgttatattaagatacactatcttttaatgttcatgaattttaaataaattgcttgtttcaatcaaaaaaaaaaaa

SEQ ID NO: 969 - DNA, 1715 bp, Elaeis guineensis
ctctcggttctcgcggccccaattccgttcttgagtaggggttctatcgctctgccgcggacgaccgagcaatcatgggtaaggaaaaggtgcacattaacattgtggttattggccatgtcgactctgggaagtcaaccactactggacaccttatctacaagcttggtggcattgacaagcgtgtgattgagagattcgaaaaggaagcagctgaaatgaacaagaggtcattcaagtatgcttgggttcttgacaagctgaaggctgagcgagagcgtggtatcacaattgatattgctctctggaagtttgagaccacaaagtactactgcaccgtcattgatgcccctgggcatcgcgacttcatcaagaacatgataacgggcacctctcaagctgattgtgcagtccttattatagactctacaactggtggttttgaggcaggtatctcaaaggatggacagacacgtgaacatgcattgcttgcctttactcttggtgtgaagcagatgatctgctgttgcaacaagatggacgccacaactccaaagtactcaaaggctaggtatgatgaaatcgtgaaggaagtttcttcttacctcaagaaggtgggttacaacccagagaagattccttttgttcccatctctggatttgagggtgacaatatgattgagaggtccaccaacctggagtggtacaagggtcccacccttcttgaggccctcgacatgatccaggagcccaagaggccctcagacaagcctctccgcctgccacttcaggacgtgtacaagattggtggcattggtactgtcccagtcggacgtgttgaaactggcattctcagacctggcatggtggttactttcggtcccagcggtctgacaactgaagtcaagtctgtggagatgcaccatgaggccctgcaggaggcccttcctggtgataatgttggtttcaatgtcaagaatgttgctgtcaaggatctcaagcgtggttttgtggcctctaactcgaaggatgatcctgcgaaggaggcagccagcttcacttctcaggtcattatcatgaatcatcctggtcagattggcaatggctatgctcctgtgcttgactgtcacacctcccacattgctgttaagtttgctgagatccttaccaagattgacagacggtctggtaaggaacttgagaaggaacccaaatttttgaagaatggtgatgctggttttgttaagatgattcccaccaagcccatggtcgttgagaccttctcagcgtacccaccacttggtcgtttcgctgtgagggacatgcgccagacggtggctgttggtgtcatcaagagtgttgagaagaaggacccaactggtgccaagatcaccaaggctgctgccaagaagaagtgaacaatgtcatcaagtgcctggtagtggtagtattagatggctttgtagcctgtttttagtgttggtagagggggcatcggtctttcggttttctgctgcccatttttctggatggaggcggctggattctcagctggaggcggtggttctttttgcaagttctttcccttgtttatttttccgttttgagtttggattaaatccacaaacagcttaaaattcagaagtcctttttgttttttgttggatgacgaaagttttggacatctgattggaaaattttgagaacagcattta

SEQ ID NO: 970 - DNA, 1667 bp, Phalaenopsis aphrodite
cctagttttgctccgagctcacgtcggcagagccgcgccttcttctcctcttgctagtagttttctccggccatgggtaaggagaaggtacacatcaacattgtggtcattggccatgtcgactccggcaagtccaccaccaccggccatctcatttacaagcttggcggtattgacaagcgcgtgattgagcggtttgagaaggaggctgccgaaatgaacaagaggtcattcaaatatgcctgggttctcgacaagctcaaggcggagcgcgagagaggaatcaccattgatatcgctctttggaagttcgagacaactaagtactattgcactgttattgatgctcccggccatcgcgacttcatcaagaacatgattactggaacttctcaggctgactgtgctgtcctgatcatcgattccaccactggtggttttgaagctggtatttcgaaggatggccagactcgtgagcatgctttgcttgctttcactcttggggtgaagcagatgatttgctgctgcaacaagatggatgccaccactcccaagtattcaaaggctaggtatgatgaaatcgtcaaggaagtctcttcctatctgaagaaggttggctacaaccctgaaaagattccatttgttcccatctctgggtttgagggtgacaacatgatagagagatccacaaaccttgactggtacaagggtccaactcttctcgatgctctcgacctgatccaagagcccaagaggccaacggacaagcccctccgcctcccccttcaggacgtctacaagatcggtggcattggaaccgtccccgtcggtcgagtcgagactggcgttttgaagcctggcatggtagtcacctttggtcccaccggtctcaccactgaagtaaagtctgttgagatgcaccatgaagctcttcaggaggccctccctggcgacaatgttgggttcaatgtgaagaatgttgcagtaaaagatctgaagcggggtttcgttgcctcaaactccaaggatgatcctgccagggaagccgccaacttcacttcccaggtcatcataatgaatcaccctggtcagattggcaacggctacgctcccgtgctggactgccacacctcccacatagctgtcaaatttgccgaaatcctgaccaagatcgacaggcggtctggcaaggagctcgagaaggagccaaagttcctgaagaatggcgatgcgggtttcgtgaagatggttcccacgaagccgatggtggtcgagaccttctccgagtatcctccactgggccgtttcgccgtaagggacatgaggcaaactgtggctgttggagtcatcaagagcgttgagaagaaggatcccagtggagccaaggttaccaaatctgctgccaagaagaaataaccaaaagccttcctaatttattggtaagattgtatcgttatatatatacttctatatattttgtgagttttatttatgctttagtcttcgagtcctctagtaagagtgtctaatccggtatcgctatcttgcatccatttgaatgagtgggtgtcggatgggcgctggcggtgggattttgatttgtttttatttccatgttgttgagtttatgtgaaccgaacaatatttgtctttaatttatcatgttg

SEQ ID NO: 971 - DNA, 1719 bp, Populus trichocarpa
cctaatctaagaccaaatggcttagtgagtgtcactatttaaacaagcataagcggccattctcgatctctttcgtttgctctctgtaactgcgagagagctccttattttttagattccctaaacttcctttcttcaagtttctctcccaaagttcatcatgggcaaggagaaggttcacattaacattgtggttattggtcatgttgactctggcaagtcaaccactactggtcatttgatctacaagcttggaggtattgacaagcgtgtgattgagaggtttgagaaggaagctgctgagatgaacaaaaggtcattcaagtatgcctgggttttggacaagcttaaggctgagcgtgagcgtggtatcacaattgacattgctctctggaagtttgagacaactaggtactactgcactgtcattgatgcccctggtcatcgtgactttatcaagaatatgatcactggtacctcacaggctgactgtgctgtcctaattattgattccaccactggtggttttgaagctggtatctccaaggatggccagacccgtgaacatgccttgcttgccttcacccttggtgtgaagcagatgatttgctgttgcaacaagatggatgccaccacccccaagtactccaagtctcggttcgatgaaatcgtgaaggaagtttcttcctacctgaagaaggttggttacaaccctgacaagatcccatttgtccctatatctggttttgagggtgataacatgatcgagaggtccaccaaccttgactggtacaagggccccaccctccttgatgctcttgaccagatcagtgagcccaagagacccacagacaagcctctccgtcttccacttcaggatgtctacaagattggtggtattggaactgtacctgtgggacgtgttgagactggtgtcctgaagcctggtatggtcgtgaccttcggccccactggactgaccactgaagttaaatctgttgagatgcaccatgaagctcttcaggaggcccttccaggtgacaatgttggtttcaatgttaagaatgttgctgtcaaggatctcaaacgtggttttgttgcttccaactctaaggatgatcctgccaaggaggctgccaacttcacctctcaggtcatcatcatgaaccaccctggtcaaattgggaatggatatgcccctgtccttgactgtcacacctgccacattgctgtcaagtttgctgagattttgaccaagattgacaggcgatctggcaaagagctcgagaaggagcccaagttcttgaagaatggtgatgctgggtttgtgaagatgattcccaccaagcctatggttgttgagaccttttctgcctatcctcctcttggtcgttttgcagtgagggacatgcgtcagaccgtggcggttggtgtcattaagagtgttgagaagaaggatccatctggtgccaaggtcaccaagtctgcagtaaagaaaaagtgaagtgtttgcttagttacagtttagactagtttatgtctgcttttctgcctgtttgattttatcttctcttctcttcaagttttgagaacagtttacaatttatctttacagtttatgcgtgttttggaattttacaagccgagcttgttatgttttttggttgtttgagacttcgtgaatttaagttctctggtatccagttatctttacctgca

SEQ ID NO: 972 - DNA, 1949 bp, Pseudotsuga menziesii
gccgttctttcaattgtctacgttgcggagagcggaggacgatagagctctgcaattttttctctagtgggaaggcgaagctgctttctgttttgcattcttcgtgttttttcgttccagtgttacttttcgttagataaccatggggaaagaaaagacccacatcaacattgtggtcataggacatgtcgactctggcaagtccaccacaaccggccatcttatttacaagctcggaggtattgataagcgtgtgatcgagcgttttgagaaggaagctgctgagatgaacaaaagatcattcaagtacgcctgggtgcttgacaaactgaaggcagagcgtgaacgtggtattactattgacattgctctctggaagtttgagaccaccaagtattactgcaccgtcattgatgcacctggccatcgtgactttatcaagaacatgattacgggtacctcacaggccgattgtgctgttttgatcattgattcaactacgggaggttttgaagctggtatttctaaggatggacagaccagagaacatgctctcttagctttcactctcggagtgagacagatgatctgttgttgtaacaagatggatgctaccacacccaagtactccaaggcacgttatgaagaaattgtaaaggaagtgtcatcatacttgaagaaggttgggtacaatcccgataaaattccgttcgtccccatttccggatttgaaggagacaacatgattgagaggtccaccaatctggattggtacaagggaccaactctattagaagcccttgaccaggtgtctgagccgaaaaggccatctgacaaaccccttcgattgccactacaagacgtgtacaagattggtggtattggaactgtgccagtgggacgtgttgaaactggtattattaagcctggtatggttgtgacctttggtcctactgggttgacaactgaagtaaaatctgtagaaatgcatcatgaagctttgctggaggcatcacccggtgacaatgttggttttaacgtgaagaatgttgcagtcaaggatttgaagcgagggtatgttgcctctgactccaagaatgatccagcaaaggaagcagctaacttcaccgctcaggttatcatcatgaaccatcctggacagattgggaatgggtatgctcctgtgttggactgccacacttcccacattgctgttaagttcgctgaaattatgaccaaggtcgatagacgatctggcaaagaacttgagaaggagccaaaatttcttaagaatggagatgctgggtttatcaagatgatgccgtccaaacccatggttgtggagacattctctgagtatcctccattggggcgtttcgccgtgagagatatgcgtcaaactgttgctgttggagtcatcaagagtgtcgaaaagaaggatcccaccggtgccaaggtcacaaaggctgcggccaagaagaaatgaaatttgttgctaccaagtgcttctttgcagaggaagggagaggggcatggatatcatatagctatgtggtgtaaatgcttgtttcattccgttgcacgagatttggtagttaggggactggtagctcggcgcatgcagacatgggttcttgacagacggtggcaccaaatattcagactgctatttattattcctagtcgttagtaatttgggcgggtttagtatatctttgtgggtgagggtagtactgcatctagattttcgacaccattgcaactgcaatttaattgcggcactttatttttctgcgttgttgaagacttgtgttttgattgaaattatgaacatcttttgcgttaaaaggttttggatgatgtttgtgtctttttattttaatagacagattgaaaatacatggtttgttgttctggaaaaaaaatgatttgctagggactgtcttagg

SEQ ID NO: 973 - DNA, 1589 bp, Selaginella moellendorffii
gcggctagggttcctcggcccttctttcgtcttctgcgcaggtagcagccatgggtaaggagaaggctcacatcaacatcgtggtcattggacatgtcgactccggcaagtccactaccacggggcatctcatctacaagctgggaggaatcgataagcgaacgatcgagaggttcgagaaggaggcggccgagatgaacaagcggtcgttcaagtacgcctgggtgctggacaagctcaaggctgagcgcgagcgtggaatcactatcgatattgcgctgtggaagttcgagaccaacaagtactactgcaccgtcatcgacgctcccggtcaccgtgatttcatcaagaacatgatcacgggaacttcccaggctgactgcgctgttctcatcatcgattccaccactggaggtttcgaggctggtatctccaaagatggtcagacccgtgagcacgctcttctcgcttttactcttggagtgaagcagatgatctgctgctgtaacaagatggacgctaccacccccaagtactccaaggcgaggtacgaagaaatcgtcaaggaggtgtcgtcctacctcaagaaggtcggctacaaccctgacaagatccctttcgttcccatttccggtttcgagggtgacaacatgatcgagaggtcgaccaacctcgaatggtacaagggcccgactcttctcgaggctttggaccaggtgaccgagcccaagaggccttcggacaagcccctccgcctcccactccaggacgtttacaagatcggaggaattggaaccgttcccgtgggacgagtggagaccggagtcctgaagcccggtatggtggtgactttcggcccaaccggactgacgactgaggtgaagtccgtggagatgcaccacgagtcccttgtggaggcactccccggtgacaacgtcgggttcaacgtgaagaacgtcgcggtgaaggatctcaagcgtggtttcgtggcttctgactcgaagaacgacccggccaaggaggctgccagcttcacttcccaggtgatcatcatgaaccacccgggacagattggaaacggctacaccccggtgctcgactgccacacctctcacatcgccgtcaagttcgccgagatcctgaccaaggtggacaggcgatccggaaaggagctggagaaggagcccaagttcctgaagaacggtgacgctggtttcgtgaagatgctgccgaccaagcccatggttgtggagacgttcgcggagtatcctccattgggacgctttgcggtgcgtgacatgaggcagacggtggcagtgggagtgatcaaagccgtggagaagaaggaacccaccggtgccaaggttaccaaggcggcggccaagaagaaatgactagttatttggagctggagagataagtttgttgctgttgtggttttggattgcaggatgcagtatgctcgtcgccttcagttctgggttttggacagaaggtggcgagcttaactgtgaactcttttttttactatagtaagaactgttttaactttcatttaattgtggcttaagataaatttattaacatcg

SEQ ID NO: 974 - DNA, 1856 bp, Trigonella foenum-graecum
acaactctcataattcattctcttccttgcgactcactcgattagggtttcagcaccgcaacgcagcgcagtttttctctttcttcacaagatctttttgtgcttttaagtccaaatgggtaaggaaaaggttcacatcaacatcgttgtcattggccatgttgactctggcaagtcaaccaccaccggccacttgatctacaagcttggaggtattgacaagcgtgtcattgagaggttcgagaaagaagctgctgagatgaacaagcgttcattcaagtatgcctgggtgctcgacaagctcaaggctgaacgtgaaagaggtatcaccattgacattgctctctggaagtttgagacaaccaagtactactgcactgtcattgatgcccccggacacagggatttcattaagaatatgatcaccggaacatcccaagctgattgtgccgttctcatcattgattccactactggtggttttgaagccggtatttctaaggatggtcagacccgtgaacatgctctccttgctttcacacttggtgtgaagcaaatgatctgctgctgcaacaagatggatgctactacacccaagtactccaagggtagatatgatgaaattgtgaaggaagtttcatcctatttgaagaaggttggatataacccagacaaaattccatttgttcccatctctggttttgagggagataacatgattgagcgctctaccaatcttgactggtacaagggtcctacacttcttgaggcccttgatcaaatcaacgagcctaagaggccatccgacaagcccctccgactaccacttcaggatgtctacaagattggaggaattggaactgtgcctgtgggacgtgttgagactggtgttttgaaacctggaatggtggtcacttttgcccctactggactgacaactgaagtcaagtctgtggagatgcaccatgaagctctcactgaggcccttcctggtgacaatgtgggatttaatgttaagaatgttgctgttaaggatcttaagcgtgggtatgttgcctcaaactccaaggatgacccagccaaggaggctgctaactttacatctcaagttatcatcatgaatcaccctggtcagattggaaatggttatgcacctgttcttgactgccacacctcccacattgctgtcaagtttgctgagcttgttaccaagattgataggcgttctggtaaggagattgagaaggagcccaaatttctgaagaatggtgatgctggtatcattaagatgattcccaccaagcccatggtggttgagactttctctgaatatcctccactcggccgttttgctgtccgagacatgcgtcaaactgtggctgttggagtcatcaaggctgtagagaagaaggaggctggtgcagctggtaagatcactaagtcggcattgaagaagaagtgaaccgtgcaggatggtctatctagtagcgaagtatacagtcgttattacaataaatggtttttggtccttagtatttctatttctcgtctggttttcttgtttttcagatttggtttgaagtctgcgccgtcatctcgcagcttttgttcccagaactgggttctagatcgacggtggcagggctatttctttttcgtttttatgatttaattgttgtgtctagtgtgaacacttggattctgtaagcaagcagcaagttttcagacctgctgattttgtttttgaatgtcaactctttgtttgtgtgtttattccttggcgttatgtttgagtttttgctgcgggcatgtctctgattgttttatgcaatatagttgctgagaatgttacgagc

SEQ ID NO: 975 - DNA, 1970 bp, Trigonella foenum-graecum
cggccggggcactgctaccactctccacactctcattctcttccttgcggctagggttttagcgcagctttcaccttcaagatctttttgttgttttcagcttttaaggactaatgggtaaggaaaaggttcacatcaacattgtggtcattggtcatgtcgactctgggaaatcaactactactggtcacttgatctacaagcttggaggtattgacaagcgtgtcattgagaggtttgagaaagaagctgctgagatgaacaagcgttcattcaagtatgcctgggttcttgacaagctgaaggctgaacgtgaaagaggtatcaccattgacattgcactctggaagtttgagacaaccaagtactactgcactgtcattgatgcccccggacacagggatttcattaagaacatgatcaccggaacatcccaagctgattgtgccgttctcatcattgattccactactggtggttttgaagctggtatttctaaggatggtcagacccgtgagcatgctctccttgctttcacacttggtgtgaagcaaatgatctgctgctgcaacaagatggatgctactacacccaagtactccaagggtagatacgatgaaattgtgaaggaagtttcatcctatttgaagaaggttggctataaccctgacaaaattccatttgttcccatctctggttttgagggagataatatgattgagcgctctaccaatcttgattggtacaagggtccaacacttcttgaggcccttgatcaaatcaacgagcctaagaggccatccgacaagcccctccgactaccacttcaggatgtctacaagattggaggaattggaactgtgcctgtgggacgtgttgagactggtgttttgaaacctggaatggtggtcacttttgcccctactggactgacaactgaagtcaagtctgtggagatgcaccatgaagctctcactgaggcccttcctggtgacaatgtgggatttaatgttaagaatgttgctgttaaggatcttaagcgtgggtatgttgcctcaaactccaaggatgacccagccaaggaggctgctaactttacatctcaagttatcatcatgaatcaccctggtcagattggaaatggttatgcacctgttcttgactgtcacacctcccacattgctgtcaagtttgctgagcttgttaccaagattgataggcgttctggtaaggagattgagaaggagcccaaatttctgaagaatggtgatgctggtatcattaagatgattcccaccaagcccatggtggttgagactttctctgaatatcctccactcggccgttttgctgtccgagacatgcgtcaaactgtggctgttggagtcatcaaggctgtagagaagaaggaggctggtgcagctggtaagatcactaagtcggcattgaagaagaagtgaaccgtgcaggatggtctatctagtagcgaagtatacagtcgttattacaataaatggtttttggtccttagtatttctatttctcgtctggttttcttgtttttcagatttggtttgaagtctgcgccgtcatctcgcagcttttgttcccagaactgggttctagatcgacggtggcagggctatttctttttcgtttttatgatttaattgttgtgtctagtgtgaacacttggattctgtaagcaagcagcaagttttcagacctgctgattttgtttttgaatgtcaactctttgtttgtgtgtttattccttggcgttatgtttgagtttttgctgcgggcatgtctctgattgttttatgcaatatagttgctgagaatgttacgagcatcttttaatgtccacttgcacaatgcttcgaacatttgttattctgtttctaaattactttgctaagtaggacctttacagcagcaatgttatataagcatgtggttcgtaagtc

SEQ ID NO: 976 - DNA, 1942 bp, Tripterygium wilfordii
aacactgctcttatcgctcctttctcaagcggctagggttattgccaaagttctcttttcagttccaaactaagacttgacaatgggtaaagagaaggttcacatcagcattgtggttatcggccatgttgactctggtaagtcaactactactggccacttgatctacaagcttggaggtattgacaagcgtgttattgagagatttgagaaagaagctgctgagatgaacaagaggtcattcaagtatgcgtgggtgcttgacaagcttaaggctgagcgtgagcgtggtatcaccattgatatcgccttgtggaagtttgagaccaccaagtactactgcactgttattgatgcccctggacatcgtgacttcattaagaacatgattactggtacctcccaggctgactgtgctgttcttattattgactccactactggaggttttgaagctggtatctccaaggatgggcagactcgggagcatgctcttcttgccttcactcttggtgtgaaacaaatgatttgctgctgtaacaagatggatgccaccaccccaaagtattcaaaagctagatatgatgaaattgtcaaggaagtttcttcctatctgaagaaggttggatacaaccctgataagattccttttgtccccatatctggatttgagggtgataacatgattgagaggtccaccaaccttgattggtacaagggtccaacccttcttgatgctctcgaccaggtcaatgaacccaagagaccctcagacaagcccctccgcctcccactacaggatgtgtataagattggtggaattggaactgttccagtgggacgtgttgagactggtatcctcaagcctggtacagttgttacctttggtccctctgggttgacaactgaagttaagtctgtggagatgcaccatgaagctcttcaagaggctctccctggtgacaatgttggtttcaatgtgaagaatgttgctgtcaaggatctcaagcgtggttttgttgcctcaaattccaaggatgatcctgccaaggaggctgctaacttcacagcccaagttattattatgaatcaccctggacaaattggagctggttatgccccagtgcttgattgccatacttcccacattgcagtcaagttcgctgagttgctcaccaagattgacaggcgatcaggcaaggagcttgaaaaggagcccaaattcttgaagaatggtgatgctgggttcgtgaagatgattccctccaagcccatggtggtggaaaccttctctgagtaccctccactgggtcgttttgctgtcagggacatgcgtcagacagttgctgttggtgtcatcaaggctgtggagaaaaaggatcctactggagctaaggtgactaaatctgctgtcaagaagaagtgaatcgtgctggctggtggtagtcatagagaagtttatcatcacaagtacaataaaaaggactgggttcttgtccagatttcttctactggatgtttactgctctgttttgatggttctagttttaagtcgtcaccatcgccgcgttcatgctgttcacagaactgggtactggaccgacggtggcgtgcttattttctttcgtcatgatttgggttgtttgttgagtctgtcaaagtttgaccgtgagtcttgagtatgttgctactgtttcctttctagctttgttactgtgctgaaccagtggttttatctgcagttttaatttatatcagtatgtgtgttgaaattatggatctcatgctctgcttattgttttactttgaatttcgaagtagttgatttgtagttcgtgctgtggtatatctttgtttttttaggattttcatttgttggtttatccgtatttgtgcttgaatagcccattttgtgttcggagctaagataaatgtactattt

SEQ ID NO: 977 - DNA, 2313 bp, Populus trichocarpa
ctttattctattactggctgctacgtggttatcttggaccattagtttaaaaacaatccaacggccgatagagaaaccctaatctaagaccaaatggcttagtgagtgtcactatttaaacaagcataagcggccattcccgatctctttcgtttgctctctgtaactgcgagagagctccttattttttagattccctaaacttcctttcttcaagtttctctcccaaatttcatcatgggcaaggagaaggttcacattaacattgtggttattggtcatgttgactctggcaagtcaaccactactggtcatttgatctacaagcttggaggtattgacaagcgtgtgattgagaggtttgagaaggaagctgctgagatgaacaaaaggtcattcaagtatgcctgggttttggacaagcttaaggctgagcgtgagcgtggtatcacaattgacattgctctctggaagtttgagacaactaagtactactgcactgtcattgatgcccctggtcatcgtgactttatcaagaatatgatcaccggtacctcacaggctgactgtgctgtcctaattattgattccaccactggtggttttgaagctggtatctccaaggatggccagacccgtgaacatgccttgcttgccttcacccttggtgtgaagcagatgatttgctgttgcaacaaatggatgccaccacccccaagtactccaagtctcggttcgatgaaatcgtgaaggaagtttcttcctacctgaagaaggttggttacaaccctgagaagatcccatttgtccctatatctggttttgagggtgataacatgatcgagaggtccacaaaccttgactggtacaagggccccaccctccttgatgctcttgaccagatcagtgagcccaagagacccacagacaagcctctccgtcttccacttcaggatgtctacaagattggtggtattggaactgtacctgtgggacgtgttgagactggtgtcctgaagcctggtatggtcgtgacctttggccccactggactgaccactgaagttaaatctgttgagatgcaccatgaagctcttcaggaggcccttccaggtgacaatgttggcttcaatgttaagaatgttgctgtcaaggatctcaaacgtggttttgttgcttccaactctaaggatgatcctgccaaggaggctgccaacttcacctctcaggtcatcatcatgaaccaccctggtcaaattgggaatggatatgcccctgtccttgactgtcacacctgccacattgctgtcaagtttgctgagattttgaccaagattgacaggcgatctggcaaagagctcgagaaggagcccaagttcttgaagaatggtgatgctgggtttgtgaagatgattcccaccaagcctatggttgttgagaccttttctgcctatcctcctcttggtcgttttgcagtgagggacatgcgtcagaccgtggcggttggtgtcattaagagtgttgagaagaaggatccatctggtgccaaggtcaccaagtctgcagtgaagaaaaagtgaagtgtttgcctagttacagtttaggctagcttatgtctgcttttctgcttgtttgattttattttctcctctcttcaagttttgagaacagtttacaatttatctttacagtttatgcgtgttttggaattttacaagccgagcttgttatgttttttggttgtttgagacttcttcgtgaattaaagttctctggtatccagttatctttacctgcatcatctcagtcatcaatgtttgtataattgttggtcttgccagttttctggctttgctctggcccttgctattgatttagatgagaaaataacgttcccgatgctgtcacaaaaactaaagcttcaactggaaacgatgctttcccatccttgtacaagatgatgatcccctgtttcaactttcgaaggaatggacatgcctttggagcctgaaggaatttgctttggtgttcttactattctgctgtccgaaattagatgggtggaagcttttatgcgccccactcaagctgttgaaaccataacatccctcgttacatcacggaagctgcccatctttgacgtgaagatgaagaagctatgatagcagttttgactggaaatgttgtagtgattaaatgtttgttattgagtggagaagaataattagacacggacaacgtatccatcatcatcagttggaacaagtaacaaattgctattaatagtataatccatttcatgttgttcgagtc

SEQ ID NO: 978 - DNA, 1696 bp, Brassica juncea
gctctcatttcagtttcgtagccgcaagtcctcctctcagattcttacttgcagctatgggtaaagagaagtttcacatcaacatcgtggtcattggccatgtcgactctgggaaatcgaccaccactggtcacttgatctacaagcttggtggtattgacaagcgtgtcattgagaggttcgagaaggaagctgctgagatgaacaagaggtctttcaagtacgcgtgggtgttggacaaacttaaggccgagcgtgagcgtggtatctaccattgatattgctctctggaagttcgagaccaccaagtactactgcacggtcattgatgcccctggtcatcgtgatttcatcaagaacatgattactggtacctcccaggctgattgtgctgtcctcatcattgactccaccactggtggtttttgaagctggtatctccaaggatggtcagacccgtgagcatgctcttcttgctttcacccttggtgtcaagcaaatgatttgctgctgtaacaagatggatgccacaacccccaagtactccaaggctaggtacgatgagatcatcaaggaggtgtcttcctacttgaagaaggttgggtacaaccctgacaaaatcccattcgtccccatctctggttttgagggtgacaacatgattgagaggtccaccaaccttgactggtacaagggaccaaccctccttgaggcacttgaccagatcaacgagccaaagaggccctccgacaagcccctccgtctcccacttcaggatgtctacaagatcggtggtattggaacggtgccagtgggtcgtgttgagactggtatgctcaagcctggtatggttgtgacctttgctccttcagggttgaccactgaggttaaatctgttgagatgcaccacgagtctcttgtggaggcacttccaggtgacaacgtgggtttcaatgtcaagaacgttgctgtcaaggatctcaagcgtgggtacgttgcgtccaactccaaggatgacccagctaagggtgctgccaacttcacttcccaggtcatcatcatgaaccacccgggtcagattggtaatggttacgcacctgttcttgactgccacacttcccacattgctgtcaagttctctgagatcctcaccaagattgacaggcgttctggtaaagagatcgagaaggagcccaagttcttgaagaatggtgacgctggtatggtgaagatgactccaaccaagcccatggttgttgagaccttctctgagtacccaccccttggacgttttgctgtgagggacatgaggcagactgttgcagtcggtgtcatcaagagcgttgacaagaaggacccaaccggagccaaggtgaccaaggctgccgtcaagaagggtgccaagtgaactatcataatcgaaactctatcatcatcaaccgcagatgaactaaagaactttgtgtgttttcttacttcagtttggtactttgttgctggtttgtgttacagtttcgtcacttctccgtcagaacgtaattctcgtaattgggttcttgatcggaggtggcagagctgcgtcgcacaaaagcatccttgtttttgcgtttcatttgttatctgaacttttagactttttggatattacgttatgatattgtgacattcctgcggatattgatttccttatttgttt

SEQ ID NO: 979 - DNA, 1647 bp, Brassica napus
ccagaaccatcctcaaacgcgagagaatcaccgtgttcacggccgcccaagccttctccaccctcctgtcacgaagcctgatgcacgccagacaatgggatacagagttgtcttcactgatcactccctcacgggtttgctgatgttgggagcatccacatgaacaaggtcttgcagctatgggtaaagagaagtttcacatcaacattgtggtcattggccatgtcgactctggaaaatcgactacaactggtcacttgatctacaagcttggtggtattgacaagcgtgtcatcgagaggttcgagaaggaggctgctgagatgaacaagaggtccttcaagtacgcatgggtgttggacaaacttaaggctgagcgtgagcgtggtatcaccattgatattgctctctggaagttcgagaccaccaagtactactgcactgtcattgatgcccctggacatcgtgatttcatcaagaacatgattactggtacctcccaggctgattgtgctgttcttatcattgactctaccactggtggttttgaagctggtatctccaaggatggtcagacccgtgagcatgctcttcttgccttcacccttggtgtcaagcaaatgatttgctgctgtaacaagatggatgccactacccccaagtactccaaggctaggtacgatgagatcatcaaggaggtgtcttcctacttgaagaaggttgggtacaaccctgacaaaatcccattcgtccccatctctggattcgagggtgacaacatgattgagaggtccaccaaccttgactggtacaagggaccaactctccttgaggctcttgaccagatcaacgagccaaagaggccttcagacaagcccctgcgtctaccacttcaggatgtctacaagatcggtggtattggaacggtgccagtgggtcgtgtggagactggtatgctcaagcccggtatggttgtgacattcgctccttcagggttgaccactgaggtcaagtccgttgagatgcaccacgagtctcttgtggaggcacttccaggtgacaacgtcggattcaatgttaagaatgttgccgtcaaggatcttaagcgtgggtatgttgcatccaactccaaggatgaccctgccaagggtgctgctaacttcacttcccaggtcatcatcatgaaccaccctggtcagatcggtaacggttacgcccctcgtgcttgattgccacacctcccacattgcagtcaagttctctgagatcctcaccaagattgacaggcgatctggtaaagagatcgagaaggagcctaagtttttgaagaatggagatgctggtatggtgaagatgactccaaccaagcccatggttgttgagactttctcagagtacccaccattgggacgttttgctgttagggacatgaggcagacggttgctgttggagttatcaagagtgttgacaagaaggacccaaccggtgctaaggtcaccaaggctgcagtcaagaagggtgccaaatgatgagccttctctatttctattacttttaaaaaaactttgatggcgtttgagccttttttttatatattttctgcgacatggtttcagttatgcagtttgtggatggttttggctaat

SEQ ID NO: 980 - DNA, 1729 bp, Cichorium intybus
cctccatctatcgagaaagcttttctgccgataattcattaagatgggtaaggaaaagattcacattagcattgtcgtcatcggacatgtcgactccggcaagtctacaaccaccggtcacttgatctacaagcttggaggtatcgacaagcgtgtgatcgaacgtttcgagaaggaagccgctgagatgaacaaacgttcattcaagtacgcatgggtgctcgacaaacttaaggccgagcgtgaacgtggtatcaccatcgatatcgctctatggaagttcgaaacaaccaagtactactgcacagtcatcgatgcccccggacatcgtgatttcatcaagaacatgattactggtacctcccaggccgattgtgccgtcctcatcatcgactccaccactggtggtttcgaagctggtatctccaaggacggtcagacccgtgagcacgctcttcttgccttcacccttggtgtgaaacaaatgatctgctgttgtaacaagatggatgccactacccccaagtactccaagtccaggtacgaggaaatcgtgaaggaagtttcatcatacttgaagaaggtcggatacaacccagacaaaatcccattcgtcccaatctccggattcgaaggtgacaacatgattgagaggtcaaccaaccttgactggtacaagggaccaactctccttgacgctcttgaccagatcaacgagcccaagagaccatcagacaagcccctccgtctcccacttcaagacgtgtacaagatcggtggtattggaactgtgccagtccggcgtgttgaaactggtgtcatcaagccaggtatgtcgtcaccttcggtccatctggttgaccacgagtcaaagtccgttgagatgcaccacgaacgttgcttgaagctcttcccggagacaatgtcggattcaatgtcaagaacgttgctgtgaaggatctcaagcgtgggtatgttgcttccaactccaaggacgaccctgctaaaggtgctgctagtttcacttcccaggtcatcatcatgaaccaccctggtcagatcggaaatggttatgctccggtgctcgattgccacacatcccacattgctgttaaattccaagagctgttgaccaagattgacagacgatctggaaaggagcttgagaaggagcctaagtttttgaagaacggagatgctggtatggttaagatgattccaaccaagcctatggtggtggagacttttgctgagtaccccccacttggaaggtttgccgtgagggacatgcgtcagacggttgctgttggtgttatcaagaatgttgacaagaaggacccgactggagctaaggtgaccaaggctgcagccaagaagggagtgaagtgaagctatgataggtgttgtgttttgattatcgagtcgttttattttctgtctgtttggattactagttctggacaaccttatattttgttgaagagttttgggatttggatctgggtgagctttcactatgtatggtgaaggtttatctgggtttttaagacttttgttgtgttttaaactttaaattcatagtgttctgtggaatgagttggttgcaaaaaactttaattctgttgccaacattttaatgattttctggatattatattttctggttcctctcaagaaaaagacaagcccggtccactttaagcctcttgtagtgcccaatactatagac

SEQ ID NO: 981 - DNA, 1404 bp, Lotus japonicus
tgatggtaaggaaaagtttcacatcacattgatagtcattggccatgtcgactctgggaagtcaacaaccactggccacttgatctacaagcttggaggaatcgacaagcgtgttattgagagatttgagaaggaagctgctgagatgacaagaggtcattcaagtatgcctgggtgcttgacaagcttaaggctgagcgtgaaagaggaatcacaattgatattgccctgtggaagtttgagaccaccaagtactactgcactgtcatcgatgctcctggacacagggattttattaagaatatgattactgggacatcccaagctgactgtgctgtgctcattattgattccactactggtggttttgaagcaggtatttccaaggatggacagactcgtgaacatgctcttctagcttttactcttggtgtgaagcagatgatctgttgctgtaacaagatggatgctactacacccaagtactcaaagtccagatttgatgaaattgtgaaagaagtctcttcctacttgaagaaggttggatacaaccctgataagattccttttgttcccatctctggttttgagggagacaacatgattgagaggtccacaaatctagattggtacaagggtcctacccttcttgaggcccttgaccagatcaatgagccaaagaggccatcagacaagcccctcaggttaccgctccaggatgtttacaagattggagcgggactgtacctgttggacgtgttgaaactggtgtcatcaaacctggaatcgtggtgacttttggaccaactggattgacaactgaagttaagtctgtggagatgcaccatgaagctctccaagaggcccttccgggtgacaatgtggggttcaatgtgaagaatgttgctgttaaggatcttaagcgtggttttgttgcctcaaactccaaggatgatcctgccaaggaggctgctaattttacctctcaggttatcatcatgaatcatcctggtcagattggaaatggctatgcccctgttctcgactgtcacacctcccacattgctgttaagtttggggaacttttgacaaagattgacagacgatctggcaaagagcttgagaaagaacccaagttcttgaagaatggtgatgctggtcttgtgaagatgattcccactaaacctatggtggtagaaactttctctgagtatcctcctcttggtcggtttgctgtgagggacatgcgtcagactgttgctgttggagtcatcaagagtgtcgagaagaaggatcctactggagccaaggtcaccaaggctgcacagaagaaggggaagtgaaccgtgctgattggttcatcaagtgaagttaattattatgactaccataaatgttgctatc

SEQ ID NO: 982 - DNA, 1717 bp, Elaeis guineensis
gatcctcttcgataaaaggcttgcggtgctccagtcgaaagccctctccgcctctcggttctcgtcgcccccgttctttcccgagagggttcgatctccccgccaccggccgagccatcatgggaaaggaaaaggtacacattaacattgtggtcattggccatgtcgattctggcaagtcaaccaccactgggcatcttatctacaagcttggtggtattgacaagcgtgtgattgagagattcgaaaaggaagcagctgaaatgaacaagaggtcattcaagtatgcttgggttcttgacaagctgaaggccgagcgagaacgtggtatcacaattgatattgctctgtggaagtttgagaccacaaagtactactgcactgtcattgatgcccctgggcatcgtgacttcatcaagaacatgatcactggcacctcccaggccgactgtgctgtccttatcatagactccacaactggtggttttgaagcaggtatctcaaaggatggacagacccgtgaacatgcattgcttgcctttactcttggtgtcaagcagatgatctgctgctgcaacaagatggatgccactactccgaagtattcaaaggctaggtatgatgaaattgtcaaggaagtttcttcctatctgaagaaggtcggttacaatcctgataagattcccttcgttcccatctctgggtttgaaggtgacaacatgattgacaggtccaccaaccttgattggtacaagggcccaaccttcttgaggctcttgacttgatacaggagcccaagaggccctcagacaagcccctccgtcttccacttcaggatgtgtacaagattggtggtatcggcactgtcccagtcggacgtgttgaaactggtatcctcaggcctggtatggtggttacctttggtcccagtggtctgacaactgaagtcaagtctgtggagatgcaccatgaggccctgcaggaggccctccctggcgataacgtgggtttcaatgttaagaatgttgctgtgaaggatctcaagcgtggttatgtggcctctaattcgaaggatgatcctgcaaaggaggccgccagcttcacttctcaggttattattatgaatcatcctggtcagattggcaacggctatgctcctgtgcttgactgtcacacctcccatattgctgttaagtttgccgagatccttactaagattgacaggcggtctggtaaggaacttgagaaggagcccaaatttttgaagaatggtgatgcaggttttgttaagatgattcccaccaagcccatggttgttgagaccttctctgagtacccacctcttggtcgatttgctgtgagggacatgcgccagacagtggcagtgggtgtcatcaagagcgtggagaagaaggatccaactggtgccaagatcaccaaggcagctgctaagaagaagtgaacaatgtcaatgtgcgcttgggtattggcgatgataatattagactgctttgatgttttgtctatgataatattagactgctttgatgtttcttttaagagtcttggtagagggggcagccttcatctcggttttctggctccattttctggacggtggtggctttgagcggtagaatgcataactggattcttgaccggaggtggtggtagcaaattgttttccttgtagttttttttttttttttgtgttgtg

SEQ ID NO: 983 - DNA, 1610 bp, Primula obconica
aacttcttttcaattgctcgtttctttggttcggctaggtcttttctctctctaattgaattacctggtaaaagttaagtatgggtaaggaaaagattcatatcagcattgtcgtcattggtcatgtcgactcgggcaagtcgaccaccactggtcaccttatctataagcttggaggtattgacaagcgtgttatcgagaggtttgagaaggaggctgctgagatgaacaagaggtcattcaagtatgcgtgggtgttggacaagctcaaggctgagcgtgaacgtggtattaccattgatattgctctgtggaagtttgagaccaccaagtattattgcactgtcatcgatgcccccggacatcgtgatttcatcaagaacatgattacgggaacttcccaggctgattgtgctgttctcattatcgattccaccactggtggttttgaggctggtatttccaaggatggtcagacccgtgagcatgctttgcttgctttcacccttggtgttaagcagatgatttgctgttgtaacaagatggatgctacacccccaagtactccaagtcaaggtatgaagagatcgtgaaggaagtctcatcctacttgaagaaggttgggtacaaccccgacaaaatcccattcgtccccatctctggattcgaaggtgacaacatgatcgaaaggtccaccaacctcgactggtacaagggcccaacccttctcgatgccctcgaccaagtctcagagcccaagaggccctcagacaagcccctccgtctcccacttcaggacgtctacaagatcggtggcatcggaacggtgcccgtcggacgtgtcgagactggtgtcatcaagcccggaatggttgtcaccttcggcccatctggtctgacaactgaggttaagtccgtcgaaatgcaccacgagtctcttctagaagcccacccaggtgacaacgttgggttcaacgttaagaatgttgctgtgaaggatctcaagcgtgggtacgttgcctctaactccaaggatgaccctgccaagggagctgctagcttcacctcgcaggtcatcatcatgaaccacccaggccagatcggtaacggatacgccccagtgctcgattgccacacctcccacattgctgtgaaattctccgagattctgaccaagatcgataggcgatctggtaaggagctcgagaaggagcccaagttcttgaagaatggagatgcgggtatggtgaagatgatcccgaccaagcctatggttgtcgagacattttccgagtacccaccgttggggcgttttgccgtgagggatatgaggcagacagttgctgttggggttatcaagagcgttgacaagaaggatccaactggtgccaaggtgaccaaagcggctgttaagaagggtgccaagtaagatggtgtggagtttagagtagaacgactgatgagtcttttgtttcgatttagtttctgcgttttgtcggacgtatgtttttatttccgtgttgagactgtgtttttgttcaagtaaggatcatctttggacaagttttaattcagacagttattcgaatttttaacttgcgatgagtttt

SEQ ID NO: 984 - DNA, 1770 bp, Scabiosa columbaria
aagccactactgcctctttcttctcctcctcattttatctctctactccgccggaattctatccctctttttcggcgaccgagagcttcgttcttctgtctttgtgatttgctgaaaactaagaatgggtaaggaaaagtttcacatcaacattgtggtcattggccatgtcgactctggaaaatcgaccactactggtcacttgatctacaagctaggtggtattgacaagcgtgtcattgaaagatttgagaaggaggctgctgagatgaacaagaggtccttcaagtatgcctgggtgcttgacaagctcaaggctgagcgtgaacgtggtattactattgatattgccttgtggaagtttgagaccaccaagtactactgcacagtcattgatgctcctggccacagagatttcattaagaacatgattactggtacttcacaggctgactgtgctgttctcattattgattccacaactggtggttttgaagctggtatctctaaggatggccagacccgtgagcacgcattgcttgctttcactcttggtgtcaagcaaatgatttgctgttgtaacaagatggatgccaccactcctaaatactcaaaggctaggtatgatgaaattgtgaaggaggtgtcttcatacttgaagaggttggatacaatcctgacaaaattgctttcgtcccaatttctgggtttgagggagacaacatgattgagaggtccacaaacctcgactggtacaagggcccaacccttcttgaggctcttgacatgatctctgagcccaagagaccatcagacaagccactcagacttccacttcaggatgtttacaagattggaggtattggaactgtgccagtgggacgtgttgagaccggtaccatcaagcctggtatggttgtcacttttggtccaactgggttgacaactgaggttaagtctgttgagatgcaccacgagtcccttctagaggctttgcctggtgacaatgttggcttcaatgtcaagaatgttgctgtcaaggatctcaagcgtggttatgttgcttccaactccaaggatgatcctgccaagggtgctgctagcttcacctcccaggtcatcatcatgaaccatcctggtcagattggtaatggttatgccccagttctcgattgtcacacatcccacattgccgtcaagtttgctgagatcctcaccaagattgacagacggtctggaaaggaaattgagaaggagcccaagttcttgaagaatggtgatgctggtatggttaagatgcttccaaccaagcccatggtggtcgagactttctcagagtaccctcctcttggtaggtttgctgtgagggacatgcgtcaaactgttgctgttggtgtcatcaaggctgttgacaagaaggatccatcaggggccaaggtgaccaaggctgctgctaagaagggtgtcaagtgaaatgtgcttttgaagagtttctctattgttgaactattttccggtttctttactatgtgttttttatctagtttttttcgattttgttctggtctttttagaagttttggttatggtattggggaatgttactcgggatacagttactctagcctcacttgtgagggttgtggaggattcaagcaacttaacattgttagttgcttgaaagctgtagttttgagggtcttctccaacccattatctttgtttttctttcttaagttccgaattgaggagtttttattaggtctgggt

SEQ ID NO: 985 - DNA, 1693 bp, Saccharum officinarum
cccgagacgccgtcgtctgctccttgctgcggttctgcgcctccacaaagctttggcctcttatctcttgcaagtttaagcttcacctccagccatgggtaaggagaatcccacatcaacattgtggttattggccacgtcgactctggtaagtcgaccactacgggccacctgatctacaagcttggaggcattgacaagcgtgtgatcgagaggttcgagaaggaggccgctgaaatgaacaagcggtccttcaagtatgcatgggtgctcgacaagctcaaggctgagcgtgagagaggtatcaccattgatatcgctctgtggaagtttgagaccaccaagtactactgcactgtcattgatgcccctggacatcgtgacttcatcaagaacatgatcaccggtacctcccaggctgactgtgccgccttatcattgactccaccactggtggttttgaggctggtatctccaaggatggccagacccgtgagcatgccctccttgctttcacccttggagtgaagcagatgatttgctgctgcaacaagatggatgcgaccactcccaagtactccaaggcccgttatgatgagattgtgaaggaagtctcatcctacctcaagaaggttggatacaaccctgacaagattttcgtcccaatctctggttttgagggtgacaacatgattgagaggtccaccaaccttgactggtacaagggcccaaccctgcttgaggctcttgaccagatcaccgagccaagaggccttcggacaagcctctgcgtctgcccctccaggatgtgtacaagattggtggtattggaactgtaccagttggtcgtgtggagactggtgtcatcaagcctggtatggttgtcaccttcggtccaactggcctgactactgaggtgaagtctgttgagatgcaccacgaggctcttcaggaggcccttcctggtgacaagttggattcaacgtgaagaacgtcgctgtgaaggatctgaagcgtgggtagtggcctccaactccaaggatgaccctgccaaggaggctgccagcttcacctcccaggtcatcatcatgaaccaccctgggcagatcggcaacggctatgctccagtgctggactgccacacctcccacatcgctgtcaagttgctgagctcattaccaagatcgacaggcggtctggcaaggagcttgagaaggagcccaagttcctgaagaacggtgatgctggtatggtgaagatgattcccaccaagccgatggtggggagacattctccgagtatcctccccttggtaggtttgctgtccgcgacatcaaacggttgctgttggagtcatcaagagtgtggagaagaaggacccgaccggcgccaaggtgaccaaggctgctgccaagaagaaatgaacctgtcgttaatcctgcatctgcttttgcaatacctagatgacttatcaccatcatataagttttgtatgtggtcggtcctgttattgtgtgaactgttaagctctgctgcggcgtggcctgtttgtgttagggtagcgtcagcgtcgggctctactgtcggtgtgccttgtgtctgtcgtctggtactatcagtatcggtaaaacttgaatggtctcagacttgtatgtcccttttgggcgccgcaaaatggaagtttcgaaggtct

SEQ ID NO: 986 - DNA, 1677 bp, Solanum lycopersicum
cagcacaaaaacagaaaaagtacgatttacgtgttataagaaaacataaataacaaagcttcttagcctgtcttggatgaacctaggcacctcaaaagataaaccaaatgactcttaactgtgtcttttgccaccgtctgtcgagcacccagttctgggaaaggatacctgacatacagggcagaaaacaagaaccaaacaacaacataaaagactgaacatgagcaggaagagtaaagtatagcaagttttcataacacactttattatagtagatactgatatctctggtaactccagagttgaactgcactattcattttttcttctgagcagccttggtgaccttggctccagatgggtccttcttgtcaacattcttgataacaccaacagcaacagtctgacgcatgtccctcacagcaaaacgtcccaatggtgggtactcggagaatgtctcaacaaccatgggcttggtgggaatcatcttaaccataccagcatcaccgttcttcaagaacttaggctccttctcgagttccttaccagaacgcctgtcaatcttagtcaagatctcagcaaacttgacagcaatatgggaggtgtgacagtccagcactggagcatatccatttccaatctgtcctggatggttcatgatgatgacctgagcggtgaagctagcagcccccttagctgggtcatccttggagttggaagcaacaaatccacgtttaagatccttaaccgcaacattcttgacgttgaacccaacattgtcaccaggaagtgcctcctgaagagcctcgtggtgcatctccacagatttaacctcagtggtcagaccagttggaccaaaagtgacaaccataccaggcttaatcacaccagtttcaacacgaccgacaggtacagttccaatacctccaatcttgtagacatcctgaagtggaagacgcaagggtttgtccgagggcctcttaggctcattaagctggtcaagagcctcaagaagggttggacccttgtaccagtccaggttagttgatctctcaatcatattatctccttcgaaaccagaaatcggcacaaatgggatcttgtcagggttgtaaccaaccttcttaaggtaagaagacacttccttcacaatttcatcatacctagccttggagtacttaggtgtgaaagagcaaaccttgttgcagcaacaaatcatttgcctaacaccaagtgtgaaagcaagcaacgcatgttcacgagtctgtccatccttagagataccagcttcaaaaccaccagtcgtggagtcgataatcaggacagcacagtcagcctgagaggtaccagtaatcatgttcttgatgaaatctctgtgtccaggagcatcaatcacagtgcagtagtactttgtggtctcaaacttccacaaggcaatatcaatggtaataccacgttcacgctcagccttaagcttgtcaagcacccatgcatacttgaatgacctcttgttcatctcagctgcttctttctcaaacctctcgatgacacgtttatcgataccacctagcttgtagatcaagtgaccagtggtagtcgatttgccagagtcaacatggccaataaccacaatgttgatgtgaaccttctctttacccatgttgatcaactagaagt

SEQ ID NO: 987 - DNA, 1599 bp, Phaseolus vulgaris
aatatctctgctacacctacactctttctctttgaggctaaccactgttcagtgcagtttctttaaccaaggttggagaagtaatgggtaaagagaaggttcacattagcatagtggtgattggccatgtggactcagggaagtcaactaccactggtcacctcatctacaagctgggaggtattgacaagcgtgtgatagagagattcgagaaggaggctgctgagatgaacaagaggtctttcaagtatgcttgggttcttgacaagctgaaggctgagcgtgaaagaggaatcaccattgacattgctctctggaagtttgagaccaccaagtactactgcacagtcattgatgcccccggacacagggatttcatcaaaaatatgatcactgggacatcccaagctgactgtgctgttcttattattgattccaccactggtggttttgaagctggtatttctaaggatggacagacccgtgaacatgctctccttgctttcactctcggtgtgaggcagatgatttgctgctgtaacaagatggatgccactacacctaactactccaaggcgagatatgatgaaattgtgaaggaagtgtcttcttacatgaagaaggttggttacaaccctgagaagatcccttttgttcccatatctggttttgagggagataacatgattgagaggtctaccaaccttgactggtacaagggtcctacccttcttgaggcgcttgatcagatcaatgagcccaagaggccatcagataagcctcttcgattaccccttcaggatgtgtacaagattggaggaattggaactgtacctgttggacgtgtggaaactggtgtcttgaaacctggaatgcttgttacttttgcaccaactggactcacaactgaagttaagtctgtggagatgcaccacgaagctctcactgaggctcttcctggtgacaatgtgggattcaacgtgaagaatgttgctgtcaaggatctgaaacgtggtttcgttgcgtcaaactccaaggacgaccctgccaaggaggctgccaacttcacgtcgcaggttatcatcatgaatcaccctggacagattggaaagggttatgcaccagttcttgattgccacacctcccacattgccgtgaagtttgccgaacttgtgaccaagattgacagacggtctggtaaagagcttgagaaggagcccaagttcctgaagaacggagatgctggttttgtgaagatgattccctctaagcccatggtggttgaaaccttctccgaatatcctccacttggtcgttttgctgttagagacatgcgtcaaactgtggctgtgggagtcatcaagagcgtggagaagaaggaccctgctggagctaaggtcaccaaggctgcacagaagaagggcaagtgaatcgtgcaggatggtctattaagaaatccctattacatgactatgatgaatgttgtcttgtttgcagtagtactttttttcatgttcttgtttatcagtttatgtctcagtgtcaggtttttttgttatataaataaagtttgttttatattatattataataaaataa

SEQ ID NO: 988 - DNA, 1825 bp, Mimulus guttatus
cccacagaatcctcgttacagaacctcactttgctcttcgcttctctggattgcttctgcggctagggttttcagcgaaggctatttctctctctagcagctctctgattttaagttaagcatccattatgggtaaagaaaagtttcacatcaacattgtcgtcattggacatgtcgactccgggaaatcgaccaccaccggtcacttgatctacaagctaggtggtattgacaagcgtgtgatcgagaggttcgagaaggaggctgctgagatgaacaagaggtccttcaagtacgcatgggttttggacaagcttaaggccgagcgtgagcgtggtatcaccattgatattgccttgtggaagtttgagaccaccaaatactactgcaccgtcatcgatgccccgggacatcgtgatttcatcaagaacatgattactggtacctcacaggctgattgtgctgtccttatcattgactccaccactggtggtttcgaagctggtatttccaaggatggacagacccgtgagcatgctcttcttgctttcactcttggtgtcaagcagatgatctgttgttgtaacaagatggatgccaccacacctaagtactccaagggtaggtacgaggaaattgttaaggaggtgtcttcatacctaaagaaggttggatacaacccagacaaaatcccattcgttcccatctctggtttcgagggagacaacatgattgagaggtcgaccaaccttgactggtacaagggcccaacccttcttgaggctcttgacctgatctccgagccaaagaggccctcagacaagccactccgtctcccacttcaggatgtctacaagattggtggtattggaacggtgcctgtcggtcgtgtggagaccggtctgatcaagcctggtatgctcgtcactttcggaccaactggtttgaccactgaggttaagtcagttgagatgcaccacgagtccatgcccgaggctcttccaggagacaatgttgggttcaatgtcaagaatgttgcagtcaaggatttgaagcgtggttttgttgcctcgaactcaaaggatgaccctgctaaggaagctgctaacttcacttcccaggtcatcatcatgaaccaccctggtcagatcggaaacggttatgcaccagtgctcgactgtcacacatcccacattgctgtcaagtttagggaaatcttgaccaagattgacaggcgatcgggtaaggagattgagaaggaacccaagttcctcaagaatggagatgctggtatggttaatatgattccgaccaagcctatggttgttgaaactttctcagagtaccctcctttgggtcgtttcgctgttcgtgacatgcgtcagacagttgctgttggtgttattaagagtgttgagaagaaggacccatcaggagccaaggtcaccaaggctgctgccaagaagggtgccaagtgaactttgccggttttcggttcagctggagaatattatttgcataatttatgtcttaaatacttttttctgatttacaatgctttatttggatttttatattgcttgttgtgttgtatttttctgccttgtatgtttggtatccattcccagaattgggtactagacaggcggtggcggatttacagcatttgaattccgtatgcagtactctggtttacagacatactttcatctttatttatggtttgatttttaatattgcttcgtaaaatttctcttgcttaattcgtgtttatgttacatgatttttcttcagagatgatttctttaatatatattttccatat

SEQ ID NO: 989 - DNA, 1981 bp, Mimulus guttatus
ctctccgaatttcactgctgctgctaagggccgttttgtaggcaaagcgactcgttctctttctctctctaacatctgcctacaagtttgtagccattcgctatgggtaaagaaaagtttcacatcaacattgtcgtcattggacatgtcgactccgggaaatcgaccactactggtcacttgatctacaagctaggtggtattgacaagcgtgtgatcgagaggttcgagaaggaggctgctgagatgaacaagaggtccttcaagtacgcatgggttttggacaagcttaaggccgagcgtgagcgtggtatcaccattgatattgccctgtggaagtttgagaccaccaaatactactgcacagtcatcgatgcccccggacatcgtgatttcatcaagaacatgattactggaacctcccaggctgactgtgctgtcctcatcattgactccaccactggtggtttcgaagccggtatttcgaaggatggacagactcgtgagcatgctcttcttgctttcactcttggagtcaagcagatgatctgttgttgtaacaagatggatgccaccacacccaagtactccaagggcaggtacgaggaaattgtcaaggaggtgtcttcatacctgaagaaggtcggatacaaccccgacaaaatcccattcgttcccatctctggtttcgagggagacaacatgattgagaggtcgaccaaccttgactggtacaagggcccaacccttctcgaggctcttgacttgatctctgagccaaagaggccctcagacaagccactccgtctcccacttcaggatgtctacaagattggtggtattggaacggtgcccgtcggtcgtgtggagactggtttgatcaagcctggtatgctcgtcactttcggaccaactggtctgaccactgaggttaagtccgttgagatgcaccacgagtctatgcccgaggctctccccggagacaatgttgggttcaacgtcaagaacgttgcagtcaaggatctcaagcgtgggtttgttgcatccaactcgaaggacgaccctgctaaggaagctgccaacttcacatcccaggtcatcatcatgaaccaccctggacagattggaaacggttatgcaccagtgctggactgtcacacatcccacattgctgtcaagtttagggaaatcttgaccaagatcgacaggcgatcgggtaaggagattgagaaggagcccaagttcctcaagaatggtgatgccggtatggttaatatgattccgaccaagcctatggtggtggagaccttctcagagtaccctcctttgggtcgttttgctgttcgtgacatgcgtcagacagttgctgtcggtgtcatcaagagtgtggagaagaaggatccatcaggagccaaggtcaccaaggctgctgccaagaagggtgccaagtgaatggtgcaggttcttgaatcgaattttcgttcgagtgaattttatctttttaataaactttgtcatgaaaactccatttttagttttgtcgttttgttttgtcggctgtggttttgcttttgcctttcactcccttgtcttttgggttgtcaatcccagaattgggtgttggacaggcggtggcgggatctacagcatcgagtcagtattgttcgattttagtaatgttttattctgttgtgtgttttgaggtgctccggttttttactgggtggctcgagaattttgtgttgtttccttgcaagtgattagaattgaactatttgaccttagcttttaaatttaatgctttgttacttatgctgtttttccctttttctctattactacttggccacatattctcttcaaatttattcataattagggtgtattgattttcagaatcaatagtgtaatgttttatctcgtaattttaatcctaaaccagaaatacatatacagataattgtgttatgagattcgcaaa

SEQ ID NO: 990 - DNA, 1916 bp, Mimulus guttatus
ttgctcttcgcttctctgaattgcttctgcggctagggttttctgcgaaggctcctttctctctctgtgttcgtagcctttcaccatgggtaaagaaaagtttcacatcaacattgtcgtcattggacatgtcgactccgggaaatcgaccaccactggtcacttgatctacaagctaggaggtattgacaagcgtgtgatcgagaggttcgagaaggaggctgctgagatgaacaagaggtccttcaagtacgcatgggttttggacaagcttaaggccgagcgtgagcgtggtatcaccattgatattgccttgtggaagtttgagaccacgaagtactactgcacagtcatcgatgcccccggacatcgtgatttcatcaagaacatgattactggaacctcccaggctgattgtgctgtccttatcatcgactccaccactggtggtttcgaagctggtatctccaaggatggacagacccgtgagcatgctcttcttgctttcactcttggtgtcaagcagatgatctgttgttgtaacaagatggatgccaccactcctaagtactccaagggtaggtatgaggaaattgtcaaggaggtgtcttcgtacctcaagaaggttggatacaaccccgacaaaatcccattcgttcccatctctggttttgagggtgacaacatgattgagaggtcaaccaaccttgactggtacaagggcccaacccttctcgaggctcttgacttaatctctgagccaaagaggccctcagacaagccactccgtctcccacttcaggatgtctacaagattggtggtattggaacggtgcccgtcggtcgtgttgagactggtttgatcaagccgggtatgctcgtcacttttggacctactggtttgaccactgaggttaagtctgttgagatgcaccacgagtctatgcctgaggctctcccaggagacaatgttgggttcaacgtcaagaacgttgcagtcaaggatctcaagcgtgggtttgttgcatccaactcgaaggacgaccctgctaaggaagctgctaacttcacttcccaggtcatcatcatgaaccaccccggacagattggaaacggttatgcaccagtcctcgattgtcacacatcccacattgctgtcaagtttagggaaatcttgaccaagatcgacaggcgatcgggcaaggagattgagaaggagcccaagttcctcaagaatggtgatgccggtatggttaatatgattccgaccaagcctatggtggtggagaccttctcagagtaccctcctttgggtcgttttgctgttcgtgacatgcgtcagacagttgctgttggtgtcatcaagagtgttgagaagaaggacccatcaggagccaaggttaccaaggctgctgccaagaagggtgccaagtgaactgtgctggttttcggttatccttattctgcccatgacttttgtttgcgtcttaaaaactctatttgtatttttaatgctttagtaggtcctttatattgcttgttgtgttgtattttcttgccctgtatgtttggtagccattcgcagaattgggtactcgacaggcggtggcaggatttacagcattgaaactttgtttcagttttggtggtttgtttttcgttgtggtactgaattatttaatgggctttaatatttaattttgatttgcttttatatttggtctatgtttgattttcatacagtttgctgtatcttgctgattgctagtaggttatataattccggttttcgatttcttgaaagtatttgatatagagcttgctcaaatcatttgtaatccttccatttagatccaaatacctttattttttttcttgttcaatgccttattcttgtatctagctaaattggaata

SEQ ID NO: 991 - DNA, 1812 bp, Abies balsamea
tctctgctccagacgccgctgcgaagctgttcttgggttttctgattctctagattcagccaggcgcttttcttagaggctttagttcatcatgggaaaggaaaagacccatatcaacattgtggttattggccatgtcgactctggcaagtcaaccaccactggtcatttgatctacaagcttggaggaattgacaagcgtgtgattgaacgttttgagaaagaagctgctgagatgaacaagaggtcattcaagtatgcttgggtgcttgacaaactcaaggctgaacgtgaacgtggtatcacaatagatattgctttgtggaagttcgagacaacaaaatactactgtactgtgattgatgcccctggccatcgtgatttcatcaagaacatgattactgggacctctcaggctgattgtgcagttttgatcattgattctacgactggaggtttcgaggctggtatctccaaggacggtcagactagagagcatgctctattggccttcaccttgggagtgaagcaaatgatttgctgttgtaacaagatggatgccaccactcccaagtactcaaaggctcgttatgaggaaattgtcaaagaagtctcttcttatttgaaaagagttggatacaatcctgataagattccttttgtgcctatctctggttttgagggtgacaacatgattgagcgctcaaacaaccttgattggtacaagggcccaacactcttggaagcccttgaccaggtctcagagcctaagcgtccctcagacaaacctctgaggttgccacttcaggatgtttacaagattggtggtattggcactgtgcctgttggtcgtgtggaaactggagtaataaagccaggtacgattgttacctttgctcctactgggctgaccactgaagtcaagtctgttgagatgcaccatgaagctctgctggaggcactgcctggtgacaatgtgggattcaacgttaagaatgttgctgttaaggatcttaagcgtggttatgtggcatctgattccaagaatgatccagccaaggaagctgccaactttacagctcaggttattataatgaatcatccaggacagattggaaatggttatgcccccgtgttggattgccacacttgccacattgctgttaagtttgctgagatcatgaccaaggttgacaggcgttctggcaaggaactggagaaggaacccaagtttcttaagaacggagatgctgggtttgtcaagatgataccaaccaaacctatggttgttgagacatttgctgagtatcccccattgggtcgatttgctgtgagggacatgcgtcagacggttgctgtaggagtcattaaagctgtggaaaagaaggaaccatctggtgctaaggtcaccaaggcagctgccaagaagaagtgactgttcaagcaaagtgatcgtgattggagaaatgcgtgctgcattttgcgagcttgcatttttccctattttcctggtggtatgttagtagatttagtttgtcacatgcagaattgggtgcttgatcgccggtggcagagtttacattattttgcagtaaatactttatagtggtttaggaagtttgggatttcgtagttgcggggaaatcatctgtttgtctgcactgctaggaaatctatgcagttggagttgtgacggaggagagatattaataatttctactatatttatttttaaagcttgtattgccgtacatacttggcattttttcgagattgagatgatttgaaattatattaaagcgcacttttgat

SEQ ID NO: 992 - DNA, 1989 bp, Amborella trichopoda
ttgagctcatagatgttctataatctgtaggctttagttgaaaactgaaagatgggtaaggagaaggttcacatcaacattgtggttattggtcatgtggactctggcaaatcaacaaccactggtcacctcatctacaaacttggaggtattgacaagcgtgtgattgagaggtttgagaaagaagcagctgagatgaacaagaggtcatttaagtatgcttgggtgcttgacaagctcaaggctgagcgtgagcgtggtatcacaattgacattgctctgtggaaatttgagacgactaagtattactgcactgtcattgatgccccgggtcatcgtgactttatcaagaacatgattactggtacctctcaggctgattgtgctgtcctcattattgactccacaactggtggttttgaggctggtatttctaaggatgggcaaacccgtgagcatgctttgctggccttcacccttggtgtcagacaaatgatttgctgctgcaacaagatggatgccaccaccccgaagtactccaaggccagatatgaagaaattacgaaggaagtgtcctcttacatcaagaaggttggatacaaccctgataagatcccctttgtacccatctctgggtttgagggtgacaacatgatcgagaggtccaccaaccttgattggtacaagggtcccaccttgctcgaagctcttgacatgatctcggagcccaagaggccatctgacaagcccctacgtctcccacttcaggatgtctacaagattggaggtattgggactgtccctgtgggccgagtggagactggtgtccttaagcctggtatggttgtcacatttgccccttctgggctcaccactgaagttaagtctgttgagatgcaccatgaggctcttcaagaggctctccctggtgacaatgtggggttcaatgtgaagaatgttgctgtcaaggatctcaagcgtggttttgtcgcctccaactccaaggatgaccctgccaaggaggctgctaacttcacagcccaggttatcatcatgaaccaccctggccagattggcaatggctacgcacctgtgcttgactgtcacacctgccacattgccgtcaagtttgctgagatcctcacaaagattgataggcggtcaggaaaagagcttgagaaggagcccaaattcttgaagaatggtgatgctggattcgttaagatgatccccacgaagcccatggttgttgagaccttctctgagtacccacctcttggtaggtttgctgtcagggacatgaggcaaaccgtggctgttggtgtgatcaaggctgttgagaagaaggacccaagtggtgccaaggtgaccaagtcagctgctaagaagaagtgaaccgaggtcttgggtccttttgtcggtgatactgttttctgcttctggactctatcgtgtgtttcttcttttgcatttcctttatgttttcgttattttgttctgtgttttggtttgttgctgttatttggcgggcggacaatgcagaactgggtgctagacaggcggtggcgtgctgattagggaggttttcttcttcccccttctttttcgctatagtaaaaacaaaaagaagacattttgcactctatttatctttttgtccgggacatggaatatgtacgagtctattttgttagttgtttatttgaagaatagattgtgatggtgatttgaagtgatgagttaagtttgacttgggtccagaatttccacctgttgcctacgcatctcttgtgatttttggctaaatttaaagttttttggtggtttgtcggtcatttgattgccccaaaagattgattaggtgatgaaatcaatttatttcaatgaaagtcgatagatatatgtgtgcctttatgactctctggtatgagttctgttagatgatgtttctttggttttctttattggtataattttaaaatcgcatta

SEQ ID NO: 993 - DNA, 1890 bp, Theobroma cacao
gagaaaatatcggagaagctttaaacggttgatgtgagatctctcacgtgagccttttaatccaacgactgagagagaaaccctagttaaaccaaagctgagagagtagctacttaagctaaagcagacagctgatttcttcctctttcgcttgctctctacgctctcttccgctgcgacgaggagagcttctgatcaagcgaatctccaagagtcctatttttagcttacagcttctctcccgagttttataatgggtaaggagaaggttcacatcaacattgtggtcatcggccatgtcgactctgggaagtcgaccaccactggtcatttgatctacaagcttggtggtattgacaagcgtgtgattgagaggttcgagaaggaggctgctgagatgaacaaaaggtcattcaagtatgcctgggtgcttgacaagcttaaggctgagcgcgaacgtggtattaccattgatattgcactgtggaagtttgagaccacaaaatactactgcactgtcatcgatgcccctggacatcgtgactttatcaagaacatgattactggtacctcacaggcagactgtgctgttctcattattgactcaaccactggtggttttgaagctggtatctctaaggatggtcagacccgtgagcatgctttgcttgcctttacccttggtgtcaagcagatgatttgctgctgcaacaagatggatgccacaaccccaaagtactccaaggcgaggtatgatgaaattgttaaggaagtctcttcttatcttaagaaagttggttacaaccctgagaagatcccatttgtcccaatctctggttttgagggtgataacatgattgagaggtctacaaaccttgactggtacaagggtcccactcttctcgatgctcttgaccagatcaatgagcccaagaggccctcagacaagccacttcgtctcccacttcaggatgtctacaagattggtggtattggaactgtccctgttggtcgtgttgagactggtacccttaagcctggtatggtcgtgacctttggccccactggtctgaccactgaagtaaagtctgttgagatgcaccatgaagccctccaggaggctctccctggtgataatgttgggttcaatgttaagaatgttgctgttaaggatctcaagcgtggttttgttgcatctaactctaaggatgatcctgccaaggaagctgccagcttcacctctcaggtcatcatcatgaaccaccctggccagattggaaatggatatgccccggtccttgattgccacacctctcacattgctgtcaaatttgctgaactgctgaccaagattgacagacgatcaggcaaggagcttgagaaggagcctaagtttttgaagaatggtgatgcagggtttgtgaagatgattcccaccaagccaatggttgtggagactttctctggatatcctcctcttggacgttttgctgtcagggacatgcgccagactgtggccgttggtgtcatcaagagtgttgataagaaggatgcatccggtgccaaggtcaccaagtctgctgctaagaagagtggaaagtgagattgcttttgtgagataattatcacagctaggataattgtcttaattttggtcatactttttatttaccggtaatttatatgtcagttttgtggaccaatttttatatgctgtcgtctgtgtctggtttgggttgagacttgcaaagttgtctgaggtttgcttttattatttgtcttatttacattttcttttgtcaagtgtagttaaatgcttttaaaacaattctcgtttgatattatgattttctgctgcgagtattcgagtaaaatcttaatgtcactatg

SEQ ID NO: 994 - DNA, 2287 bp, Cannabis sativa
aaaataaagaaaaatgttggtagtatgtattagttaagctcaattataaaacgaagtcacatttgttagggtttcatctaaagtcattgcatagcttctttgctttcttcggttctgtcactgactgatcggatattggagatcggagaggaggaattttgtttcacagatagacgattaaatacagataaaattacatcatggggaaggagaagctccatattaacattgtcgtcattggtcatgtcgattctgggaaatcaaccacaactggtcatttgatctacaagcttggaggaattgataagcgtgtgattgaaaggtttgagaaggaggctgctgagatgaacaagagatcattcaagtatgcctgggtgcttgacaaacttaaggcggagcgagagcgtggtattaccattgacattgctctctggaagtttgagaccaccaagtactactgtactgtgattgatgctcctggacatcgtgatttcatcaagaacatgattacaggaacttcacaggctgattgtgctgtgctcattattgactccacaactggtggttttgaggctggtatttccaaggatgggcagactcgtgagcatgctcttctcgccttcactcttggtgttaagcaaatgatttgttgctgcaacaagatggatgccaccaccccgaagtactcaaaggcaaggtatgatgaaatcgtgaaggaagtttcttcctacctgaagaaggttggttacaacccagataaaattgcatttattcccatctctgggtttgagggtgataacatgattgagagatccaccaaccttgactggtacaagggcccgactcttcttgaagctcttgaccagatcctagagcctaagagacccacagacaaacctcttcgtctccctcttcaggatgtttacaagattggaggcattggaactgtgcccgttggacgtgtggagactggtgtcatcaagcctggaatggttgtaacttttggtcccactggactgaccactgaagtcaagtctgttgaaatgcaccatgaggcacttcaggaggctggtcctggtgacaatgtcggatttaacgtgaagaatgttgctgtcaaggatctcaagagaggttttgtcgcctcaaactctaaggatgatcctgcgagggaggcagctaacttcacctctcaagttatcatcatgaaccatcctggccaaattggcaatggttacgcccctgttcttgattgtcataccagtcacattgccgttaagttttctgagatcctaaccaagattgacagacggtctggtaaggagattgagaaggagcccaagtttttgaagaatggtgatgctgggtttgttaaaatgcttcctactaagcctatggtggtagaaactttctcagagtaccccccacttggccgtttcgctgtcagggacatgcgacaaactgtggccgttggagtcataaagagtgtggagaagaaggatccttcaggggccaaggttaccaaatccgctgccaagaagaagtgaatcgtgcagttcaacattactgaaatcaaaggcagtatttgccgatgggttctttttacttgtttttccaatggagtcttagatgtctgtttcgcttcatataaaaagtttctaccatcgtcgtcatgcagccgttctcagaactgggtgctcgatagacggtggcacggtttttctgtcttttcagctattgtcattttttcctttcaaatcttgtcaattggttgaattttgtttagcagcaacggtgttagtctttgtcctatgctgccggatgatcataattgatgcatgttttaagtttttcaactatttttctttatatactgtatttataaattaaagttgcaaatttgaaaatgtcgtgcagccgttctcagaactgggtgctcgatagacggtggcacggtttttctgtcttttcagctattgtcattttttcctttcaaatcttgtcaattggttgaattttgtttagcagccgtcatgcagccgttctcagaactgggtgctcgatagacggtggcacggtttttctgtcttttcagctattgtcatttttttctttcaaatcttgtcaattggttgaattttgtttagcagcaacggtgttagtctttgtcctatgctgccggatgatcataattgatgcatgttttaagtttttcaactatttttctttatatactgtatttataaattaaagttgccaatttgaaaaagaacttgaaaaatgagatata

SEQ ID NO: 995 - DNA, 1870 bp, Catharanthus roseus
tctctctcgctcttttatttctcactcgcaaaatcctctgctcggaacgactgtgagcgggagagctccccagccttcggattcattttcgcgagtatgggtaaggaaaaggttcacatcaacattgtggtcattggccacgtcgactctggcaagtcgaccactactggtcacttgatctacaagcttggtggtattgacaagcgtgtgatcgaaaggtttgagaaggaggcggctgaaatgaacaagaggtcattcaagtacgcctgggtgttggacaagctcaaggctgagcgtgagcgtggtattacaattgatattgccttgtggaagtttgagaccaccaagtactactgcaccgttattgatgcccctggacatcgtgactttatcaagaacatgattactggtacctcacaggctgactgtgctgtcctcatcattgactccacaactggtggttttgaggctggtatctccaaggatggccagacccgtgagcatgctttgcttgctttcactcttggtgtgaaacaaatgatctgctgctgcaacaagatggatgccaccacacccaagtactccaaggctaggtatgatgaaatcgttaaggaagtatcatcatacctcaagaaggtcggatacaaccctgacaaaattgccttcgtccctatttctgggtttgagggagacaacatgattgaaaggtctaccaacctcgactggtacaagggcccaaccctcctcgaggctcttgacatgatccaggaacccaagaggccctcagacaagccactcaggctcccacttcaggatgtctacaagattggtggtattggtactgtccctgttggtcgtgttgaaactggtgtcctcaagcccggtatggttgtcacctttggcccaactggtctgactactgaagttaagtcagttgagatgcaccacgaagctcttcaggaggctcttcctggtgacaacgttgggtttaacgttaagaatgttgctgttaaggatctcaagcgtggttttgttgcatccaactccaaggatgaccctgccaagggagctgccagcttcacctcacaggtcatcatcatgaaccatcctggacagattggtaatggatatgccccagtgcttgattgtcacacctctcacattgctgtcaagtttgctgagatcttgaccaagattgacagacgatctggtaaggagctcgagaaggagcccaaattcttgaagaatggtgatgccggtatggttaagatgattcccaccaagcccatggttgtggagacattttctgagtacccaccacttggtcgttttgctgtgagagacatgcgtcaaactgttgctgttggtgtgatcaagagtgttgataagaaggacccatctggtgccaaggtcaccaaggcagcagccaagaagggagccaagtgaaatgtcttcatgaggagcctttatgttgttgaactattttctgttatttgctttagttttgaacgattttgttttggatatttagaagttttgaatatgtctctggttgacctgttcacagttctctagcctcaactttgaggatagtggagaaattgagcaagctttttgcgcttgttcgatggcagtgatacagggcaactaggggaattttaattgctctgaattttatagaatgagtttagtttttggtcggtaaacaattatcttttccttcattctgaggatatttttatcgatggtttacacccccatatgttttcttctgttgttttaattgtatgtttttttccatcattcttgcttaggttttctatattctcacttggtgtgtaggttgctaattttttggtattatagaaca

SEQ ID NO: 996 - DNA, 1736 bp, Catharanthus roseus
atttttccttctcttctctttcgatcgagcagcgcagcctacctcgttctctacagcagaagctttctataccttcatcatgggtaaggaaaaggttcacatcaacattgtggtcattggccacgtcgattcgggcaagtccaccaccaccggtcacttgatctacaagcttggtggtattgacaagcgtgtgattgaaaggtttgaaaaggaagctgctgaaatgaacaaaaggtcattcaagtatgcctgggtccttgacaagctcaaggctgagcgtgagcgtggtattaccattgatatagccttgtggaagtttgagaccacaaagtactactgcaccgtcattgatgcccctggacatcgtgactttatcaagaacatgattactggtacctcacaggctgactgtgctgtcctcatcattgactccaccactggtggttttgaagctggtatctccaaggatggtcagacccgtgagcacgcattgcttgctttcactctaggtgttaagcagatgatctgctgctgcaacaagatggatgccaccacccccaagtactccaaggctagatatgatgaaatcgtcaaggaagtgtcatcatacctcaagaaggtcggatacaaccctgataaaattgccttcgtccctatttctggttttgagggagacaacatgattgaaaggtctaccaaccttgactggtacaagggcccaaccctgcttgaggctctggacatgatccaggagcccaagaggccctcagacaagccacttcgtctcccacttcaggacgtctacaagattggtggtattggtacagtccctgtgggtcgtgttgaaactggtgtccttaagcctggtatggttgtgaccttcggcccaactggtctgaccactgaagttaagtcagtagagatgcaccacgaagcccttcaggaggctcttcctggtgacaatgttgggtttaatgttaagaatgttgctgttaaggatctgaagcgtggttttgttgcatccaactccaaggatgaccctgccaagggagctgccagcttcacctcacaggtcattatcatgaaccatcctggacagattggtaatggatatgccccagtgctggattgccacacctctcacatcgctgtcaagtttgctgagatcttgaccaagattgacagacgatctggtaaggagctggagaaggagcccaaattcttgaagaacggtgatgctggtatggttaagatgattcccaccaagcccatggttgtggagactttctctgagtatccacccctaggtcgttttgctgtgagagacatgcgtcaaacagttgctgtgggtgtcatcaagagtgttgacaagaaggatccatctggtgccaaggtcaccaaggctgctgctaagaagggtgccaaatgaaccgtgctggttccttctggtattgcttctgaagaagtttatcattacaataaagcttgtcgtggaaacttagtccttttcagaactgctattgtagtttggtcttttttcagtctgttgtgtcgtaggtttctgcctttcaaattcagtatcctttctcagaattgggtacttgataggcggtggcagatcctacaatgttagtttttattatgttttcgttttggagtcgttgtgcattgaggtgctttggtttttcctggcggctcaagagttttgtggtttaatatttacgcggattttatta

SEQ ID NO: 997 - DNA, 1765 bp, Catharanthus roseus
aaaatcctctgctcggaacgactgtgagcgggagagctccccagccttcggattcattttcgcgagttcagtatgggtaaggaaaaggttcacatcaacattgtggtcattggccacgtcgactctggcaagtcgaccactactggtcacttgatctacaagcttggtggtattgacaagcgtgtgatcgaaaggtttgagaaggaggcggctgaaatgaacaagaggtcattcaagtacgcctgggtgttggacaagctcaaggctgagcgtgagcgtggtattacaattgatattgccttgtggaagtttgagaccaccaagtactactgcaccgttattgatgcccctggacatcgtgactttatcaagaacatgattactggtacctcacaggctgactgtgctgtcctcatcattgactccacaactggtggttttgaggctggtatctccaaggatggccagacccgtgagcatgctttgcttgctttcactcttggtgtgaaacaaatgatctgctgctgcaacaagatggatgccaccacacccaagtactccaaggctaggtatgatgaaatcgttaaggaagtatcatcatacctcaagaaggtcggatacaaccctgacaaaattgccttcgtccctatttctgggtttgagggagacaacatgattgaaaggtctaccaacctcgactggtacaagggcccaaccctccttgaggctcttgacatgatccaggagcccaagaggccctcagacaagccactccgtctcccacttcaggatgtctacaagattggtggtattggtactgtccctgttggtcgtgttgaaactggtgtcctcaagcctggtatggttgtcacctttggcccaactggtctgacaactgaagttaagtcagttgagatgcaccacgaagctcttcaggaggctcttcctggtgacaatgttgggtttaatgttaagaatgttgctgttaaggatctgaagcgtggttttgttgcatccaactccaaggatgaccctgccaagggagctgccagcttcacctcacaggtcattatcatgaaccatcctggacagattggtaatggatatgccccagtgctggattgccacacctctcacatcgctgtcaagtttgctgagatcttgaccaagattgacagacgatctggtaaggagctggagaaggagcccaaattcttgaagaacggtgatgctggtatggttaagatgattcccaccaagcccatggttgtggagactttctctgagtatccacccctaggtcgttttgctgtgagagacatgcgtcaaacagttgctgtgggtgtcatcaagagtgttgacaagaaggatccatctggtgccaaggtcaccaaggctgctgctaagaagggtgccaaatgaaccgtgctggttccttctggtattgcttctgaagaagtttatcattacaataaagcttgtcgtggaaacttagtccttttcagaactgctattgtagtttggtcttttttcagtctgttgtgtcgtaggtttctgcctttcaaattcagtatcctttctcagaattgggtacttgataggcggtggcagatcctacaatgttagtttttattatgttttcgttttggagtcgttgtgcattgaggtgctttggtttttcctggcggctcaagagttttgtggtttaatatttacgcggattttattatagttattgaactcatttgcgagaattcttctttga

SEQ ID NO: 998 - DNA, 1772 bp, Cedrus atlantica
ttctctgattctccaggctcaggcaggcgctttggttagaggctttaattcatcatgggaaaggagaaaacccatattaatattgtggtcattggccatgtcgactctgggaagtcaacaaccactgggcatttgatctacaagcttggaggaattgacaagcgtgtgattgaacgttttgagaaagaagctgctgagatgaacaagaggtcattcaagtatgcttgggtgcttgacaagcttaaggctgaacgtgaacgtggtattacaattgatattgcattgtggaagtttgagacaactaaatactactgtactgtgattgatgctcctggccatcgtgatttcatcaagaacatgattactggaacatctcaggctgattgtgcagttttgatcattgattccacaactggaggttttgaggctggtatctccaaggatggtcagactagagagcatgccctgttggcgttcaccttgggagtgaagcaaatgatttgctgctgtaacaagatggatgccaccactcccaagtactcaaaggctcgttatgatgaaattgttaaggaagtatcttcttatttgaagagggttggatacaaccctgacaagattccttttgtgcctatctctggttttgagggtgacaacatgatcgagcgctcatctaaccttgactggtacaagggcccaactctcttggaagcccttgaccaggtctcagagcctaagcgtccttcagacaaacctctgaggttgccacttcaggacgtttacaagattggtggtattggtactgtgcctgttggtcgtgtggaaactggggttttaaagccaggtacagttgttacctttgctcctactgggctgaccactgaagttaagtctgttgagatgcatcatgaagctctgactgaggcgctccctggtgacaatgtgggattcaatgttaagaatgttgctgttaaggatctcaagcgtggctatgtggcatctgattctaagaatgatccagcgaaggaagctgcaaactttactgctcaagttattattatgaatcatcctggacagattggaaatggttatgctccggtgttggattgccacacttgccacattgctgtcaagtttgctgagatcatgaccaaggttgacaggcgttctggcaaggaactggagaaggaacccaagttccttaagaatggagatgctgggtttgtcaagatgattccaaccaaacccatggttgtggagacctttgctgagtatcctccactgggtcgttttgcagtgagggacatgcgtcagacggttgctgtaggagtcatcaaagctgttgaaaagaaggaacctaccggtgcaaaggtaaccaaggcagctatcaagaagaagtgaacgttgaagcaaactgttcaggaatggagaaatgcgtgttgcattttgtctgcttgcatttttttctattctcctgatggtatcttagtagaattagcttgtcaaatgcagaattgggtgcttgatcggcggtggcacagtttacattattttctagtaaatactctgtagtggtttagggcaagttgtttgagatttcgtagttgcggggaaatcaacagattgtctgcactgctaggaaatctatgcagttggagtgtgagggaggaagggtattaataatttcgaatactctgtttatttttaaagcttgtattgccgtacatgcatggcatttttccatattgagaagacttgaaattatattaaagcgc

SEQ ID NO: 999 - DNA, 1825 bp, Cedrus atlantica
tgcgagtctttctgctccttacgccgctgcgaagctgttcttgggttctctgattctccaggctcaggcaggcgctttggttagaggctttaattcatcatgggaaaggagaaaacccatattaatattgtggtcattggccatgtcgactctgggaagtcaacaaccactgggcatttgatctacaagcttggaggaattgacaagcgtgtgattgaacgttttgagaaagaagctgctgagatgaacaagaggtcattcaagtatgcttgggtgcttgacaagcttaaggctgaacgtgaacgtggtattacaattgatattgcattgtggaagtttgagacaactaaatactactgtactgtgattgatgctcctggccatcgtgatttcatcaagaacatgattactggaacatctcaggctgattgtgcagttttgatcattgattccacaactggaggttttgaggctggtatctccaaggatggtcagactagagagcatgccctgttggcgttcaccttgggagtgaagcaaatgatttgctgctgtaacaagatggatgccaccactcccaagtactcaaaggctcgttatgatgaaattgttaaggaagtatcttcttatttgaagagggttggatacaaccctgacaagattccttttgtgcctatctctggttttgagggtgacaacatgatcgagcgctcatctaaccttgactggtacaagggcccaactctcttggaagcccttgaccaggtctcagagcctaagcgtccttcagacaaacctctgaggttgccacttcaggacgtttacaagattggtggcattggtactgtgcctgttggtcgtgtggaaactggggttttaaagccaggtacagttgttacctttgctcctactgggctgaccactgaagttaagtctgttgagatgcatcatgaagctctgactgaggcgctccctggtgacaatgtgggattcaatgttaagaatgttgctgttaaggatctcaagcgtggctatgtggcatctgattctaagaatgatccagcgaaggaagctgcaaactttactgctcaagttattattatgaatcatcctggacagattggaaatggttatgctccggtgttggattgccacacttgccacattgctgtcaagtttgctgagatcatgaccaaggttgacaggcgttctggcaaggaactggagaaggaacccaagttccttaagaatggagatgctgggtttgtcaagatgattccaaccaaacccatggttgtggagacctttgctgagtatcctccactgggtcgttttgcagtgagggacatgcgtcagacggttgctgtaggagtcatcaaagctgttgaaaagaaggaacctaccggtgcaaaggtaaccaaggcagctatcaagaagaagtgaacgttgaagcaaactggtcaggaatggagaaatgcgtgttgcattttgtctgcttgcatttttttctattctcctgatggtatcttagtagaattagcttgtcaaatgcagaattgggtgcttgatcggcggtggcacagtttacattattttctagtaaatactctgtagtggtttagggcaagttgtttgagatttcgtagttgcggggaaatcaacagattgtctgcactgctaggaaatctatgcagttggagtgtgagggaggaagggtattaataatttcgaatactctgtttatttttaaagcttgtattgccgtacatgcatggcattttttccatattgagaagacttgaaattatattaaagcgcagttttg

SEQ ID NO: 1000 - DNA, 1609 bp, Gossypium hirsutum
caaatttaagttttttctgctaaaaagttgctatgggtaaggagaaggttcacatcaacattgttgtcattggccatgtcgactctgggaagtcaaccacaacgggtcacttgatctacaagcttggaggtattgacaagcgtgtgattgagaggttcgagaaggaagctgctgagatgaacaaaaggtcattcaagtatgcctgggtgcttgataagttgaaggctgagcgtgagcgtggtatcaccattgatattgccttgtggaagtttgagacaaccaagtactactgcactgtcattgatgctcctggacatcgcgacttcattaagaatatgattacgggtacttctcaagctgactgtgctgtccttatcattgactccacaactggaggttttgaagctggtatttccaaggatgggcagacccgtgagcatgctctccttgccttcactcttggtgtcaagcaaatgatttgctgctgcaacaagatggatgccacaacccccaagtactcaaaggcaaggtatgatgaaattgttaaggaagtttcttcctacctgaagaaggttggttacaaccctgagaagattccattcgtccccatatctggttttgagggtgacaacatgattgagaggtccaccaacctcgattggtacaagggtccaaccctccttgaggctcttgaccagatcaatgagcccaagagaccctctgacaagcccctccgtctcccacttcaggatgtctacaagatcggtggtattggaactgtcccggtgggtcgtgttgaaaccggtacccttaagcctggaatggttgttacattcggaccttctggattgaccactgaagttaagtctgttgagatgcatcatgaagctcttcaagaggctcttcctggtgacaatgttgggttcaatgtgaagaatgttgctgtcaaggatctcaagcgtggatatgttgcctccaactccaaggatgatcctgccaaggaggcagccaacttcacctcccaagttatcattatgaaccatccaggacagataggaaatggttatgcacctgtcctcgattgccacacctcccacattgctgtcaagtttgcagagctcttgaccaagattgacagacgatctggtaaggagctagagaaggagcctaagttcttgaagaatggtgatgccggtatgattaagatggttccgaccaagcccatggttgtggaaaccttctccgaataccctccacttggacgttttgccgttagggacatgagacagaccgttgctgttggtgtgatcaagagtgtggagaagaaggacccatctggagccaaggtgaccaagtctgccgccaagaagggtggcaagtgaactttggtttagtcagtttttgttttgtgagatccgtaattaattccttgagtatttggtttttgctttttagacgatgaggttttcagacaacatggttgtgtgcttgagagttaacttgcaactgatctttcactactgataagaaaatgagtggacttcaagcttctatcagaacgcatacttctttagcctcagagcttttgtttcgcttcttttagtgatag

SEQ ID NO: 1001 - DNA, 1639 bp, Gossypium hirsutum
gccgatttctccgttcttcaaaatttaagttttttctgctaaaaagttgctatgggtaaggagaaggttcacatcaacattgttgtcattggccatgtcgactctggaaagtcaacaacaactggtcacttgatctacaagcttggaggtattgacaagcgtgtgatcgagaggttcgagaaggaagctgctgagatgaacaaaaggtcattcaagtatgcctgggtgctcgataagttgaaggctgagcgtgagcgtggtatcaccattgatattgccttgtggaagtttgagacaaccaagtactactgcactgtcattgatgctcctggacatcgtgacttcattaagaatatgattacgggtacttctcaagctgactgtgctgtccttatcattgactccacaactggaggttttgaagctggtatttccaaggatgggcagacccgtgagcatgctctccttgccttcactcttggtgtcaagcaaatgatttgctgctgcaacaagatggatgccacaacccccaagtactcaaaggcaaggtatgatgaaattgttaaggaagtttcttcctacctgaagaaggttggttacaaccctgagaagattccattcgtccccatatctggttttgagggtgacaacatgattgagaggtccaccaacctcgattggtacaagggtccaaccctccttgaggctcttgaccagatcaatgagcccaagagaccctctgacaagcccctccgtctcccacttcaggatgtctacaagatcggtggtattggaactgtcccggtgggtcgtgttgaaaccggtacccttaagcctggaatggttgttacattcggaccttctggattgaccactgaagttaagtctgttgagatgcatcatgaagctcttcaagaggctcttcctggtgacaatgttgggttcaatgtgaagaatgttgctgtcaaggatctcaagcgtggatatgttgcctccaactccaaggatgatcctgccaaggaggcagccaacttcacctcccaagttatcattatgaaccatccaggacagataggaaatggttatgcacctgtcctcgattgccacacctcccacattgctgtgaagtttgcagagctcttgaccaagattgacagacgatctggtaaggagctagagaaggagcctaagttcttgaagaatggtgatgcaggtatgattaagatggttccgaccaagcccatggttgtggaaaccttctccgaataccctccacttggacgttttgccgttagggacatgagacagaccgttgctgttggtgtgatcaagagtgtggagaagaaggacccatctggagccaaggtgaccaagtctgccgccaagaagggtggcaagtgaactttggtttagtcagtttttgttttgtgagatccgtaattaattccttgagtatttggtttttgctttttagacgatgaggttttcagacaacatggttgtgtgttgaagtttttacttgagagttaacttgcaactgatctttcactactgataagaaaatgagtggacttcaagcttctatcagaacgcatacttctttagcctcagagcttttgtttcgcttcttttagtgata

SEQ ID NO: 1002 - DNA, 1944 bp, Euonymus alatus
ctctagcagctagggcatctcacatctgcgaatcaagctagctgccaaacgtctacaaccgttggatatttttctgatccaacggtcgaagaagaaaccctagtctcactgtgtccccattgccactctataaaatcacagtcttctctcatttctcgtcctctgccatctctctcactcaagtcggcgagagagacacagtcgatcgttcttctagacttctatttgtcagctacaggttttttcagctagaatttcattatgggtaaggagaagactcacatcaacattgtggtcattggccatgtcgattccggaaagtcaaccacaactgggcacttgatttacaagcttggtggaattgacaagcgtgttattgagagatttgagaaggaagctgctgagatgaacaagagatcattcaagtatgcatgggtgttggacaaactcaaggctgagcgcgaacgtggtataaccattgatattgctctatggaagtttgagaccacaaagtattattgcactgttattgatgctcctggacatcgtgactttattaagaatatgatcactggtacctcacaagccgactgtgctgtcctcatcattgactcaactactggtggttttgaagctggtatttccaaggatggccagacccgtgagcatgcactgcttgcttttactcttggtgtgaaacaaatgatttgttgctgcaacaagatggacgccactacacccaaatactctaaggctaggtatgaggaaattgtgaaggaagtttcttcctacttgaagaaggttggttacaaccctgacaagatcccatttgttcccatctctggttttgagggtgacaacatgatcgagagatctaccaaccttgactggtacaagggcccaaccctcctcgatgcccttgaccagatttcagaacccaagaggccctcagacaagcccctccgtctcccccttcaggatgtttacaagattggtggtattggaactgtcccagtcggacgtgttgagactggtgtcctgaagcctggtacagttgtgacctttggccctactggactgaccactgaagttaagtctgttgagatgcaccacgaggctctccaggaggccctgccaggtgacaatgttggcttcaatgtcaagaacgttgctgtgaaggatctgaagcgtggttttgttgcttccgactctaaaaatgatcctgctaaggaggctgccagcttcacctctcaggtcattatcatgaaccaccctgggcagattggaaatggctatgctccggtcctcgattgtcacacatctcatattgctgttaagtttgctgagatcttgactaagattgacaggcgatctggtaaggagcttgagaaggagccaaagtttttgaagaatggtgatgctggaatggtaaagatgattccaaccaagcctatggtagtggagaccttctctgcataccctcctcttggtcgtttcgctgttcgggacatgcgccagaccgtggctgtgggagtcataaagagtgttgataagaaggaagcatctgctgccaaggtcaccaagtctgctgctaagaagaaatgaatcatgggagttcgcagtggattgcattcagctgaagtctactttcatatgaataattgtctttcatacacattttatgttggtactgtcatctttggtttatttcgttttatatgttatagttttgtgccgtcgttgggttgccagtctgagaaccgggtacttgacaggcggtggcggcacagtttatagcatagagccctcttgtttttggagattttagtgtcaattttcggtcgagattactatgtcttgaggggtggttttctacttttcttccaaacggctcagaagttttgtcgttgtggttatcaagtaatgcaaattgtcgtatcttta

SEQ ID NO: 1003 - DNA, 1610 bp, Euonymus alatus
atctctctcactcaagtcggcgagagagacacagtcgatcgttcttctagacttctatttgtcagctacaggttttttcagctagaatttcattatgggtaaggagaagactcacatcaacattgtggtcattggccatgtcgattccggaaagtcaaccacaactgggcacttgatttacaagcttggtggaattgacaagcgtgttattgagagatttgagaaggaagctgctgagatgaacaagagatcattcaagtatgcatgggtgttggacaaactcaaggctgagcgcgaacgtggtataaccattgatattgctctatggaagtttgagaccacaaagtattattgcactgttattgatgctcctggacatcgtgactttattaagaatatgatcactggtacctcacaagctgactgtgctgtcctcatcattgactcaactactggtggttttgaagctggtatttccaaggatggccagacccgtgagcatgcactgcttgcttttactcttggtgtgaaacaaatgatttgttgctgcaacaagatggacgccactacacccaaatactctaaggctaggtatgaggaaattgtgaaggaagtttcttcctacttgaagaaggttggttacaaccctgacaagatcccatttgttcccatctctggttttgagggtgacaacatgatcgagagatctaccaaccttgactggtacaagggcccaaccctcctcgatgctcttgaccagatttcagaacccaagaggccctcagacaagcccctccgtctcccccttcaggatgtttacaagattggtggtattggaactgtcccagtcggacgtgttgagactggtgtcctgaagcctggtacagttgtgacctttggtcctactggactgaccactgaagttaagtctgttgagatgcaccacgaggctctccaggaggccctgccaggtgacaatgttggcttcaatgtcaagaacgttgctgtgaaggatctgaagcgtggttttgttgcttccgactctaaaaatgatcctgctaaggaggcggccagcttcacctctcaggtcattatcatgaaccaccctgggcagattggaaatggctatgctccggtcctcgattgtcacacatcccacattgctgtcaagtttgctgagatcttgactaagattgacaggcgatctggtaaggagcttgagaaggagccaaagtttttgaaaaatggtgatgcaggaatggtaaagatgattccaaccaagcccatggtagtggagaccttctctgcttaccctcctcttggtcgtttcgctgttcgggacatgcgccagactgtggctgtgggagtcataaagagtgttgataagaaggaagcatctgctgccaaagtcaccaagtctgctgctaagaagaagtgatagatgtcttttggttgatttgcattacctattgtagtgtttgtttgcctttgccctgcgattttgtttgcttttcgcatcagttttgtcatttgtggacatcttaatttgatttgtagacatcgtaagttgttttttattggttttgttatcaatgatcagtgtttatgat

SEQ ID NO: 1004 - DNA, 1612 bp, Euonymus alatus
cggccgggggcttcatttttgttctctgcatctgcggctagggtttcagtttgtctttcatttcttctttgtgaaagttttgcattagaaatcaaccatgggtaaggagaaaactcacatcaacatcgttgtcattggccacgtcgactctggaaagtcgacaactactggacacttgatttataagcttggtggcattgacaagcgtgttattgagaggtttgagaaggaagctgctgagatgaacaagagatcatttaagtatgcctgggtgttggacaaactcaaggctgagcgtgaacgtggtattaccattgatattgctctgtggaagttcgagacaacaaagtactactgcactgtcattgatgctcccggacatcgtgactttatcaagaacatgattactggtacctcacaggctgactgtgctgtcctcatcattgactccaccactggtggttttgaagctggtatttccaaggatgggcagacccgtgagcatgcattgcttgcttttacccttggtgtgaagcaaatgatttgttgttgcaacaagatggacgccactacccccaagtactcgaaggctaggtatgaggaaattgtgaaggaagtttcttcctacttgaagaaggttggttacaaccctgacaagatcccatttgttcctatctctggttttgagggtgacaacatgatcgagagatctaccaaccttgactggtacaagggcccaaccctccttgatgctcttgaccagatctcagaacccaagaggccctcagacaagcccctccgtctcccccttcaggatgtttacaagattggtggtattggaactgtcccagtcggacgtgttgagactggtgtcctgaagcctggtacagttgtgacctttggtcctactggactgaccactgaagttaagtctgttgagatgcaccacgaggctctccaggaggccctgccaggtgacaatgttggcttcaatgtcaagaacgttgctgtgaaggatctgaagcgtggttttgttgcttccgactctaaaaatgatcctgctaaggaggctgccagcttcacctctcaggtcattatcatgaaccaccctgggcagattggaaatggctatgccccggtccttgattgccacacatcccacattgctgtcaagtttgctgagatcttgactaagattgacaggcgatctggtaaggagcttgagaaggagccaaagtttttgaagaatggtgatgcaggaatggtaaagatgattccaaccaagcctatggtagtggagaccttctctgcttaccctcctcttggtcgtttcgctgttcgggacatgcgccagactgtggctgtgggagtcataaagagtgttgataagaaggaagcatctgctgccaaagtcaccaagtctgctgctaagaagaagtgatagatagatgtcttttggttgatttgcattacctattgtagtgtttatttgcctttgccctgcgattttgtttgcttttcggttcagttttgtcatttgtgaacatcttaatttgatttgtagacatcgtaagttgttttttgttggttttgttatcaatgatcagtgttt

SEQ ID NO: 1005 - DNA, 1735 bp, Euonymus alatus
cagtgcgtctttcatttcttctttgcgaaagttttgcattagaaatcaaccatgggtaaggagaaaactcacatcaacatcgttgtcattggccacgtcgactctggaaagtcgacaactactggacacttgatttataagcttggtggcattgacaagcgtgttattgagaggtttgagaaggaagctgctgagatgaacaagagatcatttaagtatgcctgggtgttggacaaactcaaggctgagcgtgaacgtggtattaccattgatattgctctgtggaagtttgagacaacaaagtactactgcactgtcattgatgctcccggacatcgtgactttatcaagaatatgattactggtacctcacaggctgactgtgctgtcctcatcattgactccaccactggtggttttgaagctggtatttccaaggatgggcagacccgtgagcatgcgttgcttgcttttacccttggtgtgaagcaaatgatttgttgttgcaacaagatggacgccactacccccaagtactcgaaggctaggtatgaggaaattgtgaaggaagtttcttcctacttgaagaaggttggttacaaccctgacaagatcccatttgttcccatctctggttttgagggtgacaacatgatcgagagatctaccaaccttgactggtacaagggcccaaccctcctcgatgcccttgaccagatttcagaacccaagaggccctcagacaagcccctccgtctcccccttcaggatgtttacaagattggtggtattggaactgtcccagtcggacgtgttgagactggtgtcctgaagcctggtacagttgtgacctttggtcctactggactgaccactgaagttaagtctgttgagatgcaccacgaggctctccaggaggccctgccaggtgacaatgttggcttcaatgttaagaacgttgctgtgaaggatctgaagcgtggttttgttgcttccgactctaaaaatgatcctgccaaggaggcggccagcttcacctctcaggtcattatcatgaaccaccctgggcagattggaaatggctatgccccagtccttgattgccacacatcccacattgctgtcaagtttgctgagatcttgactaagattgacaggcgatctggtaaggagcttgagaaggagccaaagtttttgaaaaatggtgatgctggaatggtaaagatgattccaaccaagcctatggtagtggagaccttctctgcataccctcctcttggtcgtttcgctgttcgggacatgcgccagaccgtggctgtgggagtcataaagagtgtcgataagaaggaagcatctgctgccaaagtcaccaagtctgctgctaagaagaaatgaatcatgggagttcgcagtggattgcattcagctgaagtctactttcatatgaataattgtctttcatacacattttatgttggtactgtcatctttggtttatttcgttttatatgttatagttttgtgccgtcgttgggttgccagtctgagaaccgggtacttgacaggcggtggcggcacagtttatagcatagagccctcttgtttttggagattttagtgtcaattttcggtcgagattactatgtcttgaggggtggttttctacttttcttccaaacggctcagaagttttgtccttgtggttatcaagtaatgcaaattgtcgtatctttag

SEQ ID NO: 1006 - DNA, 1752 bp, Euonymus alatus
tctgcatctgcggctagggtttcagtttgtctttcatttcttctttgtgaaagttttgcattagaaatcaaccatgggtaaggagaaaactcacatcaacatcgtcgtcattggccacgtcgactctggaaagtcgacaactactggacacttgatttataagcttggtggcattgacaagcgtgttattgagaggtttgagaaggaagctgctgagatgaacaagagatcatttaagtatgcctgggtgttggacaaactcaaggctgagcgtgaacgtggtattaccattgatattgctctgtggaagtttgagacaacaaagtactactgcactgtcattgatgctcccggacatcgtgactttatcaagaatatgattactggtacctcacaggctgactgtgctgtcctcatcattgactccaccactggtggttttgaagctggtatttccaaggatggccagacccgtgagcatgcgttgcttgcttttacccttggtgtgaagcaaatgatttgttgttgcaacaagatggacgccactacccccaagtactcgaaggctaggtatgaggaaattgtgaaggaagtttcttcctacttgaagaaggttggttacaaccctgacaagatcccatttgttcccatctctggttttgagggtgacaacatgatcgagagatctaccaaccttgactggtacaagggcccaaccctcctcgatgctcttgaccagatttcagaacccaagaggccctcagacaagcccctccgtctcccccttcaggatgtttacaagattggtggtattggaactgtcccagtcggacgtgttgagactggtgtcctgaagcctggtacagttgtgacctttggccctactggactgaccactgaagttaagtctgttgagatgcaccacgaggctctccaggaggccctgccaggtgacaatgttggcttcaatgtcaagaacgttgctgtgaaggatctgaagcgtggttttgttgcttccgactcgaaaaatgatcctgctaaggaggctgccagcttcacctctcaggtcattatcatgaaccaccctgggcagattggaaatggctatgctccggtcctcgattgccacacatcccatattgctgttaagtttgctgagatcttgactaagattgacaggcgatctggtaaggagctcgagaaggagccaaagtttttgaagaatggtgatgctggaatggtaaagatgattccaaccaagcctatggtagtggagaccttctctgcataccctcctcttggtcgtttcgctgttcgggacatgcgccagaccgtggctgtgggagtcataaagagtgttgataagaaggaagcatctgctgccaaggtcaccaagtctgctgctaagaagaaatgaatcatgggagttcgcagtggattgcattcagctgaagtctactttcatatgaataattgtctttcatacacattttatgttggtactgtcatctttggtttatttcgttttatatgttatagttttgtgccgtctttgggttgccagtctgagaaccgggtacttgacaggcggtggcggcacagtttatagcatagagccctcttgtttttggagattttagtgtcaattttctgtcgagattactatgtcttgaggggtggttttctacttttcttccaaacggctcagaagttttgtccttgtggttatcaagtaatgcaaattgtcgtatc

SEQ ID NO: 1007 - DNA, 1764 bp, Euonymus alatus
gtcttctctcatatctcgtcctctgccatctctctcactcaagtcggcgagagagacacagtcgatcgttcttctagacttctattgtcagctacaggttttttcagctagaatttcattatgggtaaggagaagactcacatcaacattgtggtcattggccatgtcgattccggaaagtcaaccacaactgggcacttgatttacaagcttggtggaattgacaagcgtgttattgagagatttgagaaggaagctgctgagatgaacaagagatcattcaagtatgcatgggtgttggacaaactcaaggctgagcgcgaacgtggtataaccattgatattgctctatggaagtttgagaccacaaagtattattgcactgtaattgatgctcctggacatcgtgactttattaagaatatgatcactggtacctcacaagctgactgtgctgtccttatcattgactcaactactggtggttttgaagctggtatttccaaggatggccagacccgtgagcatgcactgcttgcttttactcttggtgtgaaacaaatgatttgttgctgcaacaagatggacgccactacaccgaaatactctaaggctaggtatgaggaaattgtgaaggaagtttcttcctacttgaagaaggttggttacaaccctgacaagatcccatttgttcccatctctggttttgagggtgacaacatgattgagagatctaccaaccttgactggtacaagggaccaaccctccttgacgctcttgaccagatctcggaacccaagaggccctcagacaagcccctccgtctccctcttcaggatgtttacaagattggtggtattggaactgtcccagtcggacgtgttgagactggtgtcctgaagcctggtacagttgtgacctttggtcctactggactgaccactgaagttaagtctgttgagatgcaccacgaggctctccaggaggccctgccaggtgacaatgttggcttcaatgtcaagaacgttgctgtgaaggatctgaagcgtggttttgttgcttccgactcgaaaaatgatcctgctaaggaggctgccagcttcacctctcaggtcattatcatgaaccaccctgggcagattggaaatggctatgctccggtcctcgattgccacacatcccatattgctgtgaagtttgctgagatcttgactaagattgacaggcgatctggtaaggagcttgagaaggagccaaagtttttgaagaatggtgatgcaggaatggtaaagatgattccaaccaagcctatggtagtggagaccttctctgcttaccctcctcttggtcgtttcgctgttcgggacatgcgccagactgtggctgtgggagtcataaagagtgttgataagaaggaagcatctgctgccaaagtcaccaagtctgctgctaagaagaagtgatagatagatgtcttttggttgatttgcattacctattgtagtgtttgtttgcctttgccctgcgattttgtttgcttttcgcatcagttttgtcatttgtgaacatcttaatttgatttgtagacatcgtaagttgttttttgttggttttgttatcaatgatcagtgtttttgataagctacagatgcatgagaagaaaacaccaggttgtcagtatggatggtttgaaaggttacaacagaagaaataaggagtgtgaggcactgcaaattagcaaataaccaagtctgaatttctac

SEQ ID NO: 1008 - DNA, 1617 bp, Euonymus alatus
cggccgggggcttcattttgttctctgcatctgcggctagggttgcagtgcgtttttcatttcttctttgcgaaagttttgcattagaaatcaaccatgggtaaggagaaaactcacatcaacatcgttgtcattggccacgtcgactctggaaagtcgacaactactggacacttgatttataagcttggtggcattgacaagcgtgttattgagaggtttgagaaggaagctgctgagatgaacaagagatcatttaagtatgcctgggtgttggacaaactcaaggctgagcgtgaacgtggtattaccattgatattgctctgtggaagttcgagacaacaaagtactactgcactgtcattgatgctcctggacatcgtgactttatcaagaatatgattactggtacctcacaggctgactgtgctgtcctcatcattgactccaccactggtggttttgaagctggtatttccaaggatggccagacccgtgagcacgcgttgcttgcttttacccttggggtgaagcaaatgatttgttgttgcaacaagatggacgccactacccccaagtactcgaaggctaggtatgaggaaattgtgaaggaagtttcttcctacttgaagaaggttggttacaaccctgacaagatcccatttgttcctatctctggttttgagggtgacaacatgatcgagagatctaccaaccttgactggtacaagggcccaaccctccttgatgctcttgaccagatctcagaacccaagaggccctcagacaagcccctccgtctcccccttcaggatgtttacaagattggtggtattggaactgtcccagtcggacgtgttgagactggtgtcctgaagcctggtacagttgtgacctttggtcctactggactgaccactgaagttaagtctgttgagatgcaccacgaggctctccaggaggccctgccaggtgacaatgttggcttcaatgttaagaacgttgcagtgaaggatctgaagcgtggttttgttgcttccgactctaaaaatgatcctgccaaggaggcggccagcttcacctctcaggtcattatcatgaaccaccctgggcagattggaaatggctatgccccggtccttgattgccacacatcccacattgctgtcaagtttgctgagatcttgactaagattgacaggcgatctggtaaggagcttgagaaggagccaaagtttttgaagaatggtgatgcaggaatggtaaagatgattccaaccaagcccatggtagtggagaccttctctgcttaccctcctcttggtcgtttcgctgttcgggacatgcgccagactgtggctgtgggagtcataaagagtgttgataagaaggaagcatctgctgccaaagtcaccaagtctgctgctaagaagaagtgatagatagatgtcttttggttgatttgcattacctattgtagtgtttatttgcctttgccctgcgattttgtttgcttttcggttcagttttgtcatttgtggacatcttaatttgattcgtagacatcgtaagttgttttttattggttttgttatcaatgatcagtgtttatgatg

SEQ ID NO: 1009 - DNA, 1601 bp, Euphorbia peplus
atctaaaatgggtaaggagaagattcatatcagtattgtggtcattggacatgtcgactctggcaagtccaccaccactggacatctcatctacaagcttggaggtattgacaagcgtgtgattgaaagattcgagaaggaagcagctgagatgaacaaaaggtcattcaagtacgcctgggtgcttgacaagcttaaggctgagcgtgagcgtggtatcaccattgatattgccttgtggaagtttgagaccactaagtactactgcactgttattgatgctcctggacacagggactttatcaagaacatgattactggaacttctcaggctgactgtgctgttctcatcatcgattccactactggtggttttgaagctggtatttccaaggatggtcagactcgtgagcatgctctccttgctttcaccctcggtgtcaagcaaatgatctgttgttgtaacaaaatggatgcaacaactcccaagtactcaaaggccaggtatgaggaaattgtcaaggaagtgtcgtcctacctcaagaaggttggatacaaccctgacaaaattccatttgtgcccatctctgggtttgaaggtgacaatatgattgagaggtcaaccaacctcgactggtacaagggacccactttgcttgacgcacttgaccagatcaatgagccaaagaggccatcatacaagcccctccgtctaccttttcaggacgtgtacaatattggaggtattggaactgtgcccgttggtcgtgtggatactgggatcatcaagccaggtatggttgtgacctttggacccagtgggctcaccactgaagttaagtctgtggagatgcaccacgaggctctccaggaggctcttccaggtgacaatgtggggttcaatgtcaagaatgttgcagtgaaggatcttaagagaggttttgttgcatccaactcaaaggatgaccctgccaaggaagcagccaacttcacatctcatgttattatcatgaaccaccctggccagattggaaatggctatgctccagtcttggattgccacacctcccacattgctgtcaagttctctgagatcctgaccaagattgatcgccggtcggggaaggagctagagaaggagccaaaatttttgaagaatggagatgcaggtatgattaagatgattccaaccaagcctatggtggttgagacctttgctgagtaccctccattgggtcgttttgctgtgagggacatgagacaaactgttgctgttggtgtcatcaagagtgttgagaagaaggatccttccggagctaaggtcaccaagtctgctgccaagaagaaatgaatggtggggtctgcaagttctattgttggtatgatgaacgttttatggtattgcgttagtctttttaaatgtttaattagtagttaccttttgacctttacatatcgtccattctcttgctgtattacacaagaatgggtgctagacaggcggtggtagcatatatattgtatgaggatttatggttttggttatgtttacttttcttgtttcttactgttgagttgaattgctatatctaagtttgata

SEQ ID NO: 1010 - DNA, 1680 bp, Euphorbia peplus
agccctagctgatagctcactataaatcactgcatttccaattcattcctctttctattttgcggcggcttccctcttttactatccctttcagatcagtgttagatattcgtaatgggtaaggagaagattcacataagcattgtggtcattggccatgtcgactctggcaagtccaccactactggtcatctcatttacaagcttggaggtatagacaagcgtgtcattgagagatttgagaaggaagctgctgagatgaacaaaaggtcgttcaagtacgcctgggtgcttgacaagcttaaggctgagcgtgagcgcggtatcaccattgatattgccttgtggaagttcgagaccactaagtactactgcactgttattgatgcacctggacacagggactttatcaagaacatgattactggtacctcgcaggctgattgtgctgttcttatcattgattccacgactggtggttttgaggctggtatctcaaaggatgggcagactcgtgagcacgccctccttgcttttacccttggtgtcaagcagatgatttgctgctgcaacaagatggatgccactactcccaagtattccaaggccaggtatgacgaaatcatcaaggaagtctcctcctacctcaagaaggttggatacaaccctgataaaataccttttgtccccatttccgggtttgaaggtgacaacatgattgagagatcaaccaaccttgactggtacaaaggaccgaccctgctcgaagctcttgaccagattaatgagccaaagaggccaacagacaagccccttcgtctacctcttcaggacgtttacaagattggtggtattggcactgtcccagtgggtcgtgtagaaaccggtgtcatcaagccgggtatggttgtgaccttcggacccagtggactcacaacagaagttaagtcagttgagatgcatcacgaggctctacaggaagctcttcctggtgacaatgtcgggttcaatgtgaagaatgtggcagttaaggatctcaagagaggatacgttgcatccaactctaaggatgatccagccaagggagctgccaacttcacatcacaggtcattatcatgaaccaccctggccagattggaaacggatacgccccagtgttggattgccacacctcccacattgctgtgaagttctctgagatcctcaccaagattgatcgtcgatctggcaaggagctggagaaggaacccaagtttttgaagaatggggatgctgggtttgtgaaaatgattccaaccaagcctatggtggtagagacctttgctgagtacccaccattgggtcgtttcgcagttagggacatgagacagacggttgcagtgggtgttatcaagagtgtggataagaaggatccttcgggtgctaaagtgaccaagtctgctgtgaagaagggaaagtgaatcgtgcggaggagagagtacaataattttgtggagagcatgttaagttactatgccagtttatattttatctacattacatttttgactcttgtgttgccattttctagtcgccatactcagaattgggtgctagacagacggtggcattagttttggttttattgttgcgtactcttgagagttgagaccattttctatatgattttttcctattac

SEQ ID NO: 1011 - DNA, 1612 bp, Fraxinus spp
cggccgggggctcttgacataaatcaaaaactctctctgcagtcggcggcgggtgagagatttctctatactacattcgaagctttctttttaaaagcaagaatcatgggaaaggaaaagattcacattagcattgtggtcattggccacgtcgactctggaaagtcaaccaccactggccatttgatctacaagcttggtggtattgacaaacgtgttattgaaaggttcgagaaggaggctgctgagatgaacaagaggtcattcaagtatgcctgggtgctcgacaagctcaaggctgagcgtgaacgtggtattaccattgatattgccttgtggaaattcgagaccaccaaatattactgcacagttatcgatgctccaggacatcgtgactttatcaagaacatgattactggtacttcacaggctgactgtgctgtcctcatcattgactctaccactggtggttttgaagctggtatttccaaggatggtcagacccgtgagcatgcgttgcttgccttcacccttggtgtcaagcaaatgatttgctgctgcaacaagatggatgccactacgcctaaatactcgaagtctaggtatgatgaaattgtgaaggaagtgtcatcctacatcaagaaggtcggatacaaccctgacaagattccatttgtccccatctctggttttgagggtgacaacatgattgagaggtccaccaaccttgattggtacaagggcccaaccctcctcgacgctcttgaccagattcaggaacccaagagaccctcagacaagcctctccgtctcccacttcaggatgtctacaagattggtggtattggaactgtccccgtcggccgtgttgagactggtgttatcaagcctggtatggttgtcaccttcggcccaactggtttgacaactgaagtcaagtctgttgaaatgcaccatgaggccctccaggaggctctccccggtgacaatgttgggttcaacgtcaagaatgttgcagtgaaggatctcaagcgtggttatgttgcctccaactccaaggatgaccccgccaagggtgctgctagctttacttcccaggtcatcatcatgaaccaccctggtcagatcggaaatggatatgccccagtgctcgactgccacacatcccacattgctgttaagtttgccgagctccagaccaagattgacaggcgttccggtaaggagctggagaaggagcccaagttcttgaagaacggtgatgctggtcttgttaagatgattcccaccaagcccatggttgtggagacttttgcagagtatccacctcttggtcgttttgccgtgagggatatgcgccagacagttgctgttggtgtgatcaagagcgtggacaagaaggatccatctggtgccaaggtcaccaaagctgctgctaagaagggcgctaagtgaagaaattttaagttattgattaattacattatctattttcaagacatctttggcagttttgattattatggttttccctgatgctctatctggattgccatttcttgtttttaatttatcatgaatttaagacctatgttcgaacgtcttttaattg

SEQ ID NO: 1012 - DNA, 1558 bp, Fraxinus spp
ctcttgatagaaatcagaacgctctctgcagtcggcgggtgagagatttttctatactacattcgaagctttctttttaaaagtaaaacatgggtaaggaaaagattcacattagcattgtggtcattggccacgtcgactctggaaagtcaaccaccactggccatttgatctacaagcttggtggtattgacaaacgtgttattgaaaggttcgagaaggaggctgctgagatgaacaagaggtcattcaagtatgcctgggtgcttgacaagctcaaggctgagcgtgaacgtggtattaccattgatattgccttgtggaaattcgagaccaccaagtattactgcacagttatcgatgctccaggacatcgtgactttatcaagaacatgattactggtacttcacaggctgactgtgctgtccttatcattgactctaccactggtggtttcgaagctggtatttccaaggatggtcagacccgtgagcatgcgttgcttgccttcacccttggtgtcaagcaaatgatttgctgctgcaacaagatggatgccactacacctaaatactcaaagtctaggtatgatgaaattgtgaaggaagtgtcatcctacatcaagaaggtcggatacaaccctgacaagatcccatttgtccccatctctggttttgagggtgacaacatgattgagaggtccaccaaccttgattggtacaagggcccaaccctcctcgatgctcttgaccagattcaggagcccaagagaccctcagacaagcctctccgtctcccactgcaggatgtctacaagattggtggtattggagctgtccccgttggccgtgttgagacgggtgttatcaagcctggcatggttgtcaccttcggcccaactggtttgacaactgaagtcaagtctgttgagatgcaccatgaggccctccaggaggctctccctggtgacaatgttgggttcaacgtcaagaatgttgcagtgaaggatctcaagcgtggttatgttgcctccaactccaaggatgaccctgccaagggtgctgccagcttcacttcccaggtcatcatcatgaaccaccctggtcagatcggaaatggatatgccccagtgctcgactgccacacatcccacattgctgttaagtttgctgagctccagaccaagatcgacaggcgttctggtaaggagctggagaaggagcccaaattcttgaagaacggtgatgctggtcttgttaagatgattcccaccaagcccatggttgtggagacttttgcagagtatccacctcttggtcgttttgccgtgagggatatgcgccagacagttgcagttggtgtgatcaagaacgtggataagaaggatccaaccggtgcaaaggtcaccaaagctgcggctaagaagggtgccaagtgaagaaatttcgtgttattggttaattacattatctattttcaaagacatcttttgcagttttgattattatatggtttttcctgataatccatctggattgccatttcttgtttttaatt

SEQ ID NO: 1013 - DNA, 2105 bp, Gnetum gnemon
ccctcatcggaaaagaatgaggggtgcgtcatggttttttcttatgtcatagtaatactggtactagaaagaaatactatgacataagaaaaaccatgacgcacccctcatcggaaaagaatgaaacaaataaaaagcccaaagcatgcaaaattaaccacctcacactaccaccctaatcagtagaagctctcgcgaatcaatgaggggggaactctgcgcctcttcctgctgctgctgcggctcgagaaatttgtgcgatctcgatctctcattgttattttcttgttttcggcggccgttccaaagtttcaacttgagccatgggtaaagagaagactcacattaacattgtggtcattgggcacgtcgactctggaaagtcgaccaccaccggtcatttgatttataagcttggtggtatcgacaagcgtgtgattgagcgtttcgagaaggaggctgctgagatgaacaagagatcattcaaatacgcttgggttcttgacaagcttaaggctgagcgtgagcgtggtattaccattgacattgctctctggaagttcgagaccaacaaatactactgtaccgtcattgatgctcccggacaccgtgactttatcaagaatatgattacgggaacatctcaggctgattgtgccgtcctcatcatcgactccaccactggaggtttcgaggccggcatctcaaaggacggtcagacccgtgagcacgccctccttgctttcacccttggtgtgaagcaaatgatttgctgttgtaacaagatggatgcaacgacacccaagtactccaaggcacgttacgatgaaattgtaaaggaggtgtcatcatacctgaagagggttggttacaacccagacaaaattccatttgtgcccatctctggatttgagggtgataacatgattgaaagatccaccaaccttgactggtacaagggacctactcttcttgaggcccttgacatgattcatgagcccaagcgtccctctgacaagcctctcaggctgccacttcaggatgtgtacaagattggaggtattggaactgtgcctgtgggacgtgtcgaaactggtaccttgaagcctggtatggttgtcactttcggacccactgggctgaccactgaagttaagtctgtagaaatgcaccatgaagcgctgtcggaggctcttcctggtgacaatgtcggattcaacgtcaagaacgttgcagtgaaggatctcaagagaggttacgttgcatccgactccaagaatgacccagcgaaggaggcagccagcttcacttctcaggttatcatcatgaaccaccctggtcagattggaaacggttatgctcctgtgctcgactgccacacatcccacattgctgtcaagtttgctgagatccagaccaaggttgacaggcgttctggtaaggagctcgagaaggaacccaagttcctcaagaatggtgatgctggatttgttaagatgattccgaccaagcccatggtggtggagaccttctctgaatatcctcctcttggacgttttgccgtgagagacatgaggcagactgttgctgttggagtcatcaaggctgttgaaaagaaggaaccaactggtgccaaggttaccaaggccgcagcgaagaagaaatgaataacagatgcatcgtatgttttcttaggttgtaggatggtagtctctttagagttttacatgatgaactttgtttttgatgttggatttctaggcttttcggtaggttctcagaactgggttcttgatcgacggtggacttggtcttttagttgattgtttcttttgttatgttttaccttaggtttcttagttgcggggatgtttttctgcactgctaggaaatctagtcaggctgaggtttctgaatttgaataatttagtttttggacggttacaattttgatataaaatttctcaggagtttgttattgatcggacatttctttgttacagttcttctgtgttatctatgtttcctgttctcttaataccgggaaatagaaggttcctacatcaatatattatactgtttggaaatattattttagttgtagc

SEQ ID NO: 1014 - DNA, 1623 bp, Hevea brasiliensis
aaaatgggtaaggagaaggttcacatcaacatcgtggtcattggccatgtcgactctgggaagtccacgaccactggtcatctcatctacaagcttggaggtattgacaagcgtgttattgagaggtttgagaaggaagctgctgagatgaacaagaggtcattcaaatatgcctgggtgcttgacaagctcaaggctgagcgtgaacgtggtattaccattgatattgccctgtggaagttcgagaccaccaagtactactgcactgtcatcgatgctcctggacatcgtgactttattaagaacatgattactggaacctcacaggctgactgtgctgtcctcatcattgattccaccactggtggtttcgaagctggtatttccaaggatggacagacccgtgaacatgctctccttgctttcacccttggtgtcaagcaaatgatttgctgctgcaacaagatggatgccaccactcccaagtactccaaggccaggtatgatgaaattgttaaggaagtcgccttgtacctcaagaaagttgggtacaaccctgagaagattccatttgtgccaatctctggatttgaaggtgacaacatgattgagaggtccaccaaccttgactggtacaagggcccaacccttcttgaagctctggacctgatcctggagcccaagaggccctcagacaagccgctccgtctcccacttcaggatgtttacaagattggtggcattggaactgttccagtaggtcgtgtggagactggtgtcctgaagccaggtatggttgtgacctttgcacccagcggactgacaactgaagttaagtcagttgagatgcatcacgaggctctccaggaggcccttcctggtgacaatgtggggttcaacgtgaagaatgttgctgtgaaagatctcaagagaggttttgtggcatccaactctaaagatgatcctgctaaggaggctgccaacttcacatcacaggtcattattatgaaccatcccggtcagattggaaatggatatgccccagttttggactgccacacgtcccatattgccgtgaagtttgctgagatcttgaccaagattgatcgacgatcaggcaaggagctcgagaaggaacccaagtttttgaagaatggagatgctggctttgtgaagatgattcccaccaagcccatggttgttgagactttctccacgtaccccccattgggtcgttttgctgttagggacatgcgccagactgttgctgtgggtgttattaagagtgtagagaagaaggatccaactggagctaaggtcactaagtctgctgccaagaagggagggaaatgagttgtacgctcaccgcgttccacaaatgccattaagaacattttatgctctatttttgtgttttaaaatgtttaattagtagttataccttgagttttctgtgtccactgtgcgttgctgtacttagaattgggtgctagagaggcggtggagatagtctatctatggattttatggtttgattttgtaagtttatttacccattgagtttgatattgtttgtctttctcatatttctatatatttgttctcatctcattgatgtggctt

SEQ ID NO: 1015 - DNA, 2182 bp, Lactuca sativa
tggaacctcttattggcccaaaacacaaaaatacgactgaggtttgagggcatgaattgttattaatgagacttgacaaggataatatcgtaattaaataactcctctatacctaaatctaataatagtaaaccaaaaagagatggaggctggctagggcatcacaatatggaatccacggctgatcccaaaccctcacccgcacaaccgtcagatcacttcatccaacggctctaaaaaaaccctaatctcataccttctttactccacttataaaaactctctttgcagcacactccttccattcttcattttcctccatctattgagagagctagtctgcagataattcattaaggatgggtaaggaaaagattcatatcagcattgtcgtcatcggacatgtcgactccggcaagtcaacaaccactggtcacttgatctacaagcttggaggaatcgacaagcgtgtgatcgagaggttcgagaaggaagctgctgagatgaacaaacgttctttcaaatacgcatgggtgctcgacaaacttaaggccgagcgtgaacgtggtattaccatcgatattgccctctggaagtttgaaaccaccaagtactactgcacagtcatcgatgcccccggacatcgtgatttcatcaagaacatgattactggtacttcccaggccgattgtgccgttctcatcattgactccaccactggaggtttcgaagctggtatttccaaggatgggcagacccgtgagcacgctcttctcgctttcactcttggtgtgaagcaaatgatctgctgttgtaacaagatggatgctaccacccctaaatactccaagggtaggtacgaggaaatcgtgaaggaagtgtcttcatacttgaagaaggtcggatacaacccagacaaaatcccattcgttccaatctctggattcgaaggtgacaacatgattgagaggtcaaccaaccttgactggtacaagggaccaacccttcttgaagctcttgaccagatcaacgagccaaagagacccacagacaagccactccgtctaccacttcaggatgtttacaagatcggtggtattggaactgtgccagtgggacgtgttgagacaggtatcatcaagcctggtatggttgtgaccttcggaccaacagggttgaccactgaagtcaagtctgttgagatgcatcatgaagctttgaccgaagctcttcctggtgacaatgttgggttcaatgttaagaatgttgctgtgaaggatatcaagcgtgggtatgttgcctcaaactccaaggatgatcctgctaagggtgctgccagtttcacttcccaggttatcatcatgaaccaccctggtcagatcggaaatggttatgctccagtgttggattgccacacttctcacattgctgttaagttccaagagctgttgaccaagattgacagacgatcaggaaaggagcttgagaaggagcccaagtttttgaagaatggtgatgcaggtatggttaagatgatgccgaccaagcctatggtggtggagactttcgcagagtacccacctcttggaaggtttgctgtgagggacatgcgtcagactgttgctgttggtgtgatcaagagtgttgacaagaaggacccgactggagctaaggtgaccaaggccgcagccaagaagggtgtcaagtgatatgataggtgttgtgttttggtgatcgagtctttttattttctgtctgtttggattactagttttggacaatcttatattttgttgaagagtttttggtattggatctgggaagtttcgttatgttggaaactttcccaggtttgaagacttttgttgtggtttaaatctatagtggtctatggcatgagttggtttttaaaaacatttaaatctattttcaacattttatcatctcctggaaattttattcttgtttattcatttgaaacggtttgatattctgtttcgaatctgttgccttacaaaaatttcatcaaggaaaaaagatgtgattgtatatggggaaggaaagggatttacaatgcagctctcctacaactacgaagctcaaattttttgtagcaagagacaaaacaccctctaagaggatcagtcgaaagtggatatagatgagaattgttgagtggaag

SEQ ID NO: 1016 - DNA, 2378 bp, Pinus pinaster
gtatgaaccgtcggattcgagatcggacggcgatccgaaactgcaagcgtcggccgtcggatgcagcatcggacggcaaagaaggaaccctaaaacgcattgcaacgtgcttggtgggtggaggttctatgaccagtatatgttgataacaagggaggggaagtagtcctcttcatcttgtgcgagtctctctgctctctacgccgctgcgaagctgttctgtggtgcttctgattctccagactcaggcagccgtgtttgtaagagaatttagttcatcatgggaaaggagaaaacccatatcaacattgtggttattggccatgtcgactccggcaagtcaacaaccactgggcatttgatctacaagcttggaggaattgacaagcgtgtgattgaacgttttgagaaggaagctgctgagatgaacaagaggtcattcaagtatgcttgggttcttgacaagctcaaggctgaacgtgaacgtggtatcacaattgatattgcactgtggaagtttgagacaactaaatactactgcactgtgattgatgcccctggccatcgtgatttcatcaagaacatgattactggaacatctcaggctgactgtgcagttttgatcatcgactccaccactggaggttttgaagctggtatttccaaggacggtcagacgagagaacatgccctattggcgttcaccttgggagtgaagcaaatgatttgctgctgtaacaagatggatgccactactcccaagtactctaaggctcgttatgatgaaattgttaaggaagtatcttcttatttgaagagggttggatacaacccggacaagattccttttgtgcccatctctggttttgagggtgacaatatgattgagcgttctaccaaccttgattggtacaagggtccaacactcttggaagctctggaccaggtttcagagccaaagcgtccttcagacaagcctctgaggttgcctcttcaggatgtttacaagattggtggtattgggactgtgcctgttggtcgtgtggaaactggagtcataaaaccaggtacgattgttacctttggtcccactggtctgacaactgaagttaagtctgttgaaatgcatcatgaagctcttcaggaggcattgcctggtgacaatgtgggattcaatgttaagaatgttgctgttaaggatctcaagcgtggttatgtggcatctgattccaagaatgatccagcaaaggaagctgccaactttaccgcacaggttattattatgaatcatccaggacagattggaaatggttatgcccctgtgttggattgtcacacttgccacattgccgtcaagtttgctgagatcatgaccaaggttgacaggcgttctggcaaggagctggagaaggagcccaagtttcttaagaatggagatgctggatttgttaagatgattccaaccaaacccatggttgtcgaaacttttgcagagtatcctccattgggtcgttttgcagtcagggacatgcgtcagacggttgctgtaggagtcatcaaagctgttgaaaagaaggaacctagtggtgcaaaggttaccaaggcagcagccaaaaagaagtgaatgttccagcaaagtgattgggaatggaggattgcgtgctgcatttcgtgtgcttccatgcttatgcttcactattttcccgatagtatgttagtagagttagttttccaaatgcagaattgggttcttgatcggcggtggcataggttacattattttctagtaaatactttttaatggttacattaggctaaagttgatttaagatttcgtagttgcggggaaatcatgagtttgtctgcactgcaaggaaatctatgcagttggattgagggaggatgggcattaataatttctattactggtttactggtttattttaatgtttgtattgccgtccgtacatgacatttttctccggattgagaagacttggaatttatattaaagcgcagttttgaggagaaaatgtttttctaatacttttagattgctcgatgttttgtagatctatattctaggctctgcgtttttacttgcaattgaatatccgaaaagtcccttggttgagaatatgaaactagtcagtctctacgccaggcacactagaaaccttggttgttgctggatgcgtgatatagtttggcttttggagttatgctagctgtaaatgattttttgcgggcgctttgttaatcctccctctagtcactgttttcaggagtgacaagaaaatactattgtttttgttctactatacgtttgtcttagaaggagctcctggttttgcctggtataatttaagatgtcagaa

SEQ ID NO: 1017 - DNA, 1742 bp, Cucumis melo
aatccaattgccattctccatctctcgccgcaagggtttaagagcagctttctcctaagttattttacctaatattcaagcatgggtaaggaaaagactcacatcaacattgtggtcattggccatgtcgactctggtaagtcgaccactactggccatttgatttacaagcttggaggtattgacaagcgtgttattgagaggtttgagaaggaagctgctgagatgaacaagagatcgttcaagtatgcctgggtgttggataagcttaaggctgaacgtgagcgtggtatcacaattgatattgctttgtggaaattcgaaaccaccaagtactactgcactgttattgatgctcctgggcatcgtgatttcatcaagaacatgattactggaacttctcaggctgattgtgctgtccttatcattgactccactaccggaggttttgaagctggtatttctaaggatgggcagacccgtgaacacgccctccttgcctttaccctcggtgtcaagcaaatgatttgctgctgtaacaagatggatgccaccactcccaagtactccaaatctaggtacgatgaaattgtgaaggaagtttcttcctacctcaagaaggttggctacaacccagacaaaattcccttcgttcccatctctggctttgagggtgacaacatgattgaaagatccaccaacctcgattggtacaagggaccaacccttcttgaggcccttgacctgatccaagagcccaagagaccgtctgacaaaccccttcgtctcccacttcaggatgtctacaagattggaggtattggaactgttccagtgggtcgtgttgaaaccggtattataaaacctggtatggtggtaaccttcgccccaactggactgactactgaagttaagtctgtggagatgcaccacgaagctctccaagaagctctccctggtgacaacgtggggttcaacgtgaagaatgttgccgtgaaggatctcaagcgtggttatgttgcctcaaattccaaggatgatcctgccaaggaagctgcaaatttcacttcccaagttatcatcatgaaccatccaggacagattggaaatggttatgcacctgtcctcgattgccacacctctcacattgcagtcaaatttgctgagatcttaaccaagattgacaggcgatctggtaaagaactcgagaaagagcccaagtttctgaaaaatggagatgctggatttgttaagatgatccccaccaagcccatggtggtggaaacattctctgaatatcccccacttggacgatttgccgtgagggacatgcgtcaaaccgtggctgttggtgtcatcaaggccgttgagaagaaggacgcatccggcgccaaggtcaccaagtctgcagcaaagaaatcagggaagtgaatggtacgagtagccgttggcagtggtgaagtttgtcagaatgatgagtggattcttattaagttattgtctggttggggtttgttttgtctttgtttcgttgggtacgtctttaagtttcctccttcgtcgttgagcagattctctcagaattgggtgcttgatcggcggtggcaagtccttcctatttaaggttatatgttctatgcgtgttttactttaaactaatttttctggtattgatctttgtttctgtttcttacatactgatcgtttttgtgactattgcatgactgatttgccgtcaaaaa

SEQ ID NO: 1018 - DNA, 1708 bp, Mimulus guttatus
ctcagaaatcacactctctttctgcaaatcggcggcgaaagagatcaatcctcttctctctaagttcatttttcaaggttcaacatgggtaaagaaaagtttcacatcaacattgtcgtcattggacatgtcgactccgggaaatcgaccaccactggtcacttgatctacaagctaggtggtattgacaagcgtgtgatcgagaggttcgagaaggaggctgctgagatgaacaagaggtccttcaagtacgcatgggttttggacaagcttaaggccgagcgtgagcgtggtatcaccattgatattgccttgtggaagtttgagaccacgaagtactactgcacagtcatcgatgcccctggacatcgtgatttcatcaagaacatgattactggtacctcacaggctgactgtgctgtcctcatcattgactccaccactggtggttttgaggctggtatttccaaggatggtcagactcgtgagcatgctcttcttgctttcactcttggagtgaagcagatgatctgttgttgtaacaagatggatgccaccacccccaagtactccaagggtaggtacgaggaaatcgtgaaggaggtgtcttcatacctcaagaaggttggatacaaccccgacaaaatcccattcgttcccatctctggtttcgagggagacaacatgattgagaggtcgaccaaccttgactggtacaagggcccaactcttcttgaggctcttgacttaatctctgagccaaagaggccctcagacaagccactccgtctcccacttcaggatgtctacaagattggtggtattggaacggtgcccgtcggtcgtgttgagactggtctgatcaagcctggtatgctcgtcactttcggaccaactggtctgaccactgaggttaagtccgttgagatgcaccacgagtctatgcccgaggctctccccggagacaatgttgggttcaacgtgaagaatgttgcagtcaaggatctcaagcgtgggttcgttgcatcgaactcaaaggatgaccctgctaaggaagctgctaacttcacttcccaggtcatcatcatgaaccaccctggtcagattggaaacggttatgcaccagtgctcgactgtcacacatcccacattgctgtcaagttcagggaaatcttgaccaagattgacaggcgatcgggtaaggagattgagaaggagcccaagttcctcaagaatggtgatgccggtatggttaacatgattccgaccaagcccatggtggttgagactttctcagagtaccctcctttgggtcgttttgccgttcgtgacatgcgtcagacagttgctgttggtgttatcaagagcgttgagaagaaggacccatcaggcgcaaaagttaccaaggctgctgccaagaagggagccaagtgaagaggatgtgtttcgattttggttttcatctttagtttttgtttttggtatttattatggacaattttttactttttgtatggtctgcataagtttgttgtcacgtcatctagcctcatttatgaggatagtagagtattaagcaatatggtttaaccttattgcttgatgggcgtggtgataatctttgtgtataccctccaatcgttttttacttttgagtttatgatgagtttgagacattggttgctttaaaaatcttcgtatttctgtt

SEQ ID NO: 1019 - DNA, 1894 bp, Mimulus guttatus
gaaaaccctagaatttcactcctctccgaatttcactgctgctgctaagggccgttttgtaggcaaagcgactcgttctctttctctctctaacatctgcctacaagtttgtagccattcgctatgggtaaagaaaagtttcacatcaacattgtcgtcattggacatgtcgactccgggaaatcgaccactactggtcacttgatctacaagctaggtggtattgacaagcgtgtgatcgagaggttcgagaaggaggctgctgagatgaacaagaggtccttcaagtacgcatgggttttggacaagcttaaggccgagcgtgagcgtggtatcaccattgatattgccctgtggaagtttgagaccaccaaatactactgcacagtcatcgatgcccccggacatcgtgatttcatcaagaacatgattactggaacctcccaggctgactgtgctgtcctcatcattgactccaccactggtggtttcgaagccggtatttcgaaggatggacagactcgtgagcatgctcttcttgctttcactcttggagtcaagcagatgatctgttgttgtaacaagatggatgccaccacacccaagtactccaagggcaggtacgaggaaattgtcaaggaggtgtcttcatacctgaagaaggtcggatacaaccccgacaaaatcccattcgttcccatctctggtttcgagggagacaacatgattgagaggtcgaccaaccttgactggtacaagggcccaacccttctcgaggctcttgacttgatctctgagccaaagaggccctcagacaagccactccgtctcccacttcaggatgtctacaagattggtggtattggaacggtgcccgtcggtcgtgtggagactggtttgatcaagcctggtatgctcgtcactttcggaccaactggtctgaccactgaggttaagtccgttgagatgcaccacgagtctatgcccgaggctctccccggagacaatgttgggttcaacgtcaagaacgttgcagtcaaggatctcaagcgtgggtttgttgcatccaactcgaaggacgaccctgctaaggaagctgccaacttcacatcccaggtcatcatcatgaaccaccctggacagattggaaacggttatgcaccagtgctggactgtcacacatcccacattgctgtcaagtttagggaaatcttgaccaagatcgacaggcgatcgggtaaggagattgagaaggagcccaagttcctcaagaatggtgatgccggtatggttaatatgattccgaccaagcctatggtggtggagaccttctcagagtaccctcctttgggtcgttttgctgttcgtgacatgcgtcagacagttgctgtcggtgtcatcaagagtgtggagaagaaggatccatcaggagccaaggtcaccaaggctgctgccaagaagggtgccaagtgaatggtgcaggttcttgaatcgaattttcgttcgagtgaattttatctttttaataaactttgtcatgaaaactccatttttagttttgtcgttttgttttgtcggctgtggttttgcttttgcctttcactcccttgtcttttgggttgtcaatcccagaattgggtgttggacaggcggtggcgggatctacagcatcgagtcagtattgttcgattttagtaatgttttattctgttgtgtgttttgaggtgctccggttttttactgggtggctcgagaattttgtgttgtttccttgcaagtgattagaattgaactatttgaccttagcttttaaatttaatgctttgttacttatgctgtttttccctttttctctattactacttggccacatattctcttcaaatttattcat

SEQ ID NO: 1020 - DNA, 1844 bp, Tropaeolum majus
gccaaatacactattaccatcgttggatctcttttgcataaatccaacggtcattaatgaaaccctaggtgcaagaaacttgacttcacccctatttaagtgcacagttttccacttacttcatatctcatactctcccacttcataccagctcatttattttgttgaatccgacgagagggcctccttcgctacttcgattatattaactttttagcactcagatatgggtaaagagaaagttcatatcaacattgtggtcattggccatgtcgactctgggaaatcaacaacgacaggtcacttgatctacaagcttggtggtattgacaagcgtgtgattgagagattcgagaaggaagctgctgagatgaacaaaagatcattcaagtatgcttgggtgttggacaagctcaaggctgaacgtgagcgtggtattaccatcgatattgccttgtggaagtttgagaccacaaaatactactgcactgtcattgatgctcctggacatcgtgactttatcaagaacatgatcactggtacctcacaagctgactgtgccgtccttattattgattctaccactggtggttttgaagctggtatttcaaaggatggacagacccgtgagcatgctttacttgcattcacccttggtgtgaagcaaatgatttgctgctgcaacaagatggatgccaccactcctaaatactcaaaagctaggtacgatgaaattattaaggaagtgtcttcctacctgaagaaggttggttacaaccctgataaaatcgcattcgttcccatctctggtttcgaaggtgataacatgattgagaggtctacaaaccttgattggtacaaaggccctactcttcttgaagctcttgatttaatctcagagcccaagaggccaacagacaagccacttcgtcttcctcttcaagatgtgtacaagattggtggtattggaactgtgccagtaggacgtgttgagacaggtgttctgaaacctggtatggttgtgacttttggccccactggattgaccactgaagtcaagtctgtcgaaatgcaccatgaatcactcccagaggctatgccgggtgacaatgtcggcttcaacgtcaagaatgttgctgtgaaggatctgaaacgtggttttgttgcatccaactcaaaggatgaccctgctaaggaagctgccaacttcacctctcaggtcatcatcatgaaccaccctggtcagattggaaacggttatgcacccgtccttgattgccacacttcccacatcgctgtcaagttcggcgagatcctgaccaaaatcgatagacgatccggaaaggagcttgagaaggagccaaagtttttgaagaacggagatgcagggttcgttaagatgcttccctcgaaacccatggttgtggagaccttctctgcatacccaccccttggtcgttttgctgttagggacatgagacagactgtggctgttggtgtcatcaagagtgttgagaagaaagatccatcaggtgctaaagtcaccaagtctgcagtcaagaaaaagtaaaaccaggctttactgccaggttatgcagttatatgagttatccatctatacttcgtttacctcgttgtttttctatattctgaaaatgttttaagtttattgtcaccttccaattctgaattggaattttgatatgtagtgtgtatagtcttggattctggttatgcctattttggttgtgtttcacatagtgactcctaaagctatgttttctgttcaaatgttttaatgtccttcacggttaatcctgttgctatctcttttttttcttttg

SEQ ID NO: 1021 - DNA, 1625 bp, Avena sativa
agcagccatggggaaggagaagattcacatcagcattgtggtcattggccatgtcgactctggcaagtcaacaaccactggccacctcatctacaagcttggaggcatcgacaagcgtgtgatcgagaggttcgagaaggaagctgctgagatgaacaagaggtccttcaagtacgcctgggtgctggacaagcttaaggccgagcgtgagaggggtatcaccatcgatattgccctctggaagtttgagaccaccaaatactcctgcactgtcattgatgctccgggacaccgtgatttcatcaagaacatgatcactgggacatcccaggctgattgtgccgtgcttatcattgactccaccactggtggttttgaggctggtatctccaaggatggccagacccgtgagcatgctctccttgctttcacccttggagtgaagcagatgatctgctgctgcaacaagatggatgccaccacccccaagtactccaagggccgctttgaagaaattgtcaaggaagttggctcctacttgaagaaggtgggctacaaccccgacaaggtcccgtttgtccccatctctggttttgagggtgacaacatgattgagaggtccagcaaccttgactggtacaagggcccaaccttgcttgaggcgcttgaccagatcaatgagcccaagaggccctcagacaagcccctccgccttccccttcaggatgtgtacaagattggtggcattggaactgtgccagtggggcgtgttgagaccggagtgatcaagcctggcatgcttgtcacgtttggcccaactgggctgaccactgaggtgaagtctgtggagatgcaccacgagtccatgctggaggctctgccaggtgacaacgtcggcttcaacgtgaagaacgtggctgtgaaggatatcaagcgtggatacgtcgcctccaacgccaaggacgaccctgccaaggaggctgccaacttcgttgcccaggtcatcatcatgaaccaccctggccagatcggcaatggctacgccccggtgctcgactgccacacgtcccacatcgctgtcaagttctctgagatccagaccaaggtcgacaggcgttccggtaaggagattgaggccttccccaagttcctcaagaacggcgacgctggcttcgtgaagatgattcccaccaagcccatggtggtggagaccttctcccagtaccctccccttggccgctttgctgtgcgtgacatgaggcagactgtcgccgttggtgtgatcaagagcgtggagaagaaggaccccactggcgccaaggtgaccaaggctgccgccaagaagaaatgagatggtgcccggtggttgtccactactacacgcgtagtggtggtgtatggcgatggtagtcgtgttagtgaatctgggaacttgcccgttctctggagtttggttatgtgcgtcgtccagccttcgtgctgcttatcattctatctttcggttatgttggtgaaacaatgtcctgctatgttacattattgttgctactctctatatatacgtcagaaatttcgagtcatattatttgttgctggtatgccgttattttttatcaaaaaaaaaa

SEQ ID NO: 1022 - DNA, 1651 bp, Capsicum annuum
tagttgatcaacatgggtaaagaaaaagttcacataaacattgtggttattggccatgtcgactctggaaagtcgaccaccactggtcacttgatctacaagctaggtggtatcgacaagcgtgtcattgagaggttcgagaaagaagctgctgagatgaacaagaggtcattcaagtatgcctgggtgcttgacaagctcaaggctgagcgcgagcgcggtatcaccattgatattgccttgtggaagtttgagacaaccaagtactactgtactgtgattgatgctcctggtcacagggattttatcaagaacatgattactggtacctctcaagctgactgtgctgtgctcattatcgactcaactactggcggttttgaagccggtatctctaaggatggacagactcgtgagcatgcgttgcttgctttcacccttggtgtcaggcaaatgatttgctgctgcaacaagatggatgcgaccactcccaagtactcaaaagctaggtacgatgaaatcgtgaaggaagtgtcttcctatctcaagaaggttggttacaaccctgacaagatcccctttgtccccatctctggttttgagggagataatatgatcgagcgatcaacaaacctagactggtacaagggtccaacgcttcttgaggctcttgaccagatcaatgagcctaagaggccctcggacaaacccctgcgtctcccacttcaggatgtctataagattggaggtattggaactgtccctgttggtcgcgttgaaactggtatcatcaagcctggtatggttgtgacttttggtcctactggtctgaccactgaagttaagtctgttgagatgcatcacgaagctcttcaggaggcacttcctggtgacaatgttggtttcaacgtcaagaatgttgcggttaaggatctgaaacgtggatatgttgcatccaactccaaggatgacccggctaagggggcttcgagcttcacttcccaggtcatcatcatgaaccatccaggacagattggaaatggatatgccccagtgctggactgtcacacctcccacattgctgtcaagtttgctgaaatcttgaccaaaattgacaggcgttctggtaaggaactcgagaaggagcctaagttcttgaagaacggtgattctggtatggttaagatgatccccaccaagcctatggtggtagagacattctccgattacccaccattgggacgttttgctgttagggacatgcgtcaaactgttgctgttggtgttatcaagagtgttgacaagaaggacccaactggtgcaaagatcaccaaggctgctgctaagaaggcaaaatgaactgtgcagttcaattctggagatacccaaactatctactataataaagtatgttatgcagacttgttttcctttactcttgttgttcttgttcagtctttaatgtggttgttaggtcctcgctttccgccttgtatgtcaggcatcttttcgcagaattgggtgctcgacaggcggtggcataagacatagtcgagttgtttggtctttcttttgaggtgccttggttatccaagatagctctagagttctgttacttgtgtttgttataataaaagtaaatcttaattgt

SEQ ID NO: 1023 - DNA, 1671 bp, Phalaenopsis aphrodite
aaaaaatctgagagaaagcagccaatcaatccagccgtcgttgttttcttcttaggaatctgcaatgggaaaagaaaaggttcacatcaacattgtggtcatcggccatgtcgactccgggaaatcgaccactacgggtcacctcatatacaaacttggtggtatcgataagcgtgtgatcgagcggtttgagaaggaagccgccgaaatgaacaaaagatcattcaaatatgcatgggtactcgacaagctcaaagcggagcgcgaacgtggtatcaccatcgatattgcactttggaaatttgaaaccacaaaatactactgcactgtcattgatgcgcccgggcatcgtgattttatcaagaacatgatcaccggaacctctcaggcagattgtgccgttctcattatcgactccacaactggaggctttgaagcaggtatttcgaaagacggccagactcgcgagcatgcccttctcgctttcactctcggtgttaaacagatgatctgttgctgcaacaagatggatgccactacacccaagtactcaaaggcaaggtacgacgagattgtgaaggaggtttcttcctacctcaagaaagttggctacaatcctgaaaagatcccatttgtgccaatctccggattcgaaggtgataacatgatagagagatcaagcaacctggactggtacaagggacccactctccttgaagccctcgacttgatccaagagccgaaacgccctacagataagccgcttcgtcttccccttcaagatgtctacaaaattggcggcattggaacggttccagtcggccgagttgagacgggtgtcctcaagcctggaatggtggtcacctttggacctactggactcaccactgaagtcaagtccgtcgagatgcaccacgaagcccttcaggaggctgtcccgggcgacaatgttgggttcaatgttaagaatgttgctgtcaaagacttgaaacgtggttttgtggcttctaattcaaaggaagatcctgccagggaagctgccaatttcacttctcaggtcatcatcatgaaccaccccggccagatcggcaatggttatgctccggtccttgactgccacacttcccacatcgccgtcaaatttgccgagatcttgaccaagatcgacaggcggtccggcaaggagctcgagaaggagccgaaatttctcaagaatggagatgccggtttcgtgaagatgattcccaccaagccaatggtggtcgagacgttctccgagtatccgccgctcggaagatttgcagtgagggacatgaggcagacggtggcggtcggcgttatcaagagcgtggagaagaaggatccgagtggagcaaaggtgaccaaatcggctgccaagaagaaatgaattgtgcattgctgtttgaataagaacgagcgggaatccatcgagttggtttctggtgtttggatgcagaactgggtgcttgacagacggtggcactgctctctacagttatctttttagttgttgtcttgtgttgtttgtttcccttgtgttcaaggctgtactgcttttctatggtcgtattatttatcgctgcttattatgattgtactgttgttgttgcatgagtttgaatttgatgttatttgagttctagcgttcta

SEQ ID NO: 1024 - DNA, 1875 bp, Pinus taeda
ccagtatatgttgataacaagggagaggaagtagtcctcttcatctagtgcgagtctctctgctttttctacgccgctgcgaagctgttctgtggtgcttctgattctccagactcaggcagtcgtttttgtaagagaatttagttcatcatgggaaaggagaaaacccatatcaacattgtggttattggccatgtcgactccggcaagtcaacaaccactgggcatttgatctacaagcttggaggaattgacaagcgtgtgattgaacgttttgagaaggaagctgctgagatgaacaagaggtcattcaagtatgcttgggttcttgacaagctcaaggctgaacgtgaacgtggtatcacaattgatattgcactctggaagtttgagacaactaaatactactgcactgtgattgatgcccctggccatcgtgattttatcaagaacatgattactggaacatctcaggctgactgtgcagttttgatcatcgactccaccactggaggttttgaagctggtatctccaaggacggtcagacaagagaacatgccctattggcgttcaccttgggagtgaggcaaatgatttgctgctgtaacaagatggatgccactactccgaagtactctaaggctcgttatgatgaaattgttaaggaagtatcttcttatttgaagagggttggatataacccggacaagattccttttgtgcccatctctggttttgagggtgacaatatgattgagcgttctaccaaccttgattggtacaagggtccaacactcttggaagctcttgacaacctttcagagcccaaacgtccttcagacaagcctctgaggttgcctcttcaggatgtttacaagattggtggtattgggactgtgcctgttggtcgtgtggaaactggagttattaaaccaggtatgattgttacctttggtcctactggtctgacaactgaagttaagtctgttgagatgcatcatgaagctcttctggaggcattgcctggtgacaatgtggggttcaacgttaagaatgttgctgttaaggatctcaagcgtggttatgtggcatctgattccaagaatgatccagcaaaggaagctgccaactttaccgcacaggttattattatgaatcatccaggacagattggaaatggttatgcccctgtgttggattgccacacttgccacattgctgtcaagtttgctgagattcagaccaaggttgacaggcgttccggcaaggagctggagaaggagcccaagttccttaagaatggagatgctggatttgttaagatgattccaaccaaacccatggttgtggaaacctttgctgagtatcctccattgggtcgttttgcagtcagggacatgcgtcagacagttgctgtaggagtcatcaaagctgttgaaaagaaggaaccaagtggtgcaaaggttaccaaggcagcagccaaaaagaagtgaatgtttcagcaaagtgattgggagtggaggattgcgtgctgcatttcgtgtgcttccatgcttatgcttcactattttccagatattatgttagtagagttagtttgccaaatgcagaattgggttcttgatcggcggtggcataagttacattgttttctagtaaatactttttaatggttacattagggtaaagttgatttaagatttcgtagttgcggggaaatcatcagtttgtctgcactgctaggaaatctatgcagttggattgagagaggatgggcattaataatttctattactggtttatttaatgtttgtattcccgtccgtacatgacatttttctccggattgagaagacttggaatttatattaaag

SEQ ID NO: 1025 - DNA, 1734 bp, Podocarpus macrophillus
cgcaagagggctctggtttctgtggtgcgaaagccggcgttggtgtggtttgtgcgattttgttttcagttctttgttctttaattcaccatgggaaaggaaaagacccatatcaacatcgtggtcattggacatgtcgactctggcaagtccaccaccactggccaccttatttataagcttggaggtatcgacaagcgtgtgattgagcgttttgagaaggaagccgctgagatgaacaaaaggtcattcaagtatgcctgggtgctcgacaaacttaaggccgagcgtgaacgtggtattaccattgatattgccctctggaagtttgagaccaccaagtactactgcactgttattgatgcacctggacatcgcgatttcatcaagaacatgattacaggaacatctcaggctgactgtgcagttctgattattgattccaccactggaggtttcgaagctggtatctcaaaggatggacagaccagagagcatgctcttctggccttcactttgggagttagacaaatgatctgttgttgtaacaagatggatgcgaccacccccaagtattccaaggcccgttatgatgaaattgtgaaggaagtgtcttcatacttgaaaaaggtgggttacaaccctgataaaattccctttgtgcccatctctggattcgaaggagataacatgattgagagatctactaatctcgattggtacaaaggtcccaccctccttgatgctctagacatgatcagtgagcccaagagaccttcggacaagcctctccgcctaccccttcaggacgtctacaagatcggtggtattggcaccgtccctgttggacgagttgaaaccggtgtcctgaagcccggtaccgtggtgacatttggccccactggattgacaactgaagtcaagtccgttgaaatgcaccacgaagccctggcggaggctttgcctggagacaacgttggcttcaatgtcaagaacgttgcagtcaaggatctgaagcgtgggtttgtggcctcagactccaaaaacgaccctgccaaggaggctgccaacttcaccgcgcaggtgatcatcatgaaccaccctggccagatcggtaatggttatgcccctgttctcgactgccacaccagccacattgccgttaagttttctgagatccttaccaaggttgacaggcgttctggtaaggaactggagaaggaacccaagttcctcaagaacggtgatgcagggtttgttaagatgattcccaccaagcccatggtggtggagactttcgcagagtatcctccactgggtcgttttgctgtgagggacatgcgtcagacggttgctgtgggtgtgattaagagcgtggagaagaaggagcctagtggtgctaaggtcaccaaggctgccgccaagaagaaatgaactgtgctgaagtctgcagaggaggtggggcatgggtgtgttggtgggtttcttcttcgctcctctgtaggcgatggggtggtgaggtgtttggcatctcgtcgtatgcaaacctgggttcttgacaggcggtggcagaataaaagttgttatagtgtttgttattgttaattgtatgggagagtctcaggatgtgtgaagcgttattccaaatacttgtttttgaactccaaatgttgcagaaacattttatagttgtgactttctaaattagtttagttaatctcaatatatatggcg

SEQ ID NO: 1026 - DNA, 1845 bp, Prunus persica
tgctggtgccgagggcatgttcgtaacacaaggagaaattgctctgttatataaacacgctgaaaccctattcgcttctcacgcctctgcatctgtgtgcctctttcaccctcactatcactctctcgtcgctagggttttagcacagcgatctctctccagcttttataatgggaaaagaaaagattcacattaacattgtggtcattggccatgtcgactctgggaagtctaccaccactggccatttgatctacaagcttggaggtattgacaagcgtgtgattgagaggttcgagaaggaggccgctgagatgaacaagagatcattcaagtatgcctgggtgcttgacaagctcaaggccgagcgtgagcgtggtattaccattgatattgccctctggaagtttgaaactaacaagtactactgcactgtcattgatgctcccggacatcgtgacttcattaagaacatgattactggaacttcccaggctgactgtgctgtcctcattattgactccaccactggaggttttgaagctggtatttccaaggacggtcagactcgtgagcatgctctcctagctttcacccttggtgttaagcaaatgatttgctgctgcaacaagatggatgctaccactccaaagtactcgaaggcaaggtacgatgaaattattaaggaagtctcatcctatttgaagaaggttggctacaacccagacaagatcccctttgttcccatctctgggtttgagggtgacaacatgattgagaggtctagcaaccttgactggtacaagggtcctacccttcttgaggcccttgacttgatcaatgagcccaagaggcccacagacaagcccctccgcctcccacttcaggatgtctacaagattggtggcattggtaccgtccctgtcggacgtgttgaaactggtatcatcaagcctggtatggttgtgacctttggcccttctgggctgacaactgaagttaagtctgtggagatgcaccacgaagctcttccggaggctcttccaggagacaatgttggcttcaacgtgaagaacgtcgcagtcaaggatctgaagcgtggtttcgttgcctcgaattctaaggatgatccagccagggaggcagccaacttcacttcccaagtaatcatcatgaaccaccccggccagattggaaatggctatgcccctgtgctggattgccacacctcccacattgcagtcaagttcaatgagattctaaccaagattgacagacgatccggcaaggagcttgagaaggagcccaagtttttgaagaatggtgatgctggatttgttaagatgattcctaccaagccaatggtggtggagaccttctccgagtatcccccacttggtcgtttcgctgtccgggacatgcgacagactgttgctgtgggagtgatcaagagtgtggagaagaaggatccaagtggagccaaggtgaccaaatctgcagcaaagaagaagtgaattgtgcgctttgagaagggttacaataaagcatggattgttgctactagtttttctggtaggtgcttaggtgtcgtctgtcttgttggttataatttcaagtctcctccgtcgtctcttggctgctgttcgcagaactgggtgctcgatcggcggtggcggggttataatccggtgtcgttttgctgttttgttttgtggttttaattcgtgtcagttgtggtgtgtttagaatttgttgctatactttgctcggatcttgttgcctttaaaaaaaaatataattagtattgactcataattgcgtcaaattttgagcggtttcattata

SEQ ID NO: 1027 - DNA, 1826 bp, Pseudotsuga menziesii
gtcctcttcatattgtgcgagtctctctgcctcctgcgtcgctgcgaagctgttactgggttccctgattctccagactctgccaggcgatttgttgaaggctttaagtcatcatgggaaaggagaaaacccatatcaacattgtggtcattggccatgtcgactctggcaagtcaactaccactggccatttgatctacaagcttggagggattgacaagcgtgtgattgaacgatttgagaaagaagccgctgagatgaacaagaggtcattcaagtatgcttgggttcttgacaagctcaaggctgaacgtgaacgtggtatcacaattgatattgcactgtggaagtttgagacaactaaatactactgcactgtgattgatgcccctggccatcgtgatttcatcaagaacatgattactggaacctctcaggctgattgtgcagtgttgattattgactcaacaactggaggttttgaggctggtatctccaaggatggtcagactagagaacatgctctactggcattcaccctgggagtgaagcaaatgatttgctgctgtaacaagatggatgccactacccccaagtactcaaaggctcgttatgatgaaattgtcaaagaagtatcttcttatttgaagagggttggatacaacccagacaagattccttttgtgcctatctctggttttgaaggtgacaacatgattgagcgctcgaccaaccttgattggtacaagggtccaactctcttggatgcccttgaccaggtttcagagcccaagcgaccttcagacaagcctctgaggttgcctcttcaggatgtttacaagattggtggtattggaactgtgcctgttggtcgtgtggaaactggtgtcatcaagccaggtaccattgttacctttggtcctaccgggctgacaactgaggttaagtccgttgagatgcatcatgaagctctgcaggaggcattgcctggtgacaatgtgggattcaacgtgaagaatgttgctgttaaggatctgaaacgtggttatgtggcatctgattccaagaatgatccagccaaggaagctgccaactttaccgctcaggttattattatgaatcatccaggacagattggaaatggttatgctcctgtattggattgccacacttgccacattgcggtcaagttttctgagatcatgaccaaggttgacaggcgttctggcaaggagctggagaaggaacccaagttccttaagaacggagatgctgggtttgtcaagatgattccaaccaaaccaatggttgtggaaacctttgccgagtatcctccattgggtcgttttgcagtgagggacatgcgtcagacggttgctgttggagtcattaaagctgttgaaaagaaggaccctactggtgcaaaggtcaccaaggcagctgctaagaagaagtgaatattgaatagaagtgattgggaatggaggagtttgtaccgcattacgcgtgcttgcatctttctctattttcctgatggtatgttagtagagttagtttatcaaatgcagaattgggtgcttgatcggcggtggcagagtttacattattttccagtaagtactctttagtagcttagggcaagttgattgagatttcgtattttcggggaaatcatcagtttgtctgcattgctaatatgcagttggagtgtgagggaggaaggatattaataatttctgttactctgttttttattttaaatcatgtattgccgtacatatggcatttttccagattgagaaaacttggaattaatattaaatcgc

SEQ ID NO: 1028 - DNA, 1625 bp, Pteridium aquilinum
ccgacagcgtctctcagtaattgtgtgcagccatgggtaaggaaaagactcacattaacattgtggtcattggacatgtcgactccggcaagtccaccaccactggccatttgatctacaaacttggtggcattgacaagcgtgtgattgaaaggtttgagaaagaggcagctgaaatgaacaagaggtcatttaagtatgcttgggtccttgacaagctcaaggctgagcgtgagcgtggtatcacaattgatattgccttgtggaagtttgagactaccaagtactactgcactgttattgatgcaccgggtcaccgtgacttcatcaagaacatgattactggaacatcgcaggctgattgtgctgttttgatcattgattcaaccactggtgggtttgaggctggaatttccaaggatggacagactcgtgagcatgctctacttgctttcacccttggggtgaggcagatgatctgctgctgtaacaagatggatgctaccactcccaaatactcgaaggcccgttatgaggagatcatgaaggaggtgtctggatacttgaagaaagtaggctacaaccctgacaagatcccctttgtgcctatctctggttttgagggtgataacatgattgagcgatcatccaatcttgactggtacaagggtcctactttgcttgatgctcttgacatgatttcagagcccaagaggccttcagacaagcctctccgtcttccccttcaggacgtttacaagattggtggtattggaactgtgcctgttggcagagtggaaactggtgttatcaagcctggcatggttgtgacatttgctcctactggcctgactactgaggtaaagtctgtggaaatgcaccatgaagcgcttctcgaagctctgcctggtgacaatgttggcttcaacgtgaagaatgtggcagtgaaggatctcaagcgtgggtttgtggcatcagactccaagaacgatcctgccagggaggctgccaacttcactgctcaggttattatcatgaatcaccctggccagattggaaatgggtatgcgcctgttctcgactgtcacacttcacacattgctgtgaagtttgcggagatcctcacgaagattgataggcgttctggtaaggagcttgagaaagagcccaagttcttgaagaatggggatgctggatttgtcaagatgattcccacaaagcccatgacggtggagacttttgctgactaccctcccctaggtcgttttgctgttcgtgacatgcgccagacagttgctgttggtgttatcaaggctgtggagaagaaggacccctccggggcaaaggtgaccaagtctgctgccaagaagaaatgaatgttgcagatttgtgctgcagcagtttctttctgcactggttgtcagtgtgttccggttgttaggatgcttgtggccagagttttgcaaacctgggttctagataggcggtggcatggtcattggatttggcctgcccagtttcaaattttgcagtgcttttaatgagtttgttttctgtcatgaaggagttttgtcagaggcaactgcaagaacggttggaatggtgttttaatctcttaatggtaa

SEQ ID NO: 1029 - DNA, 1642 bp, Pteridium aquilinum
cagtgtttctgctgctgcctttctgtggttgaaggagcccttcgcattttcacttcgcagccatgggaaaggagaagacacacatcaacatagtggtcattggccatgtcgactccggaaaatcaaccaccactggtcatcttatctacaagcttggtggtattgacaagcgtgtcattgagcgtttcgagaaggaagcagctgaaatgaacaagaggtctttcaagtatgcctgggtgttggataagctgaaggctgagcgtgagcgtggtatcaccattgatatcgctctctggaagtttgagacaaccaagtactattgcactgttattgatgctccgggccatcgtgatttcatcaagaacatgattaccggaacttctcaggctgattgtgctgtcctgattattgactccacaactggaggatttgaggctggtatttcgaaggatgggcaaactcgtgagcatgcgctgcttgcattcactcttggagtgaggcaaatgatttgctgctgtaacaagatggatgctactaccccaaagtactctaaagctcgttatgatgaaatcatgaaggaagtgtctgcttatctcaagaaggttgggtacaaccctgacaaaataccctttgttcccatctctggttttgagggggacaacatgattgaaaggtcttccaaccttgattggtacaagggcccaacactccttgatgctctggatatggtccaggagcccaagaggccctctgacaagcctctccgcctgcctctgcaagatgtctacaagattggtggtattggaactgtgccggttggtcgtgtggagactggtatcatcaagcctggtatggttgtcacctttgccccaactggactgaccactgaggttaagtctgtggagatgcatcatgaggctctccttgaggctcttcctggtgacaatgttggatttaatgtgaagaacgtggctgtcaaggatctcaagcgtgggtttgttgcctcggactccaagaatgatcctgccaaggaggcagctaacttcacctcccaggtcatcatcatgaaccaccctgggcagattggtaatggatacgcacctgtgctggattgtcacacttcccacattgctgtgaagtttgcagagatccttactaagattgacaggcgttctggcaaggagattgagaaagagccaaaatttttgaagaatggagatgctggtattattaagatgattcctaccaagcctatgacagtggaaacctttgctgaatatcctccacttggtcgctttgctgtgcgtgacatgaggcagacagtggctgtaggtgtcatcaaggcagtggaaaagaaggatcctactggagccaaggttactaaggctgctgcaaagaagaaatgaaccaaattgtgtgccagactgatggtggatgttgagtcaggctgcgtagttttattttgttttctgtgtaattggatattgcggatgatgttatctagagtgcttcaaaactgggttttggatagacggtggcatggtctcagcctgctgctgcctgtcatcggctagtagaattttgttttgtttatccaatggaactattttgataaagaaatggccacctgccatatttatga

SEQ ID NO: 1030 - DNA, 1603 bp, Salvia sclarea
ctactagaccttggctgtcactcaattttctcttcgtgcggctagggtttcagcagacgcgctttatctctctctagcatctctgtgtttgagttctagtaatccaccatgggtaaagagaagactcacatcaacattgtggtcattggccacgtcgactccggaaagtcgaccaccactggtcacctgatctacaaacttggtggtattgacaagcgtgtgatcgagaggttcgagaaagaggctgctgagatgaacaagaggtcattcaagtacgcgtgggtgctcgacaagctcaaggctgagcgtgaacgtggtattaccatcgatattgccctgtggaagtttgagaccaccaagtactactgcacggtcatcgatgctcccggacatcgtgatttcatcaagaacatgattacgggtacctcacaggctgactgtgccgtcctcatcatcgactccaccactggtggttttgaggccggtatttccaaggatggacagacccgtgagcatgcgttgcttgctttcactcttggagtgaagcaaatgatttgctgctgtaacaagatggatgccaccacacctaaatactccaaggctaggtacgatgaaatcatcaaggaagttgcatcctacctcaagaaggtcggatacaaccccgacaaaatccccttcgtccccatttctggttttgagggagacaacatgattgagaggtccaccaaccttgactggtacaagggcccaacccttcttgaggcactcgaccagatcttggagcccaagaggccatcagacaagcccctccgtctcccacttcaggacgtgtacaagatcggtggtattggtaccgtgcccgtgggacgtgttgagaccggtatgatcaagcccggtatggtcgtcacctttgccccatctggtctgacaactgaagtcaagtccgtcgagatgcaccacgaagcccttcaagaggctctccccggtgacaacgtcgggttcaacgtgaagaacgttgcagtgaaggatctcaagcgtggttacgtcgcctccaactccaaggacgaccccgccaaggaagccgccaacttcacctcccaggtcatcatcatgaaccacccgggacagattggaaacggatacgccccggtgctggattgccacacctcccacattgcagtgaagttcgccgagatcctgaccaagatcgacaggcgatctggtaaggagctcgagaaggagcccaagttcttgaagaacggtgacgccggtatgattaagatgattccgaccaagcccatggtggtcgagaccttctccgagtaccctcctctcggacgtttcgccgtgcgtgacatgaggcagaccgtcgctgtcggtgtcatcaagagtgttgagaagaaggacccatctggtgccaaggttaccaaggctgctgccaagaagggagtcaagtgaatgttggaaattgtttcatcctcgattttggttacttcgcttaggtttgaaattttgcaattttccggaccttattttcgtttgttcgctgaaaaaaactcctttggccacgtcttctagcctcatttacgaggatagtggatta

SEQ ID NO: 1031 - DNA, 1942 bp, Sequoia sempervirens
gttagaggcaaagagcagtatatcttgctttgtagcgattagaaggccctctttaagcgagcaatttttattcttcatttgcttctgccgacgcttccagcaaattcttcatcgatctgccgggcgcttctgaatcaagtttttgagtacaagaagccatgggaaaagaaaagactcacatcaacattgtggtcattggccatgtcgactctggaaagtcaactaccactgggcatctgatttataagttgggtggcattgacaagcgtgttattgaacgttttgagaaggaagctgctgagatgaacaagaggtcattcaagtatgcttgggtgcttgacaagctcaaggctgagcgtgaacgtggtattactattgatattgcactatggaagtttgagaccactaggtactactgcactgtgattgatgctcctggccatcgtgatttcattaagaacatgattactgggacttcccaggctgattgtgcagtgttgattattgattcaaccactggaggttttgaggccggtatttccaaggatggacagacccgagaacatgctttgctggcattcaccctgggagtgaagcaaatgatttgctgctgtaacaagatggatgctactactcccaaatactctaaggctcgttatgaggaaattgtaaaggaagtatcctcttacctgaaaaaggttggatacaaccctgataaaattccgtttgttccaatctctggatttgagggagataacatgattgagagatcaaccaaccttgattggtacaagggcccaacactgttggacgcccttgaccaggtgtcagagcctaaacgtccttcagacaagcctcttaggttgccacttcaggacgtttacaagattggtgggattggaactgtgcctgtaggacgtgttgagactggagtgctgaagccaggcacaattgtcacatttggtccaactgggctgaccactgaagttaagtctgttgaaatgcatcatgaagctctgcaggaggcattacctggtgataacgtgggattcaatgtaaagaatgttgccgtgaaggatctcaagagaggatatgtggcctctgactccaagaatgacccagccaaggaagctgctaactttacatcgcaggtcattatcatgaatcacccaggccaaattggcaatgggtatgccccagtgctggattgtcacacatgccacattgctgtgaagtttgctgagatcttgaccaaggttgacagacgatctggcaaagagcttgagaaggaaccaaagttcattaaaaatggtgatgctggattcgttaagatgattccaaccaagcctatggttgtggaaactttctctgaataccctccactgggtcgttttgctgtgagggacatgcgtcagactgttgctgttggtgtcattaaggctgttgagaagaaggatccaactggtgccaaggtcaccaaggctgctgctaagaagaagtgaaagtctaagcaaactgtgcaagagcttatgcatgtgggaagtattccgttagctggcatgttgggtttctgcacatatggtatggtaataggtgtcttattagcttgtcatatgcaaaactgggttcttgatagacggtggcatagttcatttatttactgcttttcattttagtgtttggagatatacttttgatttctcagttgcggggaaatttttgatttgtctgcactgcaaggaaatctatgcagtctgagcagaggggagggatttaaataattttaattatgttatacagtgatctagtatttttgatatttcagatttaattgaatgcatgtataagatttttggaaaatatcagtgagttgaatcttcgttgacatcttgtctaacattgggggattgatgttgtattgtagtctgttgagcatctatca

SEQ ID NO: 1032 - DNA, 1596 bp, Selaginella moellendorffii
gaaaccctcttgaggcggctagggttcctcggcccttctttcgtcttctgcgcaggtagcagctatgggtaaggagaaggctcacatcaacatcgtggtcattggacatgtcgactccggcaagtccactaccacggggcatctcatctacaagctgggaggaatcgacaagcgaacgatcgagaggttcgagaaggaggcggccgagatgaacaagcggtcgttcaagtacgcgtgggtgctggacaagctcaaggccgagcgcgagcgtggaatcacaatcgatattgcgttgtggaagttcgagaccaacaggtactactgcaccgtcatcgacgctcccggtcaccgcgatttcatcaagaacatgatcacgggaacttcccaggctgactgcgctgttctcattatcgattccaccactggaggtttcgaggctggtatctccaaagatggtcagacccgtgagcacgctcttctcgcttttactcttggagtgaagcagatgatctgctgctgtaacaagatggacgctaccaccccgaagtactccaaggcgaggtacgaagaaatcgtcaaggaggtgtcgtcctacctcaagaaggtcggctacaaccctgacaagatccccttcgttcccatttccggtttcgagggtgacaacatgatcgagaggtcgaccaacctcgaatggtacaagggcccgactcttctcgaggctttggaccaggtgaccgaacccaagaggccatcggacaagcccctccgcctcccactccaggacgtttacaagatcggaggaattggaaccgttcccgtgggacgagtggagaccggagtcctcaagcccggtatggtggtgactttcggcccaaccggtctgacgactgaggtgaagtccgtggagatgcaccacgagtcccttgtggaggcactccccggtgacaacgtcgggttcaacgtgaagaacgtcgcggtgaaggatctcaagcgtggtttcgtggcttctgactcgaagaacgacccggccaaggaggctgccagcttcacttcccaggtgatcatcatgaaccacccgggacagattggaaacggctacaccccggtgctcgactgccacacctctcacatcgccgtcaagttcgccgagatcctgaccaaggtggacaggcgatccggaaaggagctggagaaggagcccaagttcctgaagaacggtgacgctgggttcgtgaagatgctgccgaccaagcccatggttgtggagacgttcgcggagtatcctccattgggacgctttgcggtgcgtgacatgaggcagacggtggcggttggagtgatcaaggccgtggagaagaaggaacccaccggtgccaaggttaccaaggcggcggccaagaagaaatgactagttctttggagctggagagataagtttgttgctgttgtggttttggattgcaggatgcagtatgctcgtcgccttcagttctgggttttggacagaaggtggcgagcttaactgtgaactctttttttactatagtaagaactgttttaactttcatttaattgtggctctaagacaaatttatt

SEQ ID NO: 1033 - DNA, 1665 bp, Picea glauca
gctctttcgtttgctctctgtaactgcgagagagctccttattttttagattccctaaacttcctttcttcaagtttctctcccaaagttcatcatgggcaaggagaaggttcacattaacattgtggttattggtcatgttgactctggcaagtcaaccactactggtcatttgatctacaagcttggaggtattgacaagcgtgtgattgagaggtttgagaaggaagctgctgagatgaacaaaaggtcattcaagtatgcctgggttttggacaagcttaaggctgagcgtgagcgtggtatcacaattgacattgctctctggaagtttgagacaactaggtactactgcactgtcattgatgcccctggtcatcgtgactttatcaagaatatgatcactggtacctcacaggctgactgtgctgtcctaattattgattccaccactggtggttttgaagctggtatctccaaggatggccagacccgtgaacatgccttgcttgccttcacccttggtgtgaagcagatgatttgctgttgcaacaagatggatgccaccacccccaagtactccaagtctcggttcgatgaaatcgtgaaggaagtttcttcctacctgaagaaggttggttacaaccctgacaagatcccatttgtccctatatctggttttgagggtgataacatgatcgagaggtccaccaaccttgactggtacaagggccccaccctccttgatgctcttgaccagatcagtgagcccaagagacccacagacaagcctcttcgtcttccacttcaggatgtctacaagattgttggtattggaactgtacctgtgggacgtgttgagactggtgtcctgaagcctggtatggtcgtgaccttcggccccactggactgaccactgaagttaaatctgttgagatgcaccatgaagctcttcaggaggcccttccaggtgacaatgttggtttcaatgttaagaatgttgctgtcaaggatctcaaacgtggttttgttgcttccaactctaaggatgatcctgccaaggaggctgccaacttcacctctcaggtcatcatcatgaaccaccctggtcaaattgggaatggatatgcccctgtccttgactgtcacacctgccacattgctgtcaagtttgctgagattttgaccaagattgacaggcgatctggcaaagagctcgagaaggagcccaagttcttgaagaatggtgatgctgggtttgtgaagatgattcccaccaagcctatggttgttgagaccttttctgcctatcctcctcttggtcgttttgcagtgagggacatgcgtcagaccgtggcggttggtgtcattaagagtgttgagaagaaggatccatctggtgccaaggtcaccaagtctgcagtaaagaaaaagtgaagtgtttgcttagttacagtttagactagtttatgtctgcttttctgcctgtttgattttatcttctcttctcttcaagttttgagaacagtttacaatttatctttacagtttatgcgtgttttggaattttacaagccgagcttgttatgttttttggttatttgagacttcgtgaatttaagttctctggtatccagttatctttaagaaaaaaaaaaaaaaaa

SEQ ID NO: 1034 - DNA, 1857 bp, Tabernaemontana elegans
ctctttcagtctaagagcgcagcctctcgttttcccagctcagaagctttcatccatccaccatgggtaaggaaaagattcacattaacatcgtggttattggccatgtcgactctggcaagtcaacgaccactggtcacttgatctacaagcttggtggtattgacaagcgtgtgattgagaggtttgagaaggaggctgctgagatgaacaagaggtcattcaagtatgcctgggtgcttgacaaactcaaggctgagcgcgagcgtggtattaccattgatattgccttgtggaagtttgagaccaccaagtactactgcactgtcattgatgcccctggacatcgtgactttattaagaacatgattactggtacctcacaggctgactgtgctgttctcatcattgactccaccactggtggttttgaggctggtatctccaaggatggtcagacccgtgagcatgcgttgcttgctttcacccttggtgtcaggcaaatgatctgctgctgtaacaagatggatgccaccaccccgaagtactccaaggctaggtatgatgaaattgtcaaggaagtgtcatcatacctcaagaaggtcggatacaaccctgaaaaaatcccctttgtccccatctctggttttgagggagataacatgattgaaaggtctaccaaccttgactggtacaagggcccaaccctccttgaggctcttgacatgatccaggagccaaagaggccctctgacaagccactccgtctccctcttcaggacgtctacaagattggtggtattggaactgtccccgtgggtcgtgttgaaactggtatcctgaagcccggcatggttgtaacttttggcccaactggcctgacaactgaagtcaagtctgttgagatgcaccacgaggcccttcaggaggctcttccaggtgacaatgttgggttcaacgtgaagaatgttgctgttaaggatctcaagcgtggttttgttgcatccaactccaaggatgacccagccaaggaggcttccagcttcacctcacaggtcatcatcatgaaccaccctggccagattggaaatggatatgccccggtgctggactgccacacctctcacattgcagtcaagtttgctgagctcttgaccaagattgatagacgatctggtaaggagcttgagaaggagcccaagttcttgaagaacggtgattctggtatggttaagatgattcctaccaagccaatggttgtggagaccttctctgagtacccacctcttggtcgttttgctgtgagggacatgcgtcaaactgttgctgttggtgtgatcaagagtgtcgaaaagaaggatcctactggtgccaaggtcaccaaggctgctgcaaagaagggtgccaaatgaaccgtgctggttcgtgctggaattacttctgatgaagtatactattataataaagctcgtcatgataattgcctccttttgagaactgctatcgttgtttggtctttatcctatctgtggtgtcgtaggtttctgccctgtaagttcagtatcctttctcaaaattgggtacttgatcggcggtggcagatcctacaataatagtctttgtgatgtcatgttatgttttgagtcctgtgcattgaggtgctttggtatttcctggcggctcaagagttttgttgtgtgatgttatgaggattctatataattgttgaactaatttcgccaattgcccttgcatctgtttctcctgcatttttttttaattgtgcttccttggagttggatcatgatccgtcctgatttacaactaaggaatcaaggcctgctttttttcctcctt

SEQ ID NO: 1035 - DNA, 1651 bp, Trigonella foenum-graecum
tgtgcttttaatccaaatgggtaaggaaaaggttcacatcaacatcgttgtcattggccatgtcgactctggcaagtcaactaccaccggccacttgatctataagcttggaggtattgacaagcgtgtcattgagaggtttgagaaagaagctgctgagatgaacaagcgttcattcaagtatgcctgggtcctcgacaagctcaaggctgaacgtgaaagaggtatcaccattgacattgctctctggaagtttgagacaaccaaatactactgcactgtcattgatgcccctggacatcgggatttcatcaagaacatgatcacgggaacttcgcaagctgattgtgccgttctcatcattgattccactactggtggttttgaagccggtatttccaaggatggtcagacccgtgaacatgctctccttgctttcactcttggtgtcaagcaaatgatatgttgctgcaacaagatggatgccaccacacccaagtacgccaagggtaggtacgacgaaattgtgaaggaagtttcatcctatttgaagaaggttggctataaccctgacaaaattccatttgttccaatctctggttttgagggagataacatgatcgagcgctcgacaaaccttgactggtacaagggtccaacccttcttgaggcccttgaccaaatcaacgagcctaagaggccatcagacaagcccctccgactaccattgcaggatgtctacaagattggaggaattggaactgtgcccgtgggacgtgttgagaccggtgtcttgaaacccggaatggtggtcacttttgcaccaactggactgacaaccgaagtcaagtctgtggagatgcaccatgaagctctcacggaggcccttcccggtgacaatgtgggatttaatgttaagaatgttgctgttaaggatctcaagcgtggttatgttgcctcaaactccaaggatgacccagccaaagaggccgctaactttacatctcaggtcatcatcatgaatcaccctggccagattggaaatggctatgcccctgttcttgactgccacacctcccacattgctgtcaaatttgctgagcttgtcaccaagattgacaggcgttccggaaaggagattgagaaggagcccaaattcctgaagaatggtgatgctggtattatcaagatgattcccaccaagcccatggtggttgagactttctctgaatatcctccactcggccgttttgctgtccgtgacatgcgtcaaactgtggctgttggagtcatcaaggctgtggagaagaaggaggctggtgcagcaggtaagatcaccaagtcagcattgaagaagaagtgaaccgtgcaggatgatctatctagcgaagtctattgtcattattacaataaatggtctttggtccatagtctttctatttctcgtttagttaaattgtttttcagattaagtgtcaagtctgcaccgtcgtctcgcagcttttgttctcagaactgggttctagatcgacggtggcagggctttttctttttcatgtttatgtttatgcttaagtgactgtgttatgtgagaactatttctattttgtaagcagctagactgctgatttggtttagtaatatcggctct

SEQ ID NO: 1036 - DNA, 1576 bp, Tripterygium wilfordii
gcggctagggtctttgcgaaagttttagccatgggtaaggagaagactcacatcaacattgtggtcattggccatgtcgactctggaaagtcgacgaccactggacacttgatttataagctcggtggcattgataagcgtgtcatcgagaggtttgagaaggaagctgctgagatgaacaaaagatcattcaagtatgcctgggtgttggacaaactcaaggcagagcgtgaacgtggtattaccattgatattgctctttggaagtttgagactacaaagtactactgcactgtcattgatgctcctggacatcgtgactttatcaagaatatgattactggtacctcacaggctgactgtgctgtcctcattattgactccaccactggtggatttgaagctggtatttccaaggatggccagacccgtgagcatgcattgcttgcttttacccttggtgtgaagcaaatgatttgttgctgcaacaagatggatgccacaacccccaaatactcaaaggctaggtatgatgaaattgtgaaggaagtttcttcctacttgaagaaggttggttacaaccctgacaagatcccatttgttcccatctctggttttgagggtgataacatgatcgagagatctaccaaccttgactggtacaagggcctaaccctccttgaggctcttgacatgatcaatgaacccaagaggccctcagacaagccccttcgtctccctcttcaggatgtttacaagattggtggtattggaactgttccagtcggtcgtgttgagactggtgtcctgaagcctggtacagttgtgacctttggtcctactggactgacaactgaagttaaatctgttgagatgcaccacgaggctctccaggaggccttgccaggtgacaatgttggtttcaatgtcaagaacgttgctgtgaaggatctgaagcgtggttttgtggcttctgactccaaaaatgaccctgccaagggggctgccagctttacctctcaggtcatcatcatgaaccaccctgggcagattggaaatggctatgctccagttcttgattgccacacatctcacattgctgttaagtttgctgagatcttgactaagattgacaggcgatctggtaaggagcttgagaaggaaccaaaatttttgaagaatggtgatgcaggaatggtgaagatgattccaaccaagcctatggtggtggagaccttctctgagtaccctcctcttggtcgtttcgctgtgagggacatgcgccagactgtggcagttggtgtcatcaagagtgttgataagaaggatgcatctggtgccaaggtgaccaagtctgctgctaagaagaagtgactcgtagaagttcatggtggatcatcgccttcagcttctgtctacttttatcaaaataattgtctttcattcgcattttatgtcggtactgtcatattttgtttttcatttggttttatatgttgtaattttgtgccgttgttgggttgccagtctgagaactgggtgcttgacaggcgatggcacagcttatagcatggag

SEQ ID NO: 1037 - DNA, 1633 bp, Valeriana officinalis
tttctctcgctcttaacagactcttattcatcgttaagcggcgagcgagcgagagccttcatttttctttcttcaagatcaaccagttagaatgggcaaagagaagtttcacattaacattgtggttattggccatgttgactctggaaagtcaaccacaactggacacttgatctacaagctaggtggcattgacaagcgtgtgattgagaggtttgagaaggaagcagctgagatgaacaagaggtccttcaagtatgcatgggttcttgacaagttgaaggctgagcgtgaacgtggtatcactattgatattgctctgtggaaatttgagaccaccaagtactattgcacagttattgatgctcctggacacagggatttcatcaagaacatgattactggaacttcgcaggctgattgtgctgttctcatcattgattccaccactggaggttttgaagctggtatttccaaggatggtcagactcgtgagcatgctcttcttgctttcactcttggtgtcaagcaaatgatttgctgctgtaacaagatggatgccacaaccccaaaatactctaaggcaaggtatgatgaaattgtgaaagaggtctcatcttacttgaaaaaagtgggatacaaccccgacaaaattgcgttcgttccaatctcaggatttgaaggtgacaacatgattgaaagatctaccaacctagactggtacaagggtcccacccttctggaagctctagacatgatctctgagcccaagagaccctctgacaaacctctcagacttccacttcaggatgtctacaagattggtggcattggaactgtaccagttggacgtgttgaaactggaaccatcaaacctggtatggttgtaacttttggtccaactgggctaaccactgaggtcaagtctgttgagatgcaccatgagtctctgctggaggctctgccaggtgacaatgttggattcaatgtaaagaatgttgctgtaaaggatttgaaacgtggttatgttgcttcaaattccaaagatgatccagctaagggtgctgccaacttcacatctcaggttatcatcatgaaccaccctggtcagattggtaatggttatgcgccggttcttgactgtcacacttctcacattgccgttaagtttgctgaaatcttgaccaagattgaccgtcggtctggtaaagaaattgagaaagagcccaagtttttgaagaatggtgatgctggtatggttaaaatgcttccaaccaaacctatggtggtcgagactttctctgagtaccccccgctaggaaggtttgctgtgagagacatgcgtcagactgtggctgttggtgttattaaggctgttgacaagaaggatccctccggtgctaaagtgaccaaggcggctgtcaagaagggtgccaagtgaaatgtgtttggatttttattagtttgctttttctattttgatattatcatgctgttttggttttcttggaaattttggttgtggaatcggaagattctcagcagatgctctagccttgcttgcaaggatagtggacggattgagcaaaacttggtgtaagctgctgtgttattgtggtttgagggtttttta

SEQ ID NO: 1038 - DNA, 1712 bp, Citrullus lanatus
cagttcttttacctaagattcaagcatgggtaaggagaaaattcacattaacattgtggtcattggtcatgtcgactctggcaagtcgaccactactggccatttgatttacaagcttggaggcattgacaagcgtgttattgagaggtttgagaaggaggctgctgagatgaacaagaggtcattcaagtatgcctgggtgttggacaagctcaaggccgagcgagagcgtggtatcacaattgacattgccctgtggaaatttgagaccaccaagtactattgcactgttattgatgctcctggccatcgtgatttcatcaagaacatgattactggtacttcccaggctgactgtgctgtccttatcattgactccactactggaggttttgaagctggtatttctaaggatgggcagacgcgtgaacacgcccttcttgcctttactcttggtgtcaagcaaatgatttgctgctgcaacaagatggatgccaccactcccaagtactcaaaatctaggtacgatgaaattgtgaaggaagtttcttcttacctcaagaaggttgggtacaacccagacaaaattcccttcgtcccgatctctggatttgagggtgacaacatgattgaaagatctacaaacctcgactggtacaagggaccaacccttcttgaggcccttgacctgatccaagagcctaagagaccatcagacaaaccccttcgtcttccacttcaggatgtctacaagattggtggtattggaactgttccagtgggtcgtgtggaaactggtattatcaagcccggtatggttgtcacctttgccccaactggactgactactgaagtaaagtctgttgagatgcaccatgaagctctccaagaagctctccctggtgataatgtggggttcaacgtgaagaatgttgctgtgaaggatctcaagcgtggttacgttgcctcaaattccaaggatgaccctgctaaggaagctgccaatttcacttcccaagttattatcatgaaccatccagggcagattggaaatggctatgctcctgtcctcgactgccacacctctcacattgcagtcaaatttgccgagattttaaccaagattgacaggcgatctggtaaagaactcgagaaagagcccaagttcttgaaaaacggagatgctggatttgttaagatgatccccaccaagcccatggtggtggaaacattctccgagtatcctccacttggacgatttgccgtgagggacatgcgtcaaactgtggctgttggtgtcatcaaggccgtcgagaagaaggacccatccggcgctaaagtcaccaagtctgcagctaagaaatcagggaagtgaatggtacgagtagccgttggcagtagtgaaggcaaacggcttgatgttagtcacaatgatgactgggttgttgttgaattaatatctgcttggggtttgttttgtgtctgtctcgttggtcacgtcttcaagtttcctccatcgtcgctgagcagcttctctcagaattgggtgcttgatcggcggtggcaagtcttccttttaaaaactttgaagattattgtatgttttatgcgtgttttattttaagctactttttattatggtattgactttcgtttctgtttctttcatgatggatcgtttttgtttgagtacattattaagcccctttgtg

SEQ ID NO: 1039 - DNA, 1721 bp, Citrullus lanatus
ccctccaatctagttttctttccccatctctcgccgcaagggtttaagagctcagctttatcctaagttcttttacctaagattcaagcatgggtaaggaaaaaattcacattaacattgtggtcattggtcatgtcgactctggcaagtcgaccactactggccatttgatttacaagcttggaggcattgacaagcgtgttattgagaggtttgagaaggaagctgctgagatgaacaagagatcattcaagtatgcctgggtgttggacaagctcaaggccgagcgtgagcgtggtattacaattgatattgctctgtggaagttcgagaccaccaagtactactgcactgttattgatgctcctggccatcgtgatttcatcaagaacatgattactggtacttcccaggctgactgcgctgttcttatcattgactccactactggaggttttgaagctggtatttctaaggatgggcagacccgtgaacacgcccttcttgcttttactcttggtgtcaagcaaatgatttgctgctgcaacaagatggatgctaccactcccaagtactcaaaatctaggtacgatgaaatcgtgaaggaagtttcttcttacctcaagaaggttgggtataacccagacaaaattcccttcgtcccgatctctggatttgagggtgacaacatgattgaaagatctacaaacctcgactggtacaagggaccaactcttcttgaggcccttgacctgatccaagagcctaagagaccatcagacaaaccccttcgtcttccacttcaggatgtctacaagattggaggtattggaactgttccagtgggtcgtgtggaaactggtattataaagcccggtatggttgtcacctttgccccaactggactgactactgaggttaagtctgtggagatgcaccatgaagctctccaagaagctctccctggtgacaatgtggggttcaacgtgaagaatgttgctgtgaaggatctcaagcgtggttacgttgcctcaaattccaaggacgaccctgctaaggaagctgccaatttcacttcccaagttattatcatgaaccatccagggcagattggaaatggctatgctcctgtcctcgactgccacacctctcacattgcagtcaaatttgccgagattttaaccaagattgacaggcgatctggaaaagaactcgagaaagagcccaagttcttgaaaaacggtgatgctggatttgttaagatgatccccaccaagcccatggtggtggaaacattctccgagtatcctccacttggacgatttgctgtgagggacatgcgtcaaactgtggctgttggcgtcatcaaggctgttgagaagaaggatccatccggtgccaaggtcacaaaatctgctgctaagaaatcgggcaagtgaatggtgcgaatagccgttggcggtagtagtgaaggccaacggcactggagtcttattaatgtgctgtgtggttggagtctgttttgtatgtgtctcgttggtcacgtcttcaagtttcctccatcgtcgctgagcagcttttcgcagaattgggtgcttgatcgacggtggcaggcttccttttttatccttgaacgtgtggtttatgcctgttttatttcaaactaccgagttttgtttttatttcttgcatattggatcgttttatttttcattacatta

SEQ ID NO: 1040 - DNA, 1756 bp, Amorphophallus konjac
accggtgttctttcgcagagaaggcttcttctcctaccccacgccgcctcttctcaagaatcttcaaaaaagcttccaatcgcacgtcagcatgggtaaggaaaaggtgcacatcaacattgtcgtcattggacatgtcgactccggcaagtctaccaccacaggccatcttatctacaagcttggtggtattgacaagcgtgtcattgagaggttcgagaaagaggctgctgagatgaacaaaaggtcattcaagtatgcctgggtccttgacaagctgaaggctgagcgtgagcgtggtatcactattgacattgctctctggaaatttgagaccaccaagtactactgtactgtcatcgatgctcctgggcatcgtgacttcatcaagaacatgatcacgggtacttctcaggccgactgtgccgtcctcatcattgactccaccaccggtggttttgaggccggtatctccaaggacggccagactcgggagcatgctttgcttgccttcacactcggagtcaagcagatgatttgctgttgcaacaagatggatgcaactacccccaagtactccaaggccaggtatgatgaaattgttaaggaagtctcatcctacctgaagaaggtgggatacaacccagacaagattcctttgttcccatctctgggtttgaaggtgacaacatgatcgagaggtccaccaacctcgactggtacaaggggcccactctactcgaagccttggacttcgatccacggagccaaacgcgccctacggacaagccccttcgccttccccttcaggatgtctacaagattggaggcatcgggactgtgcccgtgggccgtgttgaaactggagtcctcaagcctggtatggtcgtcacctttggcccgactggcctgaccactgaagtcaagtctgttgagatgcatcatgaagccctcccggaggccctccccggtgacaacgtgggcttcaacgtcaagaacgttgctgtgaaggatctgaagcgtggtttcgtggcatccaactccaaggatgaccccgctaaggaggccgcgaacttcacctcccaggtcatcatcatgaaccacccgggccagatcggcaatggctacgccccggtccttgactgccacacctcacacattgccgtcaagtttgcggagatcctgacaaagatcgataggcgttctggtaaggagctggagaaggagcccaagttcctgaagaatggcgatgctgggtttgtgaagatgatccccaccaagcccatggtggtggagactttctccgagtaccccccacttggtaggtttgccgtgagggacatgaggcagacggtcgcggtcggtgtcatcaaggccgtggagaagaaggatccaagcggcgccaaggtgaccaaggctgcccagaagaagaagtgaaccgaaaccgtattgctgctctctgcacctacggtggtggtggttgtttgagcctacttccattttatgtcgtcgtcgtcgtcgtcgcagtgtcaagtgtgctagttttgctttttgtgtgttgtccgtggatttcctgtccagcatttggatgcagaactgggttctagactggcggtggcaggggtaaaagaagagggctttgattgcttgcccctgcggcgttcagcccttacgctttggccaccacctcttctctttcattcgagtcatttttctgttgtgcttttattgttgatgcggtctgcagactttttac

SEQ ID NO: 1041 - DNA, 1487 bp, Secale cereale
ttgtggtcattggccatgttgactctggcaagtcgaccaccactggccatctgatctacaagcttggaggtatcgacaagcgtgtgatcgagaggtttgagaaggaagccgctgagatgaacaagaggtcgttcaagtacgcctgggtgcttgacaagctgaaggctgagcgtgagaggggtatcaccattgatattgccctgtggaagttcgagaccaccaagtactactgcaccgtcattgatgccctggtcaccgtgacttcatcaagaacatgattactggtacctccaggctgactgtgctgtgctcatcattgactcaccacttgggggttttgaggctggtatctcctaaggattggtcctagacccgttcgtagtcacgtcctcctttgctttcactcttggagtgaagcaaatgatctgctgctgcaacagatggatgccacactcccaagtactcgaaggcccgttatgaggaaattgtcaaggaagtctcttcctacctgaagaaggtcggctacaaccctgacaaggttcccttgtccccatctctgggtttgaggtgacaacatgattgagaggtccaccaaccttgactggtacaagggccctacccttcttgaggctcttgaccagatcaacgagcccaagaggccctcagacaagcccctccgtcttccccttcaggatgtttacaagattggtggcattggaactgtgcctgttggccgtgttgagactggtgtcatcaagcctggtatggttgtcacctttggtcccactggtctgacaactgaggtcaagtctgttgagatgcaccacgagtctctcctggaggcgcttcctggtgacaatgtttggcttcaacgtcaagaatgttgctgtgaaggatctgaagcgtgggtttgttgcatccaactccaaggatgaccctgccaaggcgcccgccaacttcacctcccaggtcatcatcatgaaccaccctggtcagatcggcaacggctacgccccagtgctggactgccacacctcccacattgctgtcaagtttgctgagctggtgaccaagatcgacaggcgatctggtaaggagctggaggcgctgcccaagttcctcaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggtgccaaggttaccaaggccgccatcaagaagaaatgagtgctctggtctctgccattgagttatctagcagtagttttagtgtctagtctttttggagtatcttagtgtatgttaagtggtgttcctgggcgttgttgcacttccgactcctgcacctgtgtgcgagctatgatgtgtcgtttaaatactctatttcgaacgca

SEQ ID NO: 1042 - DNA, 2022 bp, Cicer arietinum
ttttatttgaaattaggaattgaggcctttatataaaccctcgcaaacccttcattctgatcacagtacacacattctcttctcttctttgcggctaagtttaacgcagcattctctccttcaagtaatgggtaaagagaaagttcacatcaacattgtggtcattggccatgtcgactctgggaaatcaaccacaactggtcacttgatctacaagcttgggggtattgacaagcgtgtcattgagaggtttgagaaggaagctgctgagatgaacaagcgttcattcaagtatgcttgggttcttgacaagctcaaggctgagcgtgaaagaggtatcacaattgacattgctctttggaagtttgagacaactaagtactactgcactgtcattgatgcccccggacacagggatttcattaagaacatgattactggaacatcccaagctgattgtgctgtccttatcattgattccacaactggtggttttgaagctggtatttctaaggatggtcagacccgtgaacatgctctccttgctttcacccttggtgtcaagcaaatgatctgctgctgcaacaagatggatgctactacacccaagtactccaaggctaggtatgatgaaattgtgaaggaagtttcatcctatttgaagaaggttggttacaacccagaaaaaattccatttgttcccatctctggttttgagggagataacatgattgagcgctctacaaaccttgactggtacaagggtccaacccttcttgaggcccttgaccaaatcaatgagcctaagaggccatcagacaagcccctccgattaccacttcaagatgtctacaagattggaggaattggaactgtgcctgtgggacgtgttgagactggtgtcttgaaaccaggatttgtcgtgacttttgcaccaactggattggcaactgaagtcaagtctgttgagatgcatcacgaagctctgactgaggcccttcccggtgacaatgttggatttaatgttaagaatgttgctgtcaaggatctcaagcgtggttatgttgcatcaaactccaaggatgaccccgccaaggaggctgctaactttacatcccaagttatcatcatgaatcaccctgggcagattggaaacggttatgcccctgttcttgactgccacacctcccacattgctgtcaagtttgctgagcttattaccaagattgacaggcgttctggtaaggagattgagaaggagcctaaattcctgaagaatggtgatgctggtcttgtgaagatgattccaaccaaacccatggtggttgagacttttgctgagtatcctcctcttgggcgttttgctgttagagacatgcgtcaaactgtggctgtgggagtcatcaagagtgtggagaagaaggaaccaagtggaggaggtaagaaaactatctcagcagtgaagaagaaatgaattgtgcatgatcatctatatagggaaatctgttggtgtgactataataaatggtttgttctcagtggtaccttttctcatttagttactttgtttaagtcaccaccgtcgtctcgcagcttttgttcacagaactgggttctagaccgacggtggcatggctatttggtgtttatgtgagaacacttttatttgtgtttctttttatgcttggattgttgtgttcatgtgagaacacttctattttgtaagcaactggattgctggtttggttttgttatatcgagtttgtgtttatgtttttattttatggtttaagtttcaaagttattgctatttcatttatctatatggtaagttttcgcgggcacgatgcctgattgttaaagtatgcgcatatgtggtattaatctgataattatgtaacgattggattaggtcgtgggatggatttaattaccatcagtgtagttgagtctgtgctactatggagtagaaactttcatactaaatggacaaagtgaaaattaaaatcaaaggcttaaata

SEQ ID NO: 1043 - DNA, 1414 bp, Cicer arietinum
cacattctcttctcggctagttttaaggctccttcgagaaattttgtgattttaagctgtagcagtaatgggtaaagagaaagttcacatcaacattgtggtcattggccatgtcgactctgggaaatcaaccaccactggtcacttgatctacaagcttggaggtattgacaagcgtgtcattgagaggtttgagaaggaagctgctgagatgaacaagcgttcattcaagtatgcctgggttcttgacaagctcaaggctgagcgtgaaagaggtatcacaattgacattgctctttggaagtttgagacaactaagtactactgcactgtcattgatgcccccggacacagggatttcattaagaacatgattactggaacatcccaagctgattgtgctgtccttatcattgattccacaactggtggttttgaagctggtatttctaaggatggtcagacccgtgaacatgctctccttgctttcacccttggtgtcaagcaaatgatctgctgctgtaacaagatggatgctactacacccaagtactccaaggctaggtatgatgaaattgtgaaggaagtttcatcctatttgaagaaggttggctacaacccagaaaaaattccatttgttcccatctctggttttgagggagataacatgattgagcgctctacaaaccttgactggtacaagggtccaacccttcttgaggcccttgaccaaatcaatgagcctaagaggccatcagacaagcccctccgattaccacttcaagatgtctacaagattggaggaattggaactgtgcctgttggacgtgttgagactggtgtcttgaaaccaggatttgtcgtgacttttgcaccaactggattggcaactgaagtcaagtctgttgagatgcatcacgaagctctgactgaggcccttcccggtgacaatgttggatttaatgttaagaatgttgctgtcaaggatctcaagcgtggttatgttgcatcaaactccaaggatgaccccgccaaggaggctgctaactttacatcccaagttatcatcatgaatcaccctgggcagattggaaacggttatgcccctgttcttgactgccacacctcccacatcgccgtcaagtttgctgagcttattaccaagattgacaggcgttctggtaaggagattgagaaggagcctaaattcctgaagaatggtgatgctggtcttgtgaagatgattccaaccaagcccatggtggttgagacttttgctgagtatcctcctcttgggcgttttgctgtgagagacatgcgtcaaactgtggctgtgggagttatcaagagtgtggagaagaaggaaccaagtggtggaggtaagaaaactatctcagcagtgaagaagaaatga

SEQ ID NO: 1044 - DNA, 1600 bp, Olea europaea
tctctctgcagtcggcggcgagagatctgtctacactaccttcaaagtcttctttctaagagttcaacatgggaaaggaaaaggttcacattaacatcgtggttattggtcatgtcgactctggaaagtccaccaccactggccatttgatctacaagcttggtggtattgacaagcgtgtcattgaaaggtttgagaaggaggctgctgagatgaacaagaggtcattcaagtatgcctgggtgcttgacaagctcaaggctgagcgtgaacgtggtatcaccattgatattgccttgtggaaattcgagaccaccaagtattactgcacggttattgatgctccaggacatcgtgactttatcaaaaacatgattactggtacttcacaggctgactgcgccgtccttatcattgactctaccactggtggcttcgaagctggtatttccaaggatggtcagacccgtgagcatgctttacttgccttcacccttggtgtcaagcaaatgatttgctgctgcaacaagatggatgccaccacacctaaatactcaaagcccaggtatgatgaaattgtgaaggaagtgtcatcctacatcaagaaggttggatacaaccctgacaagatcccatttgttcccatctctggttttgagggtgacaacatgattgagaggtctaccaaccttgattggtacaagggcccaaccctcctcgaagctcttgaccagattctggagccaaagaggccctcagacaagcccctccgtctcccacttcaggacgtctacaagattggtggtattggaactgttcctgttggccgtgtggagactggtgttctcaagcctggtatggttgtcacctttggcccatctggtttgacaactgaggtcaagtccgttgagatgcaccatgaagcccttcaggaggctcttcctggtgacaatgttgggttcaacgtcaagaatgttgccgtcaaggatctcaagcgtggttacgttgcttccaactccaaggatgaccctgccaagggtgctgccagcttcacttcccaggtcatcatcatgaaccaccctggtcagatcggaaatggatatgccccagtgctcgactgccacacatcccacattgctgttaagtttgccgagctccagaccaagattgacaggcgttctggtaaggagctggagaaggagcccaagttcttgaagaatggtgatgctggtcttgttaagatgattcccaccaaacccatggttgtagagactttctccgaatacccacctcttggtcgttttgctgtcagagatatgcgccagacagttgctgttggtgtcatcaagaatgtggacaagaaggatccaagtggtgccaaggtcaccaaagctgcggctaagaagggtgccaagtgaagaaaatttcggtcagatgatatgctttttattaatcaaattagttattttcaaggcatcttttgcagttttgattattatggttcaaacagatgctctacttgttttgccatttcttgttttggttttattgcttgaagatgagttgtaggccaatgttcgaacagatattttattctgtt

SEQ ID NO: 1045 - DNA, 1995 bp, Prunus mume
ctgctctgtctcgctcatcacaccaaagtcggctagagagacctctgaatcttttttccacttcttctcctccgtttcttcagttatctttcggaaatcctgtaatgggtaaagagaagttccacatcaacattgtggtcattggccatgtcgactctggtaagtcgactaccactggtcacttgatctacaagcttggtggtatcgacaagcgtgttatcgagaggtttgagaaggaagctgctgagatgaacaagaggtcattcaagtatgcctgggtgctggacaagctcaaggctgagcgtgaacgtggtattacaattgatattgccttgtggaagtttgagaccaccaagtactactgcactgttattgatgctcctggacatcgtgactttatcaagaacatgattactggcacctcccaggctgactgtgccatcctcattattgactccaccactggtggttttgaagccggtatttccaaggatggtcagacccgagagcatgctttacttgcttttactcttggtgtgaggcagatgatttgctgctgtaacaagatggatgccaccactcccaagtactcaaaggcaaggtacgatgaaattgtgaaggaagtctcatcctatctcaagaaggtcgggtacaacccagaaaagatcccctttgtccccatttctgggttcgagggtgacaacatgattgagaggtccaccaaccttgactggtacaagggtcccacccttcttgaggcccttgacttgatcagtgagcccaagagaccatcagacaagccccttcgacttccacttcaggatgtgtacaagattggtggtattggtaccgtccctgttggacgagttgagactggtaccctgaagcctggtatggttgttacttttgcccccactgggctgactactgaagttaagtctgtggagatgcaccatgaatctctcgtagaggcccttccaggtgacaatgttggattcaacgtgaagaatgttgctgttaaggatctcaagcgtggttatgttgcttccaactccaaggatgatcctgcaaaggaagcagcaaactttacagctcaggtcatcatcatgaaccaccctggccagattggacaaggatatgctcctgttctcgactgtcacacctcccacattgctgttaaatttgctgagatgttgacaaagattgacagacgatctggtaaggaactggagaaggagcccaagttcttgaagaatggtgatgctggatttgtgaagatggttcccaccaagcccatggttgttgagaccttctctgagtaccccccacttggacgatttgctgtgagggacatgcgacagactgttgccgttggtgtcatcaagagtgttgagaagaaggatccaactggtgccaagatcactaaggccgctgctaagaagaagtgaaccggactggctcatcagatttccgcaggggaaatcttatataaatataataatagtagtaaaaacttacctattgtcactattactatggtttgttggtcatactgtttatatagtttttggtcatcattgttaggcattcagtcccagaattgggtgcttgacaggcggtggcgacgttatagcatacggagtccttgtccttcggttaaatatttttgtggttggttctgctactctggattttaatttaaaaaactatgttttattgtcgtaatgattctatatccctttggtatttcacatttcctctcatgtgctttgtcctgttgtggtgtatgaattttgatgcagcatgtttgttgatgccaaatctaaccgtatcctgcgatatcttactagagtgtatagtggatatgggttatttgtcttttcggccttcggaggcgttcttgttctttgtttattcacactggtttggttttgtcgtgggattggacttgtgctgtgttgccggacaaaaaggattagacttgtggagtctggt

SEQ ID NO: 1046 - DNA, 1492 bp, Prunus mume
ttttttcttctcttaattcatgaacagcttttataatgggaaaagaaaagattcacattaacattgtggtcattggccatgtcgactctgggaagtctaccaccactggccatttgatctacaagcttggaggtattgacaagcgtgtgattgagaggttcgagaaggaggcagctgagatgaacaagagatcattcaagtatgcctgggtgcttgacaagctcaaggctgagcgtgaacgtggtattaccattgatattgccctctggaagtttgaaactaacaagtactactgcactgtcattgatgctccaggacatcgtgacttcattaagaacatgattactggaacttcccaggctgactgtgctgtcctcattattgactccaccactggaggttttgaagctggtatttccaaggacggtcagactcgtgagcatgctctcctagctttcacccttggtgttaagcaaatgatttgctgctgcaacaaggtacagatggatgctaccactccaaagtactcgaaggcaaggtatgatgaaattattaaggaagtctcatcctatctgaagaaggttggctacaacccagacaagatcccctttgttcctatctctgggtttgagggtgacaacatgattgagaggtctaccaaccttgactggtacaagggtcctacccttcttgaggcccttgacttgatcaatgagcccaagaggccctcagacaagcccctccgcctcccacttcaggatgtctacaagattggtggcattggtaccgtccctgttggacgtgttgaaactggtatcatcaagcctggtatggttgtgacctttggcccttctggactgacaactgaagttaagtctgtggagatgcaccatgaagctcttacggaggctcttccaggagacaatgttggcttcaacgtgaagaatgtcgcagtcaaggatctcaagcgtggttttgttgcctcgaattctaaggaggatccagccagggaggcagccaacttcacttcccaagtaatcatcatgaaccaccccggccagattggaaatggctatgcccctgtgctggattgccacacctcccacattgcagtcaagttcaatgagattctaaccaagattgacagacgatccggcaaggagctcgagaaggagcccaagtttttgaagaatggtgatgctggatttgttaagatgattcctaccaagccaatggtggtggagaccttctccgagtatcccccacttggtcgtttcgctgtccgggacatgcgacagactgttgctgtgggagtgatcaagagtgtggagaagaaggatccaagtggagccaaggtgaccaaatctgcagcaaagaagaagtgaattgtgcgctttgagaaggattacaataaagcatgggttgttgctactagtttttctggtaggtgcttaggtgtcgtctgtcttgttggttataatttcaagtctcc

SEQ ID NO: 1047 - DNA, 1917 bp, Amborella trichopoda
taattttgcttatggtgcatcttttcatctgcagtgttatatcttgcgtattgaaagatgggtaaggagaaggttcacattaacattgtggtcattggccatgtcgactctggcaagtccacgaccaccgggcaccttatctacaagcttggaggtattgacaagcgtgtgattgagaggttcgagaaagaagctgctgagatgaacaagaggtcattcaagtatgcttgggttcttgacaagctcaaggctgagcgtgagcgtggtatcaccatcgacattgccctatggaaattcgagaccaccaagtactactgcactgtcattgatgcccccggccatcgtgacttcatcaagaacatgatcactggtacctctcaggctgattgtgctgttctcattattgactcaaccaccggtggtttcgaggctggtatttccaaggatggccagactcgtgagcatgctttacttgccttcaccctcggtgtgaagcagatgatttgctgctgtaacaagatggatgccaccacccccaagtactccaaggccaggtacgatgaaattatgaaggaggtttcgtcctacatcaagaaggtgggatacaaccccgacaagatcccatttgtgcccatatctggttttgagggagacaacatgatcgagaagtcaaccaatcttgactggtacaagggccccaccttgcttgaggccctcgacatgatcctagagcccaagaggcccttcgacaagccccttcgcctaccacttcaggatgtctacaagattggaggtattggaactgtccccgtgggccgagtggagactggtgtccttaagcctggtatggtggttacctttgctccctcggggctcaccactgaggtgaagtctgttgagatgcaccacgaggctttgcaagaggccttgcctggcgacaatgtggggttcaatgtgaagaatgtggccgtgaaggatctgaagcggggattcgtggcctccaactctaaggacgatcctgccaaggaggcagccaacttcacctcacaggtcatcatcatgaaccaccctggccaaatagccaatggttatgcccctgtgctcgactgccacacctgtcacattgccgtgaagtttgctgagatcctcaccaagattgacaggcgatctggcaaagaacttgagaaggagcccaagttcctcaagaacggtgatgctggtttcgttaagatgatccccacgaagcccatggtggtggagacctttgctgagtacccacccctgggtaggtttgcagtgagggacatgaggcaaacggtggcagtcggtgttatcaaggccgttgagaagaaggacccaagcggtgccaaggtcaccaaatctgcagccaagaagaagtaatgttttcttactctttacctttctctgaaaggtggacagaggagctggttaaaaaatgaccttttagattttgagatttcttttccgaggcctaaatatatattttgagtcagttttgtcatggattttgcttttagtttagatgaattggattgggtttgttggtagcttcagttttttttggagttttatatgattttgtatttggatgatgtcctctttgttcaccgatggtttatttaaggtttgaattttatatgcatggtaaaggtgcatgtgaattggttattttttccttgtgagaaatttggagagaattggtaggctagaattggcaatgtgttaggttccaattcgcctagctttaaattttattgttggagttgaaaataaattcaggccatcacaaagattttcaatactaaaacattgatacttcaaggttttaatatttggattgtttaggcctcaaccttatacaatccaccctttatatatattgccactcttttctaa

SEQ ID NO: 1048 - DNA, 1826 bp, Amorphophallus konjac
cggccgggggacgtccttcacggttgggtcttcgcgggttaaggcgcgtcccagagtgaagccaggtctcggctccttccgttcctctacggctgtttgaatattaagcaagaatgggaaaggaaaaggtccatattaacattgtggtcattggccacgttgactctgggaagtctaccaccactgggcatctaatatacaagcttggtggtattgataagcgtgtgattgaaaggtttgagaaggaagctgctgagatgaacaagagatctttcaagtatgcttgggtgctggacaagctaaaggctgagcgcgagcgtggtatcaccattgatattgctctctggaaattcgagaccaccaagtattactgcactgttattgatgcacccggacatcgtgacttcatcaaaaacatgatcaccgggacttctcaggcagattgtgctgttctcattattgattccactactggtggttttgaagctggaatttccaaggatggccagacccgtgaacatgcactgcttgctttcactttgggagtgaggcagatgatctgctgttgcaacaagatggatgcgacgaccccaaaatattcgaaggcaaggtacgatgaaattgtgaaggaggtttcgtcctaccttaagaaggtcgggtacaacccagataagattccttttgtcccgatatctggttttgagggtgacaacatgattgagaggtctaccaaccttgactggtacaaaggtcccacccttctggaagccctggacatgatccaggaaccaaaacgccccttggacaagcctcttcggcttcctctgcaggatgtctacaagattggaggcattggcactgtccctgttggtcgtgttgaaactggaattctcaagcctggtatggttgttacctttggccccactgggcttaccactgaagttaagtccgttgaaatgcatcatgaagctctcgtggaggcccttcctggtgataatgtgggttttaacgtcaagaatgtggcggttaaggatctgaagcgtggctttgttgcatccaattccaaggaagacccagccaagggggcagctagcttcatctcccaggtcattatcatgaaccacccaggccagattggcaatggttatgccccagtccttgattgccacacctctcatattgctgtgaaatttgctgaactgctgaccaagattgacagacgttctggtaaggaactggagaaggagcccaagtttctgaagaatggtgatgctgggttggtaaagatgattcccagtaaaccaatggttgtggaaacattctctgagtaccctccacttgggaggtttgccgtcagggacatgaggcagactgttgctgttggtgtcattaagagtgtggataagaaggatccaaccggtgcgaaggtgaccaagtctgcagcaaagaagaagtgaaccgaaacgatctctgtgcctgcggaggtcaagtttactagtagtatttgttatcatatcaagtatcttattttcagtcgtgtctctctctattcagttccgagtgtctgcatgcagaactgggttctagacaggcggtggcggaagtaatgtctgcttctgacatccggccgtggcttgatgcattgtttattttcaagttttattggaaggtggaacatagagacggttatatatcagtggtctcctattaatggttttggatattagattacagcataacgtgctgcataatgtgtttgcgtagttttgttttggtgcgtgagttgtttgtagcatcatttttctatggtcattggtgtattttgt

SEQ ID NO: 1049 - DNA, 1567 bp, Arnica chamissonis
agagaagccgtctccagatatctcgttcaggatgggtaaggaaaagattcatatcagtattgtcgtcattggacatgtcgactccggcaagtctacaacaactggacaccttatctacaagctaggtggtatagataaaagagttattgagagatttgagaaggaggcagctgaaatgaacaaaaggtcattcaagtacgcatgggttcttgacaagctaaaggctgagcgtgaaagaggtatcaccattgatattgcactgtggaagttcgagaccaccaagtactactgcacagtcattgatgctcctgggcatcgtgactttatcaagaacatgattactggtacctcccaagctgactgtgcagtgctgatcattgattccaccactggtggttttgaagctggtatttccaaggatggtcagacccgtgagcatgctcttcttgctttcactcttggtgtgaagcaaatgatttgctgttgtaacaagatggatgccaccacaccaaagtactccaaggcaaggtatgaagaaattgtcaaggaagtgtcatcatacctgaagaaggttggatacaaccctgacaaaatcccatttgtcccaatctctgggtttgaaggagacaacatgattgagaggtcaactaatcttgactggtacaagggaccaacccttcttgatgcacttgataatatcagtgagcccaagagaccatcagacaagccccttcgtcttccgcttcaagacgtgtacaagattggtggtattggaactgtgccagttggacgtgttgagactggtgtgatcaagcctggtatggttgttactttcggaccaactggattgaccactgaagttaagtctgttgagatgcaccatgaagccctaactgaagctcttcctggtgacaatgttggtttcaatgtgaagaatgttgctgtcaaggatctcaagcgtggttatgtagcatcgaactccaaggatgacccggctaagggcgcagcaagtttcacttcccaggttatcatcatgaaccaccctggtcagatcggtaatggttatgcaccggttcttgattgccacacctcccacatcgccgtcaagttttctgagatattgaccaaaattgacagacggtctggtaaggagattgagaaagagcctaaattcttgaagaatggagatgctgggatggtgaagatgcttcccactaaacctatggtggtcgagacctttgccgagtacccaccacttggtaggtttgctgtgagggacatgcgtcaaacggttgctgtgggtgtgatcaagagtgtggacaagaaggacccaactggagccaaggtgaccaaggctgcagtcaagaagggagccaagtgaggtggtttttcgttttggtgaatggagtattttatattctgcgtttcatttactagttttgaacttatattttgttgaagctttttcattcctgtgaaaggtttttggatttcagacttttgttgtggttaaatttatagttgtgtactgcagtgactttgtagttgatgggtgaacaaaactttt

SEQ ID NO: 1050 - DNA, 1551 bp, Arnica chamissonis
ctcgtctgccgatacttcgttaaggatgggtaaggaaaagatacatattagcattgttgtcattggacatgtcgactccggcaagtctacaacaaccgggcatcttatctacaagctaggcggcattgataaacgtgttatcgaaaggtttgaaaaagaagctgcggaaatgaacaaaagatccttcaagtacgcctgggtgcttgacaagctcaaggctgagcgtgaaagaggtatcactatcgatattgctttgtggaagtttgagacaaccaagtactactgcaccgtcattgatgctcctggacatcgtgacttcatcaagaacatgattactggtacctcccaggctgactgtgcagtacttatcattgattccactactggtggttttgaggctggtatttcaaaagacggtcagacccgtgagcacgctcttcttgctttcacccttggtgtcaagcaaatgatttgctgttgtaacaagatggatgccaccacaccgaagtactccaaggcaaggtacgaagaaattgtgaaggaagtttcatcttacttgaagaaggttggatacaacccagataaaatcccattcgtgccaatctctggttttgaaggagacaatatgattgagaggtcaacaaacctcgactggtacaagggtcctacccttctcgatgctcttgaccagatcagtgaacccaagagaccatcagacaagccacttcgtctcccacttcaggacgtgtacaagattggtggtattggaactgtgcctgtgggacgtgttgagaccggtgtgattaagcctggtatggttgtcacatttggaccgtctgggttgaccactgaagtcaagtctgttgagatgcaccatgaagccctaacagaggctctccctggtgacaatgtggggttcaatgtcaagaacgttgctgttaaggatctcaagcgtggatatgttgcatcaaactccaaggacgatcctgccaagggtgcagccagtttcacctctcaggttatcatcatgaaccacccgggccagattggaaatggttatgccccggttcttgattgccacacctcccacattgctgtcaagttttcagagattttgaccaagattgacagacgatctggtaaggagattgagaaggagcctaagttcttgaagaacggggatgcgggaatggtgaagatgcttccaaccaagcctatggttgttgaaacttttgctgagtacccacctcttggtcgttttgctgtgagggacatgcgtcaaacggttgcagtcggagttatcaagagtgttgacaagaaggacccaactggagccaaggtgaccaaggcggcagtgaagaagggagcaaaatgaggtggttggtgttttggtttatggagtattttatgttatgtgatttcatttactagttttgaactgagttttgttattcgacccttgaagctttcttgattgtgcaagttttatgggttgcagacttttgttgtgggttaaatttatagtggtctactttaatgagtttgtagttg

SEQ ID NO: 1051 - DNA, 1701 bp, Arnica chamissonis
tcggccagctacacaagcagattcatcatcaagtttgtttgatatctcagaatgggtaaggaaaagattcacatcagcattgtggttattggacatgtcgactctggaaagtcaaccacaaccggccatctgatctataagttgggcgggatcgataaaagagttattgagcggtttgagaaagaagctgctgaaatgaacaagaggtcattcaagtatgcttgggttcttgacaaactaaaagctgaacgagaacgtggaattactattgatattgctttgtggaaatttgagactaccaagtactattgtactgtaatcgatgcacctggacatcgtgatttcattaagaacatgattacaggtacatctcaggctgattgtgctgtcttgattattgactcaaccactggtgggtttgaagctggtatctccaaagatggtcagacccgtgaacatgctctgcttgctttcactcttggggtcaagcaaatgatctgctgctgtaacaagatggatgccaccacccctaagtactccaaggcaaggtatgaagaaatcgtgaaggaagtttcttcttacctgaagaaggttggctacaacccagacaaaatcccatttgtacccatctctggttttgagggtgacaacatgattgagaggtcaacaaaccttgactggtacaaggggccaactcttcttgatgctcttgaccagatcagtgagccaaaaagaccatcagacaaacctcttcgcctaccacttcaagatgtgtacaagattggaggtattggaactgtgcctgttggtcgtgttgaaaccggtgttatcaaacccggtatggttgtcacttttggtccatcgggattgaccactgaagtcaagtcagttgaaatgcaccatgaggccctaactgaagccctccccggtgacaatgttgggtttaatgtcaagaacgtcgcggttaaggatctgaaacgtgggtatgttgcatctaactccaaggatgacccggccaagggtgccgccagtttcacctcacaggtcatcatcatgaaccaccctggtcagattggaaacggttatgccccagttctggattgccacacttctcacattgctgtcaagttctctgagattttgaccaagattgaccgtcggtccggtaaagagattgaaaaagagcccaagtttttgaagaacggggacgctgggatggtgaagatgcttccaaccaagcccatggtagttgagacctttgcagagtacccaccacttggcagattcgcagttagagacatgaggcagaccgttgcagttggtgtgattaagagtgttgataagaaggacccgacaggagctaaggtgaccaaggctgcagtgaagaagggggtcaagtgaagctgctcgagtgtatcgttcttgaacgatggtcgtgttttaatcttgtttttgaactattttatttatgtttattttgggtcaaggagttttggtatttggtcctgtggcttgcattgctgtactctagcctcagttgtgaggatgggtggaggtattgagcaacttgttgcttgatgactgtggtgcaagtttttcaggagccaaattttggtcatattgtgctacaactttttgcttaagcttctcatcctggttcaacttttatgttttttgagatgttgtggtttttttataaca

SEQ ID NO: 1052 - DNA, 1774 bp, Arnica chamissonis
aaatcggccagctacacaagcagattcatcatcaagtttgtttgatatctcagaatgggtaaggaaaagattcacatcagcattgtggttattggacatgtcgactctggaaagtcaaccacaaccggccatctgatctataagttgggcgggatcgataaaagagttattgagcggtttgagaaagaagctgctgaaatgaacaagaggtcattcaagtatgcttgggttcttgacaaactaaaagctgaacgagaacgtggaattactattgatattgctttgtggaaatttgagactaccaagtactattgtactgtaatcgatgcacctggacatcgtgatttcattaagaacatgattacaggtacatctcaggctgattgtgctgtcttgattattgactcaaccactggtgggtttgaagctggtatctccaaagatggtcagacccgtgaacatgctctgcttgctttcactcttggggtcaagcaaatgatctgctgctgtaacaagatggatgccaccacccctaagtactccaaggcaaggtatgaagaaatcgttaaggaagtttcttcttacctgaagaaggttggctacaacccagacaaaatcccatttgtacccatctctggttttgagggtgacaacatgattgagaggtcaacaaacctcgactggtacaagggtccaactcttcttgatgctcttgaccagatcagtgagccaaaaagaccatcagacaaacctcttcgcctaccacttcaagatgtgtacaagattggaggtattggaaccgtgcctgttggtcgtgttgaaaccggtgttatcaaacccggtatggttgtcacctttggtccatcgggattgaccactgaagtcaagtcagttgaaatgcaccatgaggccctaactgaagccctccctggtgacaatgttgggtttaatgtcaagaacgtcgcggttaaggatctgaaacgtgggtatgttgcatctaactccaaggatgacccggccaagggtgctgccagtttcacctcacaggtcatcatcatgaaccaccctggtcagattggaaacggttatgccccagttctggattgccacacttctcacattgctgtcaagttctccgagattttgaccaagattgaccgtcggtccggtaaagagattgaaaaagagcccaagtttttgaagaacggggacgctgggatggtgaagatgcttccaaccaagcccatggtagttgagacctttgcagagtacccaccacttggcagattcgcagttagagacatgaggcagactgttgcagttggtgtgattaagagtgttgataagaaggacccgacaggagctaaggtgaccaaggctgcagtgaagaagggtgtcaagtgaagctgctcgagtgtatcgttcttgaacgatggtcgtgttttaatcttgtttttgaactattttatttatgtttattttgggtcaaggagttttggtatttggtcttgtggcttgcattgctgtactctagcctcggttgtgaggataggtggaggtattgagcaacttgttgcttgatgacggtggtgcaagttttccaggagccaaattttggtcttatcgtgctacaactttttacttgagcttctcatcgtggttcaacttttatgctttttgcgatgtggttttttttattacaaaaaaatggttggtaagttgatgattaagctaccattcctactaatcataagtaccgttcaataccttgcta

SEQ ID NO: 1053 - DNA, 1779 bp, Catharanthus roseus
atatcacggaagggctttcactataaatacactcctggcagagaagccttctccctcctcaaggtcttacagagttgcgcagcgcagaaacaatctctccttgaggctagagcttaaagcacttgcgagtttaattcttgaaatctgatatgggtaaggaaaaggttcacatcagcattgtggtcattggccatgtcgactctggcaagtccacaacaactggccatctcatctacaagcttggtggtattgacaagcgtgttattgagaggtttgagaaggaagcagctgagatgaacaagaggtcattcaagtatgcttgggtgcttgacaagctgaaagctgagagggagcgtggtattactattgatattgctctgtggaagtttgagaccaccaagtattactgcacagttattgatgctcctggacatcgtgactttattaagaacatgattacgggtacctcccaggctgactgtgctgtgcttatcattgactccactactggtggttttgaagctggtatttccaaagatggtcagacccgtgaacatgcccttcttgctttcactcttggagtcaagcaaatgatctgttgctgcaacaagatggatgctactactcccaagtactcaaaggcaaggtatgatgaaatagtgaaggaggtttcatcatacatgaagaaggttggatacaatcctgataagattccttttgttcctatctctgggtttgagggtgataacatgatcgagaggtccaccaaccttgactggtacaagggtccaactcttcttgaggctcttgacatgatcagtgagccaaagagaccatcagacaagcctctccgtctcccactacaggatgtgtacaagattggtggaattggtactgttccagtgggaagggttgagactggtatcctcaagccaggaatggttgtgacatttggacccagtggacttacaactgaagttaaatccgttgagatgcaccatgaggccctccaagaagctcttcctggggacaatgttggcttcaatgttaagaatgttgctgtgaaggatcttaagcgtggttttgttgcatccaactcaaaggatgatccagccaagggtgctgcaaacttcacatctcaggttatcatcatgaaccaccctggtcaaattgggaacggctatgcccctgttctcgactgccacacttcccacattgcagtcaagtttgcagagatcttgaccaagatcgacagacgatctggcaaagagctcgagaaggagccaaagtttttgaagaacggtgatgcaggatttgtcaagatgattcctactaaacccatggttgttgagaccttctctgagtatccaccactgggtaggtttgctgtcagggacatgcgccagactgttgccgtgggtgttatcaagagtgtggagaagaaggatccctctggagctaaagtcaccaaagctgctgcaaagaagacagggaagtgaatggagaagcttggaatatgcattaataattatatcaaacaacatttttatttgcttattataactcattttttgagtcctttaggttcgtttattttcatcaaacttttgttattgttgtccggttgccgctcccagaattgggtgttggaccgccggtggtagttcttatgttttcttacagtaaattatatatagtgttaattgttcggacaaaatttctggtttttatcttttcttcttgtgtctttattagttacatgaatctgctggcttcatt

SEQ ID NO: 1054 - DNA, 1682 bp, Cicer arietinum
ctcttctcggctagttttaaggctccttcgagaaattttgtgattttaagctgtagcagtaatgggtaaagagaaagttcacatcaacattgtggtcattggccatgtcgactctgggaaatcaaccaccactggtcacttgatctacaagcttggaggtattgacaagcgtgtcattgagaggtttgagaaggaagctgctgagatgaacaagcgttcattcaagtatgcctgggttcttgacaagctcaaggctgagcgtgaaagaggtatcacaattgacattgctctttggaagtttgagacaactaagtactactgcactgtcattgatgcccccggacacagggatttcattaagaacatgattactggaacatcccaagctgattgtgctgtccttatcattgattccacaactggtggttttgaagctggtatttctaaggatggtcagacccgtgaacatgctctccttgctttcacccttggtgtcaagcaaatgatctgctgctgtaacaagatggatgctactacacccaagtactccaaggctaggtatgatgaaattgtgaaggaagtttcatcctatttgaagaaggttggctacaacccagaaaaattccatttgttcccatctctggttttgagggagataacatgattgagcgctctacaaaccttgactggtacaagggtccaacccttcttgaggcccttgaccaaatcaatgagcctaagaggccatcagacaagcccctccgattaccacttcaagatgtctacaagattggaggaattggaactgtgcctgttggacgtgttgagactggtgtcttgaaaccaggatttgtcgtgacttttgcaccaactggattggcaactgaagtcaagtctgttgagatgcatcacgaagctctgactgaggcccttcccggtgacaatgttggatttaatgttaagaatgttgctgtcaaggatctcaagcgtggttatgttgcatcaaactccaaggatgaccccgccaaggaggctgctaactttacatcccaagttatcatcatgaatcaccctgggcagattggaaacggttatgcccctgttcttgactgccacacctcccacattgctgtcaagtttgctgagcttattaccaagattgacaggcgttctggtaaggagattgagaaggagcctaaattcctgaagaatggtgatgctggtcttgttaagatgattccaacaaagcccatggtggttgagacttttgctgagtatcctcctcttgggcgttttgctgtgagagacatgcgtcaaactgtggctgtgggagttatcaagagtgtggagaagaaggaaccaagtggtggaggtaagaaaactatctcagcagtgaagaagaaatgaattgtgcacgatcatctatatagggaaatctattggtgtgacatctgttggtgtgactatagtaaatggtttgttctcactagtactttttctcatttaattactttgtttaagtcaccaccgtcgtctcgcagcttttgttcccagaactgggttctagatcgacggtggcatggctatttggtgttttttttatgctttgattattgtgtttatgtgagaacaattctcttttgtaagcaactggattgctggtttttgttttggtatatcac

SEQ ID NO: 1055 - DNA, 1673 bp, Euonymus alatus
atttctctctgagtccttctagtaagtctgcgagagggactcagtcgatcgttcttctcgagttctacttgtcagctacagctagaattacataatgggtaaggagaagactcacatcaacattgtggtcattggccacgtcgactctggaaagtcgacaaccactggacacttgatttataagcttggtggcattgacaagcgtgttattgagagatttgagaaggaagctgctgagatgaacaagaggtcattcaagtatgcctgggtgttggacaaactcaaggctgagcgcgaacgtggtatcaccattgatattgctctgtggaagtttgagaccacaaagtactactgcactgtcattgatgctcctggtcatcgtgactttattaagaatatgatcactggtacctcacaggctgactgtgctgtcctcattattgactccaccactggtggttttgaagctggtatttccaaggatggccagacccgtgagcatgcattgcttgcttttacccttggtgtgaaacaaatgatctgttgctgcaacaagatggatgccacaacccccaaatactcgaaggctaggtatgaggaaattgtgaaggaagtttcttcctacttgaagaaggttggttacaaccctgacaagatcccatttgttcccatctctggttttgagggtgacaacatgattgagagatctaccaaccttgactggtacaagggaccaaccctccttgacgctcttgaccagatctcggaacccaagaggccctcagacaagcccctccgtctccctcttcaggatgtttacaagattggtggtattggaactgtcccagtcggacgtgttgagactggcgtcttgaagcctggtacggtggtgacctttggtcctactggactcacaactgaagttaaatctgttgagatgcaccacgaggctctccaggaggccctgccaggtgacaatgtgggtttcaatgtcaagaatgttgctgtgaaggatctgaagcgtggttttgttgcttctgactcgaaaaatgaccctgctaaggaggctgccagcttcacctctcaggtcatcatcatgaaccaccctgggcagattggaaatggctatgccccagtccttgattgccacacatcccacattgctgtgaagtttgctgagatcttgactaagattgacaggcgatctggtaaggagattgagaaggaaccaaaatttttgaagaatggtgatgcaggaatagtgaagatgattccaaccaagcctatggtggtggagaccttctctgcgtaccctcctcttggtcgttttgctgtaagggacatgcgccagactgtggctgtgggtgtcgtcaagagtgttgacaagaaagaagcatctgctgccaaggtcaccaagtctgctgctaagaagaagtgactcatgggaggtcactgtttgacatcttcagctgaagtctacttccatatgaataatcgtctttccgttgttactgtcatatttggttgtttatttcgttttatatggtacagttttgtgccgtctttgttgggttcctggtttgagaactgggtacttgacaggcggtggcacagcttatagcatgaaagttttattagtgtttttagagattgtattagtgttgattttctgt

SEQ ID NO: 1056 - DNA, 1739 bp, Lactuca sativa
aacccctgtatgctctctctgttctatattctctatttagtcttcctcttttcgccgttcttcaaatttctttgatcgaagaggaattctctgtttctcaaagctgttaaaccatgggtaaggaaaaggttcacatcaacatcgtcgtcatcggccatgttgactctggaaaatcaaccactaccggtcacctgatctacaagcttggtggaatcgacaagcgtgtgatcgagaggttcgagaaagaagccgctgagatgaacaaacgttcattcaaatacgcctgggtgctcgacaaactgaaagccgagcgtgaacgtggtatcaccattgatatcgctctctggaaattcgaaaccaacaagtactactgcacagtcatcgacgctcccggccatcgtgatttcatcaagaacatgattaccggaacttcccaagccgactgcgccgtcctcatcatcgactccaccaccggtggcttcgaagctggtatctccaaagatggtcaaacccgtgaacacgctctcctcgctttcactctcggtgtcaaacaaatgatctgttgctgcaacaaaatggacgccaccacccccaaatactcaaaagccagatacgatgaaatcatgaaggaagtctcaacctacctcaagaaagtcggttacaaccctgacaaaatcccattcgtcccaatctctggattcgaaggtgacaacatgattgaaaggtcaacaaatctcgattggtacaaaggccctactctccttgaagctcttgaccaaatcaacgagccaaaacgtcccacagacaaaccacttcgtctcccacttcaagacgtttacaaaatcggtggaattggaactgttccagtcgggcgggttgaaaccggtatcatcaaacccggaatggtcgtcacttttggcccaaccggtttaacaactgaagtgaagtccgttgaaatgcatcatgaagctttgttggaggctctaccaggtgacaatgttggattcaatgtgaagaatgttgctgtgaaggatatcaagcgtgggtatgttgcttcgaattctaaagatgatcctgctaaaggtgctgcgagttttacttctcaggtgattatcatgaaccacccgggtcagattggaaacgggtatgctccggtgttggattgccacacgtctcatattgctgtgaagtttgctgagattttgacaaagattgatagaaggtctgggaaggagattgagaaggagccgaagtttttgaagaatggtgatgctggaatggtgaagatgatgccgactaagcctatggttgtggagacgttttctgagtatccaccgttggggaggtttgctgtgagggatatgaggcagacggtggctgttggtgttatcaagagtgtggataagaaggatccgactggtgctaagatcaccaaggctgctgcgaagaagaaatgaattttggtggggaaggggaaggtttgtttttcgtattttaattttcgtttggtgtcgtgtgtcggtttgtgtgtttggttagcggtggtgatggtggtgttattgcggtttcgtgttcgtacttgggtgcttgataggcggtggcgtctttattttgtttgtttttgttgaagacaattttgattttggattggaatatgaatggctttttggtggtttatgcttttattattatcttttgcagttatatataaaacacatttaaaatggataactaaaaac

SEQ ID NO: 1057 - DNA, 1898 bp, Medicago truncatula
gtttactcttactccactctcattctcttccttgctgctagggttttagcgcatccttcaaagaactttttgtggttttaaacttttaaggacaatgggtaaggaaaaggttcacattaacattgttgtcattggccatgtcgactctgggaagtcaactaccactggtcacttgatctacaagcttggaggtattgacaagcgtgtgattgagaggtttgagaaagaagctgctgagatgaacaagcgttcattcaagtatgcttgggttcttgacaagctcaaggctgagcgtgaaagaggtatcacaattgacattgctctgtggaagtttgagaccactaagtactactgcactgtcattgatgcccctggacacagggatttcattaagaacatgattactggtacatcccaagctgattgtgctgttctcatcattgattccaccactggtggttttgaagctggtatttccaaggatggtcagactcgtgaacatgctctccttgctttcactcttggtgtgaggcaaatgatctgctgctgcaacaagatggacgccactactcccaagtactccaagagcaggtatgatgaaattgtgaaggaagtatcatcctacatgaagaaggttggctataacccagataaaattccatttgttcccatctctggttttgagggagataacatgattgagcgctctacaaatcttgactggtacaagggtccaacacttcttgaggctcttgatcaaatcaatgagcctaagaggccatcagacaagcccctccgactacctcttcaggatgtctacaagattggaggaattggaactgttcctgtgggacgtgttgagactggtaccatgaaacctggaatggtggtgacttttgctccaactggactgcaaactgaagtcaagtctgtggagatgcatcatgaatctctcactgaggcacttcccggtgacaatgtgggatttaatgttaagaatgtttctgtcaaggatctcaagcgtggttatgttgcctcaaacaccaaggatgacccagccaaggaggctgctaacttcacatctcaggtgattatcatgaatcaccctggccagattggaaatggttatgcccctgttcttgactgccacacctcccacattgcagtcaagtttgctgagcttgttactaagattgacaggcgttctggtaaggagatcgagaaggagcctaaattcctgaagaatggagatgctggtattattaagatgattcccaccaagcccatggtggttgagactttctctgaatatcctccacttggccgttttgctgtcagagatatgcggcaaactgtggctgttggggttatcaagggtgtggagaagaaggaacctggcacagctaagataactaagtcagcagccaagaagaaatgaaccgtgcaggatgattttccttgggaagtttatagtcgttattacaataaatggtttgtggttcttagtatttctatttcgtgtcttgttaagttgttttttggattaagtgtgaagtctgcaccgtcatctcccagcttttgttcccagaactgggttctagatcgacggtggcatgactagttatttttcttgtttctgctttaattgtcttgtcttgtgtgaacacctgaattttacaagcagcaagtttccggacctgctgtttgtttttaatatcaactctatatctgcgtgtttattccttggtgtgatgtttaatctttgctggggcaagtgtctgatgttttaggcaatttcattgcccagaatgtcaggagcatttttgaatcagcagcatctgaatattattgttctcttaattttacatttgctaagtaggaaaccccaaatttacagt

SEQ ID NO: 1058 - DNA, 1603 bp, Olea europaea
cagaaattaaaactctctctgcagtcggcgggtgagagatttctctatactaccttcaaagctttctttttagaagtaaaacatgggtaaggaaaagattcacattagcattgtggtcattggccacgttgactctggaaagtcaaccaccaccggccatttgatctacaagcttggtggtattgacaagcgtgttattgaaaggttcgagaaggaggctgctgagatgaacaagaggtcattcaagtatgcctgggtgctcgacaagctcaaggctgagcgtgaacgtggtattaccattgatattgccttgtggaaattcgagaccaccaaatattactgcacagttattgatgctccaggacatcgtgactttatcaagaacatgattactggtacttcacaggctgactgcgccgtccttatcattgactctaccactggtggttttgaagctggtatttccaaggatggtcagacccgtgaacatgctttgcttgccttcacccttggtgtcaagcagatgatttgctgctgcaacaagatggatgccactacgcctaaatactcgaagtctaggtatgatgaaattgtgaaggaagtggcatcctacatcaagaaggtcggatacaaccctgacaagatcccatttgtccccatctctggtttcgagggtgacaacatgattgagaggtccagcaaccttgattggtacaagggcccaaccctcctcgaagctcttgaccagattctggagcccaagagaccctcagacaagcctctccgtctcccacttcaggacgtctacaagattggtgggattggaactgtacctgtcggccgtgttgagactggtgttatcaagcctggtatggtcgtcacctttggcccatctggtttgacaactgaagtcaagtctgttgagatgcaccacgaggccctccaggaggctctccccggtgacaatgttgggttcaacgtcaagaatgttgcagtgaaggatctcaagcgtggttatgttgcctccaactccaaggatgaccctgccaagggtgctgccagtttcacttcccaggtcatcatcatgaaccaccctggtcaaattggaaacggttatgccccagtgctcgactgccacacatcccacattgctgttaagtttgctgagctccagaccaagatcgacaggcgttctggtaaggagctggagaaggagcccaagttcttgaagaacggtgatgctggtcttgttaagatgattcccaccaagcccatggttgtggagactttcgcagagtacccacctcttggacggtttgctgtgagggatatgcgccagacagttgctgttggtgtgatcaagagcgtggacaagaaggatccaaccggtgccaaggtcaccaaagctgctgctaagaagggtgccaagtgaagaaatttcatgttatcgattattcacattagctattttcaagacatcttttgcatttttgattattatggtttgtcctgatgctctatctggattgccatttcttgttttggtttattatgagttgtaagacctatttcaacatcttttaatttatgtttttcttaccgt

SEQ ID NO: 1059 - DNA, 1397 bp, Phalaenopsis aphrodite
gctcctagctctcgtcggcagagccgcgccttcgtctcctcttgctagtagttttctccagccatgggtaaggagaaggtacacatcaacattgtggtcattggccatgtcgattccggcaagtccaccaccactggccatctcatttacaagcttggcggtattgacaagcgtgtgattgagaggtttgagaaggaggctgccgaaatgaacaagaggtcattcaaatatgcttgggttctcgacaagctcaaggctgagcgtgaaagaggaatcaccattgatatcgctctctggaaattcgagaccaccaagtattactgcactgttattgatgctcctggccatcgtgacttcatcaaaaacatgattactggaacttctcaggctgactgcgctgtcctgatcattgattccaccactggtggttttgaagctggtatctccaaggatggccagactcgcgagcatgctttgcttgctttcactcttggggtgaagcagatgatttgctgttgcaacaagatggatgccaccacccccaagtactcaaaggctaggtatgatgaaatcgtcaaggaagtctcctcctatctaaagaaggttggctacaaccctgataagattccatttgttcccatctctggatttgagggtgacaacatgatagagagatccacaaaccttgactggtacaagggtccaactcttctcgaagccctcgacctgatccaagagcccaagaggccaacagacaagcccctccgcctcccccttcaggacgtctacaagatcggtggtattggcaccgtccccgtcggtcgagtcgagactggcgttttgaagcctggcatggtagtcacctttggtcccaccggcctctccactgaagtaaagtctgtggagatgcaccatgaagctcttcaagaggccctccccggcgacaatgtcggtttcaatgtgaagaatgttgcggtaaaagatctgaagcgaggtttcgttgcctcaaactccaaggatgatcctgccaaggaagcagctaacttcacttcccaggtcatcataatgaaccaccctggtcagattggcaacggctacgctcccgtgctggactgccacacctctcacattgccgtcaagtttgccgaaatcctgaccaagatcgacaggcggtctggcaaggagctcgagaaggagcccaagttcctgaagaatggcgacgcgggtttcgtgaagatggttcccactaagcctatggtggtcgagaccttctccgagtatcctccactgggccgtttcgccgtgagggacatgaggcaaactgtggctgttggagtcatcaagagcgttgagaagaaggatcccagtggagccaaggttaccaaaatctgctgcca

SEQ ID NO: 1060 - DNA, 1343 bp, Papaver somniferum
cagttaatttctaagaattcagtatgggtaaagagaaggttcacatcaacattgtcgtcattggacatgtcgactctggaaaatcgaccaccactggtcacttgatctacaagcttggaggtattgacaagcgtgttattgaaaggttcgagaaggaggctgctgagatgaacaagaggtcattcaagtacgcatgggttcttgacaagcttaaggctgaacgtgagcgtggtattaccattgatatcgccttgtggaagtttgagaccaccaagtactactgcacagttattgatgctcctggacatcgtgactttatcaaaaacatgattactggtacttctcaggctgattgtgccgtcctcattatcgattctaccactggaggttttgaggctggaatctcaaaggatggtcagactcgtgagcacgctcttcttgctttcactcttggtgtcaagcagatgatctgttgttgtaacaagatggatgccaccacccccaagtactcaaaggctaggtacgatgaaattgtaaaggaggtctcatcttacttgaagaaggttggatacaacccagacaaaattgcctttgttcccatctctggatttgagggagacaacatgattgagaggtccaccaaccttgactggtacaagggaccaactcttctcgaggctcttgacaatatctctgagccaaagagaccctcagacaagccccttcgtcttccccttcaggatgtttacaagattggaggtatcggaactgtgccagtgggacgtgttgaaactggattcatcaagcctggtatggttgttacctttggacccactgggttgaccactgaagttaagtctgtggagatgcaccacgaagcccttcaagaagctcttccaggagacaatgttgggttcaatgtcaagaatgttgcagtgaaggatctcaagcgtggtttcgtcgcctccaactccaaggacgaccctgccagggaagctgccaacttcacctcccaggtcatcatcatgaaccatcctggtcagatcggtaacggttatgctccagtcctcgactgtcacacatctcacattgctgttaagtttgctgagatcctcaccaagattgataggcgatctggaaaggagcttgagaaggagcccaagttcttgaaaaatggtgatgctggtatcattaagatgcttccaacaaagcccatggtcgtagagaccttctctcagtaccctcctcttggacgttttgctgttagggacatgaggcagacagttgctgttggtgtcatcaaggaagttgagaagaaggacccaacaggagccaaggttacc

SEQ ID NO: 1061 - DNA, 1710 bp, Primula obconica
ccccaacagtcatcactccaaactcctaccaacaccactaccacccattacggccgaaaacatcactctctctctcctccgcggctacatttctctcccttcgtgtgattcaagaagcagctcagtatgggtaaggaaaagattcacatcagcatcgtggtcattggccacgtcgactctggcaagtcgacgaccactggtcaccttatctacaagcttggaggtatcgacaagcgtgttatcgagaggtttgagaaggaagctgctgagatgaacaagaggtcgttcaagtacgcatgggttttggacaagctcaaggctgagcgtgaacgtggtatcaccattgatattgctttgtggaagtttgagaccaccaagtactactgcaccgttatcgatgcccctggacatcgtgatttcatcaagaacatgattactggtacttctcaggccgattgtgctgtcctcattatcgactctaccactggtgggtttgaagctggtatttccaaggatggtcagactcgtgagcacgctttgcttgctttcacccttggtgtcaagcagatgatctgttgttgtaacaagatggatgctactaccccaaaatattccaagtcaaggtacgaggaaatcgtgaaggaagtctcatcgtacctgaagaaggtcgggtataaccccgacaaaatcccatttgtgcccatctccggatttgaaggtgacaacatgattgagaggtccaccaaccttgactggtacaagggcccaacccttcttgacgccctagaccaagtctccgagcccaagaggccctccgacaagcccctccgtctcccacttcaggacgtctacaagattggcggcattggcacggtgcctgtgggacgtgtcgagacaggtgtcatcaagcccggtatggtggtcaccttcggcccatctggtctgaccactgaagtcaagtctgtcgagatgcaccacgagtctctcctagaggcccacccaggtgacaacgttgggttcaatgtgaagaatgttgctgttaaggatctcaagcgtggttatgttgcatcaaactcgaaagacgaccctgcaaagggagctgctagcttcacctcgcaggtcatcatcatgaaccaccctggccagatcggaaatgggtacgccccggtgctggattgccacacctcccacattgctgtcaagttttccgagattctgaccaagatcgataggcgatctggaaaggagctcgagaaggagcccaagttcttgaagaacggtgatgctggtatggttaagatgattccgaccaagcctatggtggtggagactttctctgagtaccctccgttgggacgttttgctgtgagggacatgaggcagactgttgctgtgggtgtcatcaagagtgtggacaagaaggatcctacaggagctaaggtcaccaaggctgctgtgaagaagggtgccaagtgaatcgtgcgggtttctggtagattccatgaagttccgtattatgctatgaataatgtcagccgtttgttttactttctgtgttttggggttctgccctgtttgttgcgcagccgttctcagaattgggtgctcgataggcggtggcagattctctaatgttgtctttgttttccttccgtaagacgcttgtttaagttggttttgagaatgctcctgtggcttctcaatgatttt

SEQ ID NO: 1062 - DNA, 1771 bp, Prunus persica
ctgctttgtctcgctcatcacaccaaagtcggcgagagaggcctctgaatctttttccagttcttctcctccgtttcttcagttatctttctgaaatcctgtaatgggtaaagagaagttccacatcaacattgtggtcattggccatgtcgactctggtaagtcgactaccactggtcacttgatctacaagcttggtggtatcgacaagcgtgttatcgagaggtttgagaaggaagctgctgagatgaacaagaggtcattcaagtatgcctgggtgctggacaagctcaaggctgagcgtgaacgtggtattacaattgatattgccttgtggaagtttgagaccaccaagtactactgcactgttattgatgctcctggacatcgtgactttatcaagaacatgattactggcacctcccaggctgactgtgccatcctcattattgactccaccactggtggttttgaagccggcatttccaaggatggtcagacccgagagcatgctttacttgcttttactcttggtgttaggcagatgatttgctgctgtaacaagatggatgccaccactcccaagtactcaaaggcaaggtacgatgaaattgtgaaggaagtctcatcctatctcaagaaggtcgggtacaacccagaaaagatcccctttgtgcccatttctgggttcgagggtgacaacatgattgagaggtccaccaaccttgactggtacaagggacccacccttcttgaggcccttgacttgatcagtgagcccaagagaccatcagacaagccccttcgacttccacttcaggatgtgtacaagattggtggtattggtaccgtccctgttggacgagttgagactggtaccctgaagcctggtatgcttgtgacttttgcccccactgggctgactactgaagttaagtctgtggagatgcaccatgaatctctccaagaggcccttccaggtgacaatgttggattcaacgtgaagaatgttgctgttaaggatctcaagcgtggttatgttgcttccaactccaaggatgatcctgcaaaggaagcagcaaactttaccgctcaggtcatcatcatgaaccaccctggccagattggacaaggatatgctcctgttcttgactgtcacacctcccacattgctgttaaatttgctgagatgttgacaaagattgacaggcgatctggtaaggaactggaaaaggagcccaagttcttgaagaatggtgatgctggatttgtgaagatgattcccaccaagcccatggttgttgagaccttctctgagtaccccccacttggacgatttgctgtgagggacatgcgacagactgttgctgttggtgtcatcaagagtgttgagaagaaggatccaactggtgctaagatcactaaggccgctgctaagaagaagtgaaccggactggctcatcagatttccgcaggggaaatcttatataaatataataatagtagtaaaaacttacctattgtcactattactatggtttgttggtcatactgttttatatgttatagtttttggtcatcattgttaggcattcagtcccagaattgggtgcttgacaggcggtggcgacgttacagcatacggagtccttgtacttcggttcggtgttgagtctaggtgctttggattttacccaaggcggctaaatacttttgttgttggttctgctactctggattttaattaaaaaaactatgttttattttcgta

SEQ ID NO: 1063 - DNA, 1838 bp, Rosa hybrid cultivar
gtgaatctcctgtgcctcggctctctctctctagggttttagcacttcctccaggttcaagttgatatttcgttatgggcaaggaaaagtttcatatcaacattgtggttattggccatgttgactctgggaagtcgaccaccactggtcatttgatctacaagcttgggggtattgacaagcgtgtgattgagaggttcgagaaggaggctgctgagatgaacaagcgttcattcaagtatgcttgggtgcttgacaagcttaaggctgagcgtgaaaggggtattaccattgacattgctctctggaagtttgagaccaccaagtactactgcactgtcattgatgctcctggacatcgtgacttcatcaagaacatgattactggaacttcccaggctgattgtgctgtcctcattattgactctaccactggaggttttgaggctggtatctctaaggatggtcagacccgtgagcatgctctccttgctttcacccttggtgttaggcaaatgatttgttgctgcaacaagatggatgctaccagtcctaagtactcgaaggcaaggtatgatgaaatcgtgaaggaagtgtcatcctatctgaagaagattggatacaacccagacaaaattgcttttgttcccatctctggatttgagggtgacaacatgattgagaggtccaccaacctcgactggtacaagggtccaacccttcttgaggcccttgacatgatcaacgagcccaagaggccctccgacaagcccctccgacttccacttcaggatgtctacaagattggaggtattggaactgttcctgttggacgtgtggagactggtattatcaagcctggtatggttgtgacttttgctcccactgggttgaccactgaagttaaatctgtggagatgcaccacgaggctctccaggaggctcttcccggtgataatgttggcttcaacgtcaagaacgttgcagtcaaggatctcaagcgtgggtatgttgcttcaaactccaaggatgatccagccaaggaagcagctaacttcactgcccaggtcatcattatgaatcaccctggccagattggaaacggttatgctcctgtgcttgattgccacacctctcacattgctgtcaagttcaatgagattttgaccaagattgacagacgttctggcaaggagcttgagaaggagcccaagtttttgaagaatggtgacgcagggtttgttaagatgattcccaccaagcccatggtcgttgaaactttctctgagtatcccccacttggtcgttttgctgtgagggacatgcgccagacagttgctgtgggagtcatcaaggctgtggagaagaaggatcccagcggagccaaggttaccaagtctgcagccaagaagaagtgaattgtgcgctttgcaggtgcaagtgaaggccatcttcagtgtggttataataaagcatgggtggttgctactagtattttcagtcggtcgttagttgtcgtctttgccattcataggctcaagttccctccgtcttcatgtggctgttcacagaattgggttctcgataggcggtggcgagcttacttgtgttttttctaattctgttctgttgtcctagctatgttctgtgactatctttttaagcagctttcacatgctgcctggatattgtttacttttatataatatggacttaatactgtgtcagattttttgttgtgctcttctttgagtttttctaacagcaatgtttgtcctgtacaaaaaaagtaaaaaacaaggggttttagttatgcgacttatttttgttaattgtct

SEQ ID NO: 1064 - DNA, 1740 bp, Rosa hybrid cultivar
ttagcacttcctccaggttcaagttgatattcgttatgggcaaggaaaagtttcatatcaacattgtggttattggccatgtcgactctgggaagtcgaccactactggtcatttgatctacaagcttgggggtattgacaagcgtgtgattgagaggttcgagaaggaggctgctgagatgaacaagcgttcattcaagtatgcttgggtgcttgacaagcttaaggctgagcgtgaaaggggtattaccattgacattgctctctggaagtttgagaccaccaagtactactgcactgtcattgatgctcctggacatcgtgacttcatcaagaacatgattactggaacttcccaggcggattgtgctgtcctcattattgactctaccactggaggttttgaggctggtatctcgaaggatggtcagacccgtgagcatgctctccttgctttcaccctcggtgttaggcaaatgatttgttgctgcaacaagatggatgctacctctcctaagtactcgaaggcaaggtatgatgaaatcgtgaaggaagtgtcatcctatctgaagaagattggatacaacccagaaaaaattgcttttgttcccatctctggatttgagggtgacaacatgattgagaggtccaccaacctcgactggtacaagggtccaacccttcttgaggcccttgacatgatcaacgagcccaagaggccctccgacaagcccctccgacttccacttcaggatgtctacaagattggaggtattggaactgttcctgttggacgtgttgagactggtattatcaagcctggtatggttgtgacttttggtcccactggattgaccactgaagttaagtctgtggagatgcaccacgaggctctccaggaggctcttcctggtgacaatgttggcttcaacgtcaagaacgttgcagtcaaggatctcaagcgtgggtatgttgcttcaaactccaaggatgatccagccaaggaagcagctaacttcactgcccaggtcatcattatgaatcaccctggccagattggaaacggttatgctcctgtgctcgattgccacacctctcacattgctgtcaagttcaaagagattttgaccaagattgacagacgttctggcaaggagctagagaaggagcccaagtttttgaagaatggtgacgcagggtttgttaagatgattcccaccaagcccatggtcgttgaaactttctccgagtatcccccacttggtcgttttgctgtgagggacatgcgccagacagttgctgtgggagtcatcaaggctgtggagaagaaggatcccagcggagccaaggttaccaagtctgcggtcaagaagaagtgaattgtgcgctttgcaggtgcaagtgaaggccatcttcagtgtggttataataaagcatgggtggttgctactagtattttcagttggtctttagttgttgtctttgtcagtcattggctcaagtttcctccgtcttcgtgtggctgttcgcagaattgggtgcttgataggcggtggcgagcttacttgtgtttttctagttctgttctgttgtcctagctatgctctgtgactatctttttaagcagctttcacatgccgcctggatattgtttacttatataatatggacttaatattgtgtcaaaaaaaaaaaacaaaactacgagacttagttctctctctctgcgcggccgcgagc

SEQ ID NO: 1065 - DNA, 1507 bp, Scabiosa columbaria
tctatttctctcttcaaacttctcttctctttctacagtgagagctttcttcgccaattcactacattcaagaaaatgggtaaagagaagttccacatcaatatcgtggttataggccatgtcgactctggaaaatctaccactactggccacttgatctacaagcttggaggtattgacaagcgtgtgattgagaggtttgagaaggaggctgctgagatgaacaagaggtcattcaagtatgcctgggttcttgacaagcttaaggcagagcgtgagcgtggtattaccattgatattgccttgtggaagtttgagaccaccaagtactactgcacagttattgatgcccctggacatcgtgatttcatcaagaacatgattactggtacctcacaggctgattgtgctgtccttatcattgactctaccactggtggatttgaagctggtatctctaaggatggtcagacccgtgagcatgctttgcttgctttcacccttggtgtcaagcaaatgatctgctgctgtaacaagatggatgctaccaccccaaaatactcgaaggcaaggtatgatgaaatcgtgaaggaagtctcatcctacttgaagaaggttggatacaaccctgacaaaattgcttttgttcccatctctggttttgagggagacaacatgattgagagatctaccaacctcgactggtacaaaggacccacacttcttgaggctcttgacatgatctctgagccaaagagaccctcagacaagcccctccgtctcccacttcaggatgtctacaagattggtggtattggaactgtgcctgtgggacgagttgagaccggtaccatcaagcctggtatggtcgtcacctttggtccaactgggctaaccactgaggtcaagtccgttgagatgcaccatgagtccttgcttgaggctctccctggtgacaatgtcgggttcaatgttaagaatgttgctgtcaaggatctcaagagagggtacgtcgcttcaaactccaaggatgatcctgccaagggtgctgccagcttcacctcacaagtcatcatcatgaaccaccctggtcagatcggtaatgggtatgcaccagtgcttgattgccacacatcccacattgcagtcaagtttgcagagatcttgaccaagattgataggcgatctggtaaggaaattgagaaggagccaaagttcttgaagaatggtgatgccggtatggtgaagatgcttccaaccaagcccatggttgttgagaccttctccgagtacccacctcttggtaggtttgctgtgagggacatgaggcaaacagttgctgtcggtgttatcaaggctgttgacaagaaggatccatcaggtgctaaggtgaccaaggcagcagcaaagaaaggagttaagtaaacagttgtcaaagatatctgtgagttgttgaactgtattacagtagtattttcattttatgttacttttattatgtgtttag

SEQ ID NO: 1066 - DNA, 1798 bp, Fragaria vesca
acatcgtttcattggcagttgtcactctcctgtgctcagctctctatctctttagggtttcagcgcttcctccaggttcaactatgggcaaggaaaagtttcacatcaacattgtggtcattggccatgttgactctgggaagtcgaccaccactggtcatttgatctacaagcttgggggtattgacaagcgtgtcattgagaggtttgagaaggaggctgctgagatgaacaagcgttctttcaagtatgcttgggtgcttgacaagctcaaggctgagcgtgagaggggtattactattgatattgctctctggaagtttgagaccaccaagtactactgcactgtcattgatgctcctggacatcgtgacttcatcaagaacatgattactggaacttcccaggctgattgtgctgtcctcattattgactccaccactggaggttttgaggctggtatctcgaaggatggtcagactcgtgagcatgctctccttgctttcacccttggtgttaggcaaatgatctgctgctgcaacaagatggatgctacctctcccaagtactcaaaggcaaggtatgatgaaatcgtgaaggaagtgtcatcttacctgaagaagattggatacaacccagacaaaattccttttgttcccatctctggttttgagggtgacaacatgattgagaggtccaccaaccttgattggtacaagggtccaacccttcttgaggcccttgacatgatcaacgagcctaagaggccctctgacaagcccctccgactaccacttcaggatgtctacaagattggaggtattggaactgttcctgttggacgtgttgagactggtattatcaagcctggtatggttgtgactttcgctcccactggattgaccactgaagttaagtctgtggagatgcaccacgaggctctccaggaggctcttcctggtgacaatgttggtttcaacgtcaagaacgttgcagtcaaggatctcaagcgtgggtatgttgcttcaaactccaaggatgatcctgccaaggaggcagccaacttcaccgcccaggtcatcatcatgaatcaccctggccagattggaaacggttatgctcctgtgcttgattgccacacctctcacattgctgtcaagttcggtgagattctgaccaagattgacagacgttctggcaaggagcttgagaaggagcccaagtttttgaagaatggtgatgctggttttgttaagatgcttcccaccaagcccatggttgttgaaactttctctgagtatcccccacttggtcgttttgctgtgagggacatgcgccagactgttgctgtgggagtcatcaaggctgtggagaagaaggatcctagcggagccaaggttaccaagtctgcagccaagaagaagtgaattgtgcgccttccaggttcaagtgcaggctatcttcagtgtggttataataaagcatggtttgttgctactagtattctgagtcggtcttttactgtcgtctgtgtcagtcgtaggctcaagttacctccgtcttcgtgtgggtattcgcagaattgggtgcttgataggcggtggcgagcttacttatgttttttttttttcttgttctgtgctgttgtcatagctatgttttgtgactaccttcttaagcagctttcatatgttgcttggatattgtttacttttatataatgtcagcttattttatgcttgctctatttcaacagcaatgctattttgctatattaatatgatgcttgcataacaaa

SEQ ID NO: 1067 - DNA, 1743 bp, Helianthus annuus
gatctctcttctcttgccgtttctcatcgtactagaagaagtacaagtttggtcatttcagcaacaagttcagttgtattatgggtaaggagaaggttcacataaacatcgtggtcattggccatgttgactctggaaagtcaaccactacaggccacttgatctacaagcttggaggcatagacaagcgagtgatcgagaggttcgaaaaagaagctgccgaaatgaacaaacgttccttcaagtacgcctgggtgctagacaagctcaaagccgaacgtgaacgtggtatcaccattgatatcgccttgtggaagttcgaaaccaccaagtactattgcacagtcatcgatgcgcctggtcatcgcgatttcatcaagaacatgattacggggacatctcaggctgattgcgctgtcctgatcatcgactccaccacaggtggtttcgaagctggtatttccaaagatggtcagactcgtgaacatgctttgcttgctttcaccctcggtgtcaggcaaatgatatgttgttgtaacaagatggacgctacaacacctaaatactcgaagcctaggtacgacgagattgttaaggaagtgtcgtcgtaccttaaaaaagtcggatacaaccccgaaaaaatcccatttgttccaatttctggtttcgaaggagataacatgattgagaggtcaacaaaccttgattggtacaaggggccaacacttcttgaagcacttgacaatgttagtgaaccgaagaggccttcagacaagccgcttcgtctcccactacaggacgtgtacaagatcggtgggattggaactgtgcccgtgggtcgggtagagactggtattatcaagccgggtatggtcgtcactttcggcccgtctggtctcaccactgaagtgaaatcggtcgaaatgcatcatgaagcacttcaagaggcattgccaggggataacgtcgggttcaatgtgaagaatgttgcggtgaaggatcttaaacgcggttatgttgcttcaaactcgaaagatgatccagcaaagggtgcggctggcttcacttctcaggttattatcatgaaccaccctggccagattgggaacggttatgcaccagtgcttgattgccacacttctcacattgctgttaagtttgctgagctgcagaccaagattgaccgcaggtctggtaaggagctcgagaaggagcctaagtttttgaaaaacggtgatgcggggattgtgaaaatggttccaaccaagcctatggtggtggagacgttctctgagtatccgcctttggggcgttttgctgtgagggatatgcgacagacggttgctgttggtgtgatcaagagtgtggacaaaaaggacccaactggtgctaagatcaccaaggctgcagccaagaagaaatgaaccgatgcttttatgaaccttctgttcacagtgcactttgttattgtcttgttatttgtttttaacttttgtttgcgtcgttgctgccatcgtttactgccgttcttaggaacagtggttctgttgcgttttcaggttgatagtcatacatgggtgcttgacagacggtggcacaacgcgagtaatgctacttattttcgttttcgtggagtgtttatatctgaacttgaagaataaaatctatatatttgtggatacttatcatcttggatgcttaattgtttgtggttgatttgtattggcaatatatagtatatgt

SEQ ID NO: 1068 - DNA, 1772 bp, Thalictrum flavum
actaagttactagacctactcttcaactttcttaaagcttattagggtttcttcttcttcgcggcgcgtcaattcctttcactaaggatgggaaaagagaaggttcatatcaacattgttgtcattggccatgtcgactctggcaaatctaccactactgggcatctgatctacaagctaggaggtattgacaagcgtgtcattgaaaggttcgagaaagaggctgctgagatgaacaagaggtcattcaagtatgcctgggtcctggacaaacttaaggctgaacgtgaacgtggtattaccattgacattgccctatggaagtttgagaccacaaaatactactgcactgtcattgatgctccaggacatcgtgatttcattaagaacatgattactggtacatcccaggctgactgtgctgttctcatcattgactctaccactggtggttttgaagctggtatctctaaggatggtcagactcgtgagcatgccctgcttgctttcacccttggtgtgaagcagatgatctgctgttgtaacaagatggatgccaccaccccaaagtactcgaaggctaggtatgatgaaattgtcaaggaagtctcttcttacctgaagaaggttggatacaaccctgacaaaattccatttgtacctatctctggatttgagggtgataacatgattgaaaggtccaccaaccttgattggtacaagggcccaacccttcttgaagctcttgacaatatctcagaacccaagaggccaacagacaagcccctccgtctcccacttcaggatgtttacaagattggtgggattggaactgtgcctgtcggtcgagttgagactggtgttctcaagcctggtatggttgtcacctttggccccactggactgaccactgaagttaagtctgttgagatgcatcatgaggcactccaagaagccctccctggtgacaatgtgggattcaatgtgaagaatgttgctgttaaggatctcaagcgtgggtatgttgcctccaactccaaggatgatcctgccagggaagctgccaacttcacttcccaagttatcatcatgaaccaccctggacagattggaaacggatatgctccagttcttgactgccacacctcccacattgctgtcaagtttagtgagatccttaccaagattgatagacgatcaggaaaggagcttgagaaggagcccaagtttgtgaagaacggtgatgcttgttttgttaagatgcttcctaccaagcctatggtggttgagaccttctccgagtatcctccacttggtcgttttgctgtcagggacatgcgtcagacagttgctgtgggagtcatcaagagcgttgagaagaaggatcccagtggcgccaaggtcaccaagtctgctgccaagaagaaatgaatcgaggcggagtctggttcatttgaagacttgtatttttactatcataaagacttggtatggtctactagttgctttgttgatttattatgtggttgttttggtcactataatcttctgtcttcgcaatctcttgttagtctcatccagaattgggtgcttgacaggcggtggcaaagctttagactcctttccttgtcagtttgttgagtcctgttgtagcctacgttggttttggttgtgacatttcctgttttgtactcttatgttggagtttttacacggatgctcctgcactctgaatgtttcctttattcgaagtaatacatgtatcttctgcc

SEQ ID NO: 1069 - DNA, 1637 bp, Triphysaria pusilla
attggcgtagccagaaacttgaagccattctctatatcgcatcaattcttgtgtaaaggttaaacatgggtaaggaaaagtttcatatcaacattgttgtcattggtcatgtcgactctggaaagtcaaccaccactgggcatctcatctacaagcttggaggtatcgacaagcgtgtgattgagaggtttgagaaggaggctgctgagatgaacaagaggtccttcaagtatgcctgggtgctcgacaagctcaaggctgagcgtgagcgtggtattaccattgatattgccttgtggaagtttgaaaccactaagtactactgtacagttattgatgctcctggacatcgagattttatcaagaatatgatcactgggacatcacaggctgactgtgctgtgcttatcattgactcaaccactggtgggtttgaggctggtatctctaaggatggccagacccgtgagcacgctctcttggctttcactcttggtgtgaagcaaatgatctgctgctgtaacaagatggatgctaccactcccaagtactccaagtccagatacgatgaaattgtgaaggaagtctcttcctacctgaagaaggttggttacaacccggacaaaatcaatttcgttcccatctctggattcgaaggagacaacatgattgagaggtcaaccaaccttgactggtacaagggcccaacccttctggaagctctggacatgatctcggagcccaagaggccatcagataagccccttcgtctcccacttcaggatgtttacaagattggtggtattggcactgtccctgttggaagagttgaaactggtatcattaaacctggtatgcttgttacttttgccccatctggactcacaactgaggttaagtcggttgagatgcaccatgaggccctccaagaagctctccccggtgacaatgtcggcttcaatgtcaagaatgttgctgtgaaggatctcaagcgtggttatgttgcgtctaactcaaaggatgatcctgctaaggaggctgctaatttcacgtcccaggtcattatcatgaaccacccaggccagatcggacaaggatacgccccagtgcttgattgccacacctctcacattgctgtcaagtttgctgagcttgtgaccaagattgacagacgatctggaaaggaactcgagaaggagcccaagttcttgaagaatggtgatgctgggatggttaagatggttccgaccaagcccatggtggtcgagacctttgctgcgtatccacctttgggacgatttgctgtgagggacatgcgtcagacagttgctgttggtgttatcaagagtgttgagaagaaggatccatctggagctaaggttaccaaggctgcggccaagaagggtgccaagtgactactgcgcttttctgatgatgatattattttacttgactattacaactgccaaaaacaatttcatttcccttgtcatttagttatgtgttctagttatttctgctctattagtatttggtctatcctatgcggttttggctctcaattttgggttcttgatcgtaggtggaacctgaaatgactttggatttttgcctttatgtttttaataatatgagtc

SEQ ID NO: 1070 - DNA, 1640 bp, Triphysaria pusilla
tcaatatcgaagaagtccatcgattcatttgtagaggttaagcatgggtaaagaaaagtttcacattaacatcgttgtcattggtcatgttgactctgggaagtcgaccaccactgggcatctcatctacaagcttggaggtatcgacaagcgtgtgattgagaggtttgagaaggaggccgctgagatgaacaagaggtccttcaagtatgcctgggtgctcgacaagctcaaggccgagcgtgagcgtggtattactattgatattgccctctggaagtttgaaaccaccaagtactactgcacagtcattgatgctcctggccatcgggactttatcaagaatatgatcactgggacttcacaggctgactgtgcagtgcttatcattgactcgaccactggtgggtttgaggctggtatctctaaggatggccagactcgtgagcacgctctattggctttcactcttggtgtgaagcaaatgatctgttgctgtaacaagatggatgccaccactcccaagtactctaagtccagatatgatgaaatcgtgaaggaagtctcttcctacctgaagaaggttggttacaaccctgacaagatcaattttgtgcccatctctggttttgagggcgacaacatgattgagaggtcgaccaaccttgactggtacaagggcccaacccttcttgaagcactggacatgatctccgagcccaagaggccatcagacaagcccctccgtctcccacttcaggatgtctacaagattggtggcattggaactgtccctgttggaagagttgaaactggtgtcatcaaacctggtatgcttgtcacattcgccccatctgggctcacaactgaggttaagtcggttgagatgcatcatgaggccctccaggaagctctccctggtgacaatgttggcttcaatgtcaagaatgttgctgttaaggatctcaagcgtggttatgttgcgtctaactcaaaggatgatcctgccaaggaggctgctaatttcatttcccaggtcattatcatgaaccacccgggtcagattggacaaggatatgccccagtgctcgattgccacacctctcacattgctgttaagtttgctgagcttgtgaccaagattgacaggcgatctggcaaggagcttgagaaggagcccaagttcttgaagaacggtgatgctgggatggttaagatggttccgaccaagcccatggtggttgagacctttgctcagtatccacctttgggacgatttgctgtgagggacatgcgccagacagttgctgttggtgttatcaagagtgttgagaagaaggatccgtctggagctaaggttaccaaggctgctgccaagaagggtgccaagtgacttatgcactttgatcttttctattgcaactactgcaaaaaacatttatattttccttgtcatgaagtttttagttctttttatttctgctctattagtatttggtcaaacctatgtggttttggttctcagacttgggtgctggatcgcaggtggaaactgatacgactcttgtttttgtctttatgttattctatgaatatgaaatgagttctggttttgtcatatccaaaaaaaaaaaaaaaaa

SEQ ID NO: 1071 - DNA, 1477 bp, Valeriana officinalis
ctttcctctcttctccttaagatctagctgcgaaacagtttttagcactttgcagaatggggaaggaaaagtttcacatcaacattgtggttattgggcatgtggattctggaaagtcaaccacgactgggcatctaatctacaaacttggaggcattgataagcgtgtgatcgagaggtttgagaaggaagctgctgagatgaacaagcgttcattcaagtatgcttgggtgctcgacaagctcaaggccgaacgtgagcgtggtatcaccatcgatattgcactgtggaagtttgaaaccacaaagtattactgcacggttatcgatgcacctggtcaccgtgactttatcaaaaacatgattactggaacttctcaggcagattgtgctgttttaatcattgattccactactggaggatttgaagctggtatttcgaaagatggccagactcgtgaacatgctctccttgcttttactctgggtgtcaaacagatgatctgctgttgtaacaagatggatgcaactacacccaagtattcaaaggcaaggtacgatgaaatagtaaaagaagtctcttcatacttgaagaaagtcggttacaaccctgacaagatcccatttgtaccaatctctggattcgaaggcgacaacatgattgaaagatcaaccaacctcgactggtacaagggacccactcttctcgaggccctagacttaatcagcgagcccaaaagaccctcagacaaaccccttcgcctacctctacaagacgtctacaaaatcggaggcattggaacagtgccagtcgggcgtgttgaaaccggtaccataaaacccggcatggttgtcactttcggtccatctgggttgaccacagaagtcaagtcagtcgaaatgcatcatgagtctttgaccgaagctcttcccggtgacaatgtaggattcaatgttaagaatgtggctgttaaggatcttaaacgtggttacgtggcatcaaattccaaagatgatccagcgaaagaggctgctaattttacttcgcaggttataatcatgaaccatcctggtcaaattggaaacgggtacgctccggttcttgactgtcacacgtcgcatatagctgtcaagtttggtagtctgttgaccaagattgaccgaagatccggtaaggagattgagaaagaaccaaagtttctgaaaaacggtgatgctgggatggttaagatgattcctactaaacctatggtggtcgagactttttctgaatatcccccgcttggcagatttgctgtaagggatatgcgacaaacggttgcagttggagttattaagagtgttgagaaaaaagaaccttccggagccaaagtgacaaaggctgctgctaagaagggtgctggaaagtgaatccatgagctttttccgtgtttgggtgaagggtattatcgtaaaaataaggttatggtcgttgattg

SEQ ID NO: 1072 - DNA, 1709 bp, Vinca minor
ctcactcatacaatctatctgcgagtgagatagctctcagtccttcagattcatcttcccaagttttttctgaaatttcagtatgggcaaggaaaagattcacatcagcattgtggtcattggacatgtcgactctggcaagtctactaccactggtcacttgatttacaagcttggtggtattgacaagcgtgtgattgaaaggttcgagaaggaggctgctgaaatgaacaagaggtcattcaagtacgcctgggtgcttgacaagctcaaggctgagcgtgagcgtggtattaccattgatattgccttgtggaagttcgagaccaccaagtactactgcacagtcattgatgcccctggacatcgtgatttcatcaagaacatgattactggtacctcacaggctgactgtgctgtccttatcattgactccaccactggtggttttgaagctggtatctctaaggatggtcagactcgtgagcacgccttacttgccttcactcttggtgtcaagcagatgatctgctgctgtaacaagatggatgccaccacccccaagtactcgaaggccaggtacgaagaaatcgtcaaggaagtgtcatcttacctcaagaaggtcggatacaaccccgacaaaatccccttcgtccccatctcaggttttgagggagacaacatgattgagaggtcttctaaccttgactggtacaagggccctacccttcttgatgctcttgaccaaatctcagagcccaagaggccatcagacaagccactccgtctcccacttcaggatgtttacaagattggtggtattggtaccgtccctgtgggtcgtgtggaaactggtgtcatcaagcctggtattcttgtgacctttgggccaactggtctgactactgaagttaagtctgttgagatgcaccatgaagctcttaccgaggcacttcccggtgacaatgttgggttcaatgtcaagaatgttgctgttaaggatctaaagcgtggttatgttgcatccaactccaaggatgacccagccaagggggctgccagcttcacctcgcaggtcatcatcatgaatcaccctgggcagattggaaatgggtatgccccagtgctggactgtcacacctctcacattgccgttaagtttgctgagatattgaccaagattgacagacgatctggtaaagagattgagaaggagcccaagttcttgaagaacggtgatgctggtatggttaagatgatccccaccaagcccatggttgttgaaacgtttgctgagtaccctccccttggtcgttttgctgtaagagacatgcgtcaaacggttgcggttggtgttatcaagagcgtggacaagaaggacccaactggtgccaaggtcaccaaggcagcagtcaagaagggtgccaagtgaaatgctcgcctgaggagtttttcggttgaactattattgtcttctgttttctttagttattatggattctgttctgaacatcttattcgcagttttggttattcccctggtttccttattcactgctctctagccttgctttcaaggatggtggagaaattgagcaagcttttgcttgtttgatggcagtgatacagactatcttgggcatttttaatgattcgtatttattatagtgtggtagttggtcgttgaacaattgttattattatgtgtc

SEQ ID NO: 1073 - DNA, 1706 bp, Vinca minor
agctttctataatttcagtatgggtaaggaaaagattcacatcagcattgtggtcattggacatgtcgactctggcaagtctaccaccactggtcacttgatctacaagcttggtggtattgacaagcgtgtgattgaaaggttcgagaaggaggctgctgaaatgaacaagaggtcattcaagtacgcttgggtgcttgacaagctcaaggctgagcgtgagcgtggtattaccattgatattgccttgtggaagtttgagacaaccaaatactactgcacagtcattgatgcccctggacatcgtgatttcatcaagaacatgattactggtacctcacaggctgactgtgctgtccttatcattgactccactactggtggttttgaagctggtatctctaaggatggtcagactcgtgagcacgccttgcttgccttcactcttggtgtcaagcagatgatctgctgctgtaacaagatggatgccaccacccccaagtactcgaaggctaggtacgaagaaatcgttaaggaagtgtcttcatacctcaagaaggttggatacaacccagacaaaatccccttcgtccctatctcaggttttgagggagacaacatgattgagaggtcttccaaccttgactggtacaagggccctacccttcttgatgctcttgaccaaatctcagagcccaagaggccatcagacaagccactccgtctcccacttcaggatgtttacaagattggtggtattggtaccgtccctgtgggtcgtgtggaaactggtgtcatcaagcctggtattcttgtgacctttgggccaactggtctgactactgaagttaagtctgttgagatgcaccatgaagctcttacggaggcacttcccggtgacaacgttgggttcaatgtcaagaatgttgccgttaaggatctaaagcgtggttatgttgcatccaactccaaggatgacccagccaagggggctgccagcttcacctcgcaggtcatcatcatgaatcaccctgggcagattggaaatgggtatgccccagtgctggactgccacacctctcacattgctgtcaagtttgctgagatcttgaccaagattgacagacgatctggtaaagagattgagaaggagcccaagttcttgaagaacggtgatgctggtatggttaagatgattcctaccaagcccatggttgttgaaacgtttgctgagtaccctccccttggtcgttttgctgtgagagacatgcgtcaaacagtggctgttggtgttatcaagaatgtggacaagaaggacccaactggtgccaaggtcaccaaggcagcagtcaagaaaggtgccaaatgaactgtgctgcgtactggtactgctggtgaagatgttttctattacaataaggcatttcgtgagaactggaacttttatagaactgctattgtagtttgttttttgtgtcatttgttgtgtcgtaggtgtctgccctgtaagttcagtatcctttctcagaattgggtactcgacaggcggtggcagatcctacaatcttagtctttgttatgttttgttggagtctctcttacatttgagttgctttggtttccgagcgactcagatattgtgtgttttattattatgcggatgcaattatagctatggatcttattttgcgaaaaaaaaaaaaaag

SEQ ID NO: 1074 - DNA, 1648 bp, Citrullus lanatus
tttggtttatgatcattaactcttttcaggttacaagtttaaaatggggaaagagaaggttcacattaacattgtggtcattggccatgtcgactcagggaagtcaaccaccaccggacacttgatctataagcttggtggtattgacaagcgtgtcattgaaaggtttgagaaggaagcagctgagatgaacaagaggtccttcaagtatgcctgggtgttggacaagcttaaggctgagcgtgaacgtggtattaccattgatattgccttgtggaagtttgaaaccaccaaatactactgcaccgttattgatgcccctggacatcgcgatttcattaagaacatgattactggtacctcacaagctgactgtgctgttctcattattgactccactactggtggttttgaagctggtatttctaaggatggtcaaacccgtgagcatgctttgcttgcgtttactcttggtgtcaagcagatgatttgctgctgcaacaagatggatgccaccaccccgaagtactccaaggcaaggtatgatgaaattgtcaaggaagtttcttcctacctcaagaaggttggatacaaccctgacaaaatcccatttgtccccatctctggtttcgaaggagacaacatgattgagagatcaaccaaccttgattggtacaagggtccaactctccttgaggctcttgacttgatccaggagcccaagaggccctcagacaagccactccgtcttccacttcaggatgtgtacaagatcggtggtattggaactgtaccagtcggacgtgttgagactggtgtcctcaaacctggaatggttgtcacttttggcccttctggattgaccactgaagttaagtctgttgagatgcaccacgaagctctccctgaggccgttcctggcgacaatgtgggattcaatgtaaagaatgttgctgtaaaggatctcaagcgtggtttcgttgcttccaactcaaaggatgaccctgccaaggaggctgccaacttcacttctcaagtcattatcatgaaccacccaggacaaattggcaatggttatgctccagtgctcgattgccacacctctcacattgccgtgaagtttgccgagattcaaaccaagatcgacaggcgatctggtaaggaacttgagaaggaacccaaattcttaaagaatggtgatgcaggtatgattaagatggttcccaccaagcccatggtggtggaaactttctctcagtaccctcctctcggacgttttgccgtgagggacatgagacagaccgttgctgttggcgtcatcaagtccgtcgaaaagaaggatccaagtggtgctaaggttaccaagtctgcagtcaagaaaggtggaaagtgaaccgtaattacaaaacctcacacaactctttctgaggtttgcaagtataactgtcagaataaagacctggtaagctttcttggtaatgctttgtcgaatcttataattttcattcgtgattatagtttttggcgttggttattaggtacccagtctcagaattgggtgcttgatagacggtggcacaactattatctttagtcctttttttcttcttttcgttcggtcttctgctttattggtcctgtttgagtt

SEQ ID NO: 1075 - DNA, 1741 bp, Olea europaea
ctcgatctcctcattggtatctccttcaagctcaccagcatctttggatttcttctcgtccttcttctttttcttgctcttcacagaaattaaaactctctctgcagtcggcgggtgagagatttctctatactaccttcaaagctttctttttagaagtaaaacatgggtaaggaaaagattcacattagcattgtggtcattggccacgttgactctggaaagtcaaccaccaccggccatttgatctacaagcttggtggtattgacaagcgtgttattgaaaggttcgagaaggaggctgctgagatgaacaagaggtcattcaagtatgcctgggtgctcgacaagctcaaggctgagcgtgaacgtggtattaccattgatattgccttgtggaaattcgagaccaccaaatattactgcacagttattgatgctccaggacatcgtgactttatcaagaacatgattactggtacttcacaggctgactgcgccgtccttatcattgactctaccactggtggttttgaagctggtatttccaaggatggtcagacccgtgaacatgctttgcttgccttcacccttggtgtcaagcagatgatttgctgctgcaacaagatggatgccactacgcctaaatactcgaagtctaggtatgatgaaattgtgaaggaagtggcatcctacatcaagaaggtcggatacaaccctgacaagatcccatttgtccccatctctggtttcgagggtgacaacatgattgagaggtccagcaaccttgattggtacaagggcccaaccctcctcgaagctcttgaccagattctggagcccaagagaccctcagacaagcctctccgtctcccacttcaggacgtctacaagattggtgggattggaactgtacctgtcggccgtgttgagactggtgttatcaagcctggtatggtcgtcacctttggcccatctggtttgacaactgaagtcaagtctgttgagatgcaccacgaggccctccaggaggctctccccggtgacaatgttgggttcaacgtcaagaatgttgcagtgaaggatctcaagcgtggttatgttgcctccaactccaaggatgaccctgccaagggtgctgccagtttcacttcccaggtcatcatcatgaaccaccctggtcaaattggaaacggttatgccccagtgctcgactgccacacatcccacattgctgttaagtttgctgagctccagaccaagatcgacaggcgttctggtaaggagctggagaaggagcccaagttcttgaagaacggtgatgctggtcttgttaagatgattcccaccaagcccatggttgtggagactttcgcagagtacccacctcttggacggtttgctgtgagggatatgcgccagacagttgctgttggtgtgatcaagagcgtggacaagaaggatccaaccggtgccaaggtcaccaaagctgctgctaagaagggtgccaagtgaagaaatttcatgttatcgattattcacattagctattttcaagacatcttttgcatttttgattattatggtttttcctgatgctctatctggattgccatttcttgttttggtttatcatgagttgtaagacctatttcaacatcttttaatttatgtttttcttccgaagtcatagtggcatttgaattttagctggattgatttcttgccttgaagcgctttc

SEQ ID NO: 1076 - DNA, 1902 bp, Cicer arietinum
taaacaacttgtattttggatttttttacagaaaagggttatataagaataaattctgttaattttcaatcttatgcttgtatttgttgtgtatgcttgatcttgtggaacatgccctgtgttcctcttttaatattgtattgtatagttgacatggattgtgcattttgattgtcataatgttgatttaagactgatatttattttacttatgtattgtttccttactgtttgtgttcaaattgcagaaattttgtgattttaagctttagcagtaatgggtaaagagaaagttcacatcaacattgtggtcattggccatgtcgactctgggaaatcaaccaccactggtcacttgatctacaagcttggaggtattgacaagcgtgtcattgagaggtttgagaaggaagctgctgagatgaacaagcgttcattcaagtatgcctgggttcttgacaagctcaaggctgagcgtgaaagaggtatcacaattgacattgctctttggaagtttgagacaactaagtactactgcactgtcattgatgcccccggacacagggatttcattaagaacatgattactggaacatcccaagctgattgtgctgtccttatcattgattccacaactggtggttttgaagctggtatttctaaggatggtcagacccgtgaacatgctctccttgctttcacccttggtgtcaagcaaatgatctgctgctgtaacaagatggatgctactacacccaagtactccaaggctaggtatgatgaaattgtgaaggaagtttcatcctatttgaagaaggttggctacaacccagaaaaaattccatttgttcccatctctggttttgagggagataacatgattgagcgctctacaaaccttgactggtacaagggtccaacccttcttgaggcccttgaccaaatcaatgagcctaagaggccatcagacaagcccctccgattaccacttcaagatgtctacaagattggaggaattggaactgtgcctgttggacgtgttgagactggtgtcttgaaaccaggatttgtcgtgacttttgcaccaactggattggcaactgaagtcaagtctgttgagatgcatcacgaagctctgactgaggcccttcccggtgacaatgttggatttaatgttaagaatgttgctgtcaaggatctcaagcgtggttatgttgcatcaaactccaaggatgaccccgccaaggaggctgctaactttacatcccaagttatcatcatgaatcaccctgggcagattggaaacggttatgcccctgttcttgactgccacacctcccacattgctgtcaagtttgctgagcttattaccaagattgacaggcgttctggtaaggagattgagaaggagcctaaattcctgaagaatggtgatgctggtcttgttaagatgattccaacaaagcccatggtggttgagacttttgctgagtatcctcctcttgggcgttttgctgtgagagacatgcgtcaaactgtggctgtgggagttatcaagagtgtggagaagaaggaaccaagtggtggaggtaagaaaactatctcagcagtgaagaagaaatgaattgtgcacgatcatctatatagggaaatctattggtgtgacatctgttggtgtgactatagtaaatggtttgttctcactagtactttttctcatttaattactttgtttaagtcaccaccgtcgtctcgcagcttttgttcccagaactgggttctagatcgacggtggcatggctatttggtgttttttttatgctttgattattgtgttatgtgagaacaattctcttttgtaagcaactggattgctggtttttgttttggtatatcactcca

SEQ ID NO: 1077 - DNA, 1551 bp, Panicum virgatum
aaacacactaagcaaaaaaaaacataacagatatattgattctggaaactgacactgacacatactgtaaaaataaacactgcgagacccaaacaaccaaacttgtccgacaatataataactgtaatgcaaacttttctagccaaaataactccactagctatgcgatgtcataataacatccacggatcgaccgtttatttcttcttggcagcagccttggtgaccttggctcccgttgggtccttcttctccacgctcttgatcacgccgacagccaccgtctgcctcatgtcgcgcacagcgaaccgccccagcggcgggtactcggagaacgtctccaccaccatgggcttggtcgggatcatcttgacgaacccagcgtcgccgttcttgaggaacttgggggcgctctcgagctccttgccggagcgcctgtcgatcttggtcagcagctccgagaacttgacggcgatgtgggacgtgtggcagtccagcaccggggcgtagccattgccgatctgccccgggtggttcatgatgatcacctgcgccgtgaagctggcggcctccttggcggggtcgtccttggagttggacgccacgtagccgcgcttcaggtccttgaccgccacgttcttcacgttgaaccccacgttgtcgcccggcagcgcctcctgcatcgactcgtggtgcatctccaccgacttcacctccgtcgtcaggccggtgggcgcgaaggtgaccaccatgccgggcttcaggacgcccgtctccacgcggcccaccgggacggtgccgatgccgccgatcttgtacacgtcctgcaggggaaggcggaggggcttgtccgacggccgcttcggctcgttgatctggtccagcgcctccaggagggtcgggcccttgtaccagtccaggttcgtcgacctctcgatcatgttgtcaccttcaaacccggagatgggcacgaaggggatcttgtccgggttgtaccccaccttcttcaggtacgacgccacttccttcacgatctcgtcgtaccgagacttggagtacttgggggtgtatgttgttaccttgttgcagcagcagatcatctgcctgacaccaagcgtgaaggcaaggagggcgtgctcacgggtctggccgtccttggagataccggcctcaaagccaccggtggtggagtcgatgatgagcacggcgcaatcggcctgggaggtcccggtgatcatgttcttgatgaagtcacggtgcccaggggcgtcgatcacggtgcagtagtacttggtggtctcgaacttccacagggcaatgtcgatggtgatgcccctctcgcgctcggccttgagcttgtcgaggacccaggcgtacttgaaggacctcttgttcatctcggcagcctccttctcgaacctctcgatgacgcgcttgtcgatgcctcccagcttgtagatgaggtggccggtggtcgtggacttgccagagtcaacatggccgatgaccacgatgttgatgtgaaccttctccttacccatggctagaaag

SEQ ID NO: 1078 - DNA, 1643 bp, Ambrosia trifida
caaccattctctcagtcactctctctgctaatccatccatttcttcagcaaagattgtttgatttctcagaatgggtaaagaaaagattcatatcagcattgtcgtcattggacatgtcgactctggcaagtcaaccactacaggtcacttgatctataagttgggaggaatcgataagagagttatcgagaggtttgagaaggaagctgctgaaatgaacaaaaggtctttcaagtatgcctgggttcttgacaaactcaaagctgagcgagaacgtggaatcacaatcgatattgcattgtggaaatttgagaccaccaagtactactgtaccgtcattgatgctcctggacatcgtgatttcattaagaacatgattactggtacatctcaagctgattgtgctgtcttgattattgactctaccactggtgggtttgaagctggtatctctaaggatggtcagacccgagaacatgctctgcttgctttcactcttggtgtgaagcaaatgatctgctgttgtaacaagatggatgcaaccactcctaagtactccaaggcaaggtatgacgaaattgtgaaggaagtctcttcttacctgaagaaggttggttacaacccgagaaaatcccatttgtcccatctctggtttgaggtgacaacatgattgagaggtcgacaaacctcgactggtacaagggcccaacccttcttgaagctcttgaccagatcaacgagcccaagagaccctcagacaagccacttcgtctcccacttcaggatgtgtacaagatcggtggtattggaactgtgccagtgggacgtgttgagactggtgtgatcaagcctggtatggttgtcacctttggaccatctgggttgaccactgaagttaagtctgttgagatgcaccatgaagctcttcaagaggctcttcctggtgacaacgttgggttcaatgtcaagaacgttgcagtcaaggatctgaaacgtgggtatgttgcttccaactccaaggacgacccagctaagggtgcagccagtttcacctcacaggtcatcatcatgaaccaccctggtcagattggaaacggttatgctccagttctcgattgccacacttctcacatcgctgtcaagttctccgagcttttgaccaagatcgacagacgatccggaaaagagcttgagaaagagcccaagtttttgaagaacggagatgcaggtatggttaagatgcttccaaccaagcctatggtggtcgagactttcgcagagtacccacctcttggtaggtttgctgttcgtgacatgaggcagactgttgccgttggtgtgatcaagagtgttgacaagaaggacccgactggagctaaggtgaccaaggctgcagtcaagaagggtgccaagtgaatctgctggaccgatgaagctgttttaagtgcgtatttgaacaattttaattatgtttattttgtgtcaaggatttttggtattatgtgttgtggcttgcattcctgtactctagcctcgcttgcggggatgggtggaggtattgagcaacctgttgcttgatgacggtagtgcaagtttacaaacatccagattttgacttattgtgacttaaaaactaatatta

SEQ ID NO: 1079 - DNA, 1407 bp, Brassica juncea
gttctctcgcttagtttcgtagccgcaagactccctctcagattcttacttgcagctatgggtaaagagaagtttcacatcaacattgtggtcattggccatgtcgactctggcaaatcgactacaactggtcacttgatctacaagcttggtggtattgacaagcgtgtcatcgagaggttcgagaaggaggctgctgagatgaacaagaggtccttcaagtacgcctgtgttgttggacaaacttaaggctgagcgtgagcgtggtatcaccattgacattgctctctggaagtttgagaccaccaagtactactgcacagtcattgacgctcctggacatcgtgatttcatcaagaacatgattactggtacctcccaggctgattgtgctgttttgatcattgactccaccactggtgggtttgaagctggtatctctaaggatggtcagacccgtgagcatgctcttcttgctttcacccttggtgtcaagcagatgatttgctgctgtaacaagatggatgccactacccctaagtactccaaggctaggtacgatgagatcatcaaggaggtgtcttcctacttgaagaaggttggatacaaccctgacaaaatcccattcgtccccatctctgggttcgagggtgacaacatgattgagaggtccaccaaccttgactggtacaagggacctactctccttgaggctcttgaccagatcaacgagccaaagaggccatcagacaagcccctccgtctgccacttcaggacgtctacaagatcggtggtattggaacggtgccagtgggtcgtgtcgagaccggtatgctcaagcctggtatggttgtgacctttgctccttcagggctgaccactgaggttaagtctgttgagatgcaccacgagtctcttgtggaggctcttccaggtgacaacgttggattcaatgttaagaacgttgctgtcaaggatcttaagcgtgggtatgttgcatccaactccaaggatgatcctgctaaaggtgctgccaacttcacttcccaggtcatcatcatgaaccaccctggacagatcggtaacggatacgcgccagtgcttgattgccacacctcccacattgcggttaagttctctgagatcctcaccaagattgacaggcgttctggtaaggagatcgagaaggagcccaagtttttgaagaatggtgatgctggtatggtgaagatgactccgaccaagcccatggttgtcgagaccttctctgagtacccacccctcggacgtttcgctgtgagggacatgaggcagactgttgcagtcggtgtcatcaagagcgtggacaagaaggacccaaccggtgctaaggtcaccaaggctgcagttaagaagggagccaaatg

SEQ ID NO: 1080 - DNA, 1466 bp, Brassica juncea
ggcgccctcattaagttccctcgttcagtttcgtagccgcatctcacattcttacttgcagctatgggtaaagagaagtttcacatcaacattgtggtcattggccatgtggactctggaaaatcgaccaccactggtcacttgatctacaagctcggtggtattgacaagcgtgtcatcgagaggttcgagaaggaagctgctgagatgaacaagaggtccttcaagtacgcatgggtgttggacaaacttaaggctgagcgtgagcgtggtatcactattgatattgctctctggaagttcgagaccaccaagtactactgcacggtcattgatgctcctggtcatcgtgatttcatcaagaacatgattactggtacctcccaggctgattgtgctgttcttatcattgactctaccactggtggttttgaggctggtatctctaaggatggtcagactcgtgagcatgctcttcttgccttcacccttggtgtcaagcaaatgatttgctgctgtaacaagatggatgctactacccctaagtactccaaggctaggtacgatgagattatcaaggaggtgtcttcatacctgaagaaggttggatacaaccctgacaaaatcccattcgtccccatctctgggttcgaaggtgacaacatgattgagaggtccaccaaccttgactggtacaagggaccaactctccttgaggcacttgaccagatcaacgagcccaagaggccatcagacaagcccctccgtcttccacttcaggatgtctacaagattggtggaattggaacggtgccagtgggtcgtgttgaaaccggtatgctcaagcctggtatggttgtcacctttgcccttcagggttgaccactgaggttaagtctgttgagatgcaccatgagctcttgtggagcacttccaggtgacaacgttggattcaatgttaagaatgttgctgtcaaggatcttaagcgtgggtatgttgcatccaactccaaggatgatcctgccaagggtgccgctaacttcacatcacaggtcatcatcatgaaccaccctggtcagatcggtaacggttacgcaccagtccttgactgccacacttcccacattgcagtcaagttctctgagatcctgaccaagattgacaggcgatctggtaaagagattgagaaggagcccaagtttttgaagaatggagatgccggtatggtgaagatgactccgaccaagccaatggttgttgagactttctcagagtacccaccattgggacgttttgctgtcagagacatgagacagaccgtggctgttggagttatcaagagtgttgacaagaaggacccaaccggtgccaaggtcaccaaggctgctgtcaagaagggtgccaaatgatgagactctctccttaaaaaaaactttgattgtgtttgagcctttttaatattttt

SEQ ID NO: 1081 - DNA, 1705 bp, Fagus grandifolia
atgggtaaggaaaaggttcacattaacattgtggtcattggccatgtcgactctggaaagtcgaccaccactggacacttgatctacaagcttggaggaattgacaagcgtgtgatcgagaggttcgagaaggaggcagctgagatgaacaagaggtcattcaagtatgcctgggtgttggacaagcttaaggcagagcgtgagcgtggtattaccattgatattgccttgtggaaatttgaaaccaccaggtactactgcactgtcattgatgctcccggacatcgtgactttattaagaacatgattactggaacgtcacaggctgactgtgccgtcctgattattgactccaccactggaggttttgaggctggtatttctaaggatggtcagacccgtgagcatgctttgcttgctttcacccttggtgtcaagcagatgatttgctgttgtaacaagatggatgccacaaccccaagtactccaaggctaggtacgatgaaattgttaaggaagtctcatcctatttgaagaaggttggatacaacctgacaaatccccttgtccccatttctggttttgagggttgacaatatgattgagaggtctaccaacctcgactggtacaagggtcccaccctccttgatgctcttgaccagatctcagagcccaagagaccctcggacaagccccttcgtcttcctcttcaggatgtgtacaagatcggtggtattggaactgtgcctgttggacgtgttgagactggtgtcgtcaagcccggtatggttgtgacatttggccccactgggttgacaactgaagttaagtctgtggagatgcaccacgaagctctcctggaggcccttcctggtgacaatgttggcttcaacgtcaagaatgttgctgtgaaggatctcaagcgtggttttgttgcttccaactccaaggatgatcctgccagggaagctgccaacttcacctcccaggtcatcatcatgaaccaccctggtcagattggaaatggctatgctccagtccttgattgccatacctcccacattgctgttaagttcagtgagatcttgaccaagattgacaggcgatctggaaaggagcttgagaaggagcccaaatttttgaagaacggtgatgctggtatggttaagatgattcccaccaagcccatggttgttgagactttctctgagtatccacctcttggtcgttttgctgtgagggacatgcgtcagaccgttgctgttggtgtcatcaagagtgttgagaagaaggatccctctggtgccaaggtcaccaagtctgcagcaaagaagaagtgaaccgtgatggatcaacctcgtatttctgctacttactatcgttttgataatggttttgataaaaacttggtcatgtttggtactgctttagtttttcgtttgctttcttttgtgtgttatagttttataccgtcgttgttgggcagccaatctcagaattgggtgcttgataggcggtggcataacaattgcatagagttgaaggtgtttgttttcccttcttgttgggtcgaggtgcttcagattccttgaggtggctcaaaagttttgtttttatgtttggaattataaactagtctttgtttttgtctatttatattcgtagtcttgtggtttttcattatttactaataatgttcatgct

SEQ ID NO: 1082 - DNA, 1358 bp, Ricinus communis
atgggtaaggagaagattcacatcagcatcgtggtcattggacatgtcgactctggcaagtccaccaccactggacatctcatctacaagctcggaggtattgacaagcgtgtgattgagaggttcgagaaggaggctgctgagatgaacaagaggtcattcaagtatgcttgggtgctggacaagcttaaggctgagcgtgagcgtggtatcaccattgatattgccttgtggaaattcgagaccaccaagtactactgtactgtcattgatgctcctgggcatcgtgactttattaagaacatgattactggtacttcgcaggctgactgtgctgttcttatcattgattccactactggtggttttgaagctggtatttctaaggatgggcagacccgtgagcatgctcttcttgctttcacccttggtgtcaagcaaatgatttgctgctgcaacaaggtaatggtcaattactcccaagtactctaaggccaggtacgatgaaattgtcaaggaagtttcatcctatcttaagaaggtgggatacaaccccgacaaaattcctttcgttcccatctctgggttcgaaggtgacaatatgatcgagaggtccaccaacctggactggtacaagggtccaaccctacttgaagctcttgaccagatcaatgagccaaagaggccctcagacaaacctctccgtctcccacttcaagacgtatacaaaattggtggtattggaactgttcctgtgggtcgtgtagagactggtgtcctcaagcctggtatggtggtgacctttggacccagtggattgacaactgaaattaagtcagttgagatgcatcacgaggctctccaggaggccctccccggcgacaatgttggatttaacgtgaagaatgttgctgtgaaagatttgaagagaggttatgttgcatcaaactccaaggatgatcctgccaaggaagctgccaacttcacatcccaggttatcatcatgaaccaccctggccagattggaaatggatatgctccagttttggactgccacacctcccacattgctgtgaagtttgctgagatcttgaccaagatcgatcgccgatctggcaaggagcttgagaaggagcctaagttcttgaagaatggtgatgctgggtttgttaagatgattccaaccaagcccatggttgtcgagaccttctctgagtaccctccgttgggacgttttgctgtgagggacatgcgtcagactgttgctgtgggtgttatcaagagcgtggagaagaaggacccgagtggtgctaaggttacgaagtctgctgccaagaagggagggaaatgaatattgc

SEQ ID NO: 1083 - DNA, 1341 bp, Gossypium raimondii
cataatgggtaaggagaaggttcacatcaacattgttgttataggacatgtcgactctggaaagtcgaccaccactggtcacttgatctacaagcttggtggtatcgacaagcgtgtgatcgaaaggtttgagaaggaagctgctgagatgaacaagaggtcattcaagtatgcttgggtgcttgacaagttgaaagcagaacgtgagcgtggtattaccattgatattgccttgtggaagtttgagaccaccaaatactattgcactgtcattgatgctcccggacatcgtgactttatcaaaaacatgatcactggtacctctcaggctgactgtgctgtccttatcattgactccaccactggaggtttcgaggctggtatttcaaaggatgggcagacacgtgaacatgctttgcttgcctttactcttggtgtgaagcaaatgatttgttgttgcaacaaggtcaactcccaaatactcaaaggcaaggtacgatgaaatcgtgaaggaggtttcttcatacttgaagaaggttggttacaaccctgagaagattccattcgtccctatctctggttttgagggtgacaacatgattgagagatcgaccaaccttgattggtacaagggtccaactctgctcgaggctcttgaccagatcaatgagcccaagcgaccctctgacaagccccttcgtctcccacttcaggatgtctacaagattggtggtattggaactgtcccagtgggtcgtgttgaaactggtatcctcaagccaggtatggttgttactttcggtccttcgggattaaccactgaagttaaatccgttgaaatgcaccatgaggctctttccgaggctcttcctggtgacaatgtcggtttcaatgttaagaatgttgctgtcaaggatctcaagcgaggattcgttgcttctaactcaaaggatgatccagcaaaggaggcagccaacttcacctcccaagtcatcatcatgaaccatcctggccagattggaaacggatatgctcctgtccttgattgccacacctcccacattgctgtcaagttttcagaaatcttgaccaaaatcgatagacgatccggtaaggagcttgaaaaggagcccaagttcttgaagaacggcgatgctggattgattaagatggttcccaccaagcccatggttgtggaaaccttttccgagtatcccccactcggtcgtttcgctgtgagagacatgaggcagacagttgctgtcggtgtcatcaagaatgtggagaagaaggatccaactggagccaaggtaaccaagtccgctgccaagaagaagtgaa

SEQ ID NO: 1084 - DNA, 1587 bp, Phalaenopsis aphrodite
agctctcgtcggcagagccgcgccttcgtctcctcttgctagtagttttctccagccatgggtaaggagaaggtacacatcaacattgtggtcattggccatgtcgattccggcaagtccaccaccactggccatctcatttacaagcttggcggtattgacaagcgtgtgattgagaggtttgagaaggaggctgccgaaatgaacaagaggtcattcaaatatgcttgggttctcgacaagctcaaggctgagcgtgaaagaggaatcaccattgatatcgctctctggaaattcgagaccaccaagtattactgcactgttattgatgctcctggccatcgtgacttcatcaaaaacatgattactggaacttctcaggctgactgcgctgtcctgatcattgattccaccactggtggttttgaagctggtatctccaaggatggccagactcgcgagcatgctttgcttgctttcactcttggggtgaagcagatgatttgctgctgtaacaagatggatgccacacccccaagtattcaaaggctaggtatgatgaaatcatcaaggaagtctcctcctatctgaagaaggttggctacaaccctgagaagattccatttgttccgatctctgggtttgagggtgacaacatgatagagagatccacaaaccttgactggtacaaaggtccaactctcctcgaagctcttgacctgatccaagagccaaagaggccaacagacaagcccctccgcctcccccttcaggatgtctacaagatcggtggtattggcaccgtccccgtcggtcgagtcgagactggcgttttgaagcctggcatggtagtcacctttggtcccaccggtctcaccactgaagtaaagtctgttgagatgcaccatgaagctcttcaggaggccctccctggcgacaatgtcgggttcaatgtgaagaatgtcgcagtaaaagatctgaagagaggtttcgtcgcctcaaactccaaggatgatcctaccagggaagctgctaacttcacttcccaggtcatcataatgaaccaccctggtcagattggcaacggctacgctcccgtgctggactgccacacctcccacattgcagtcaaatttgccgaaatcctgaccaagatcgacaggcggtctggcaaggaactcgagaaggagcccaagttcctgaagaatggcgacgcgggtttcgtgaagatggttcccacgaagccgatggtggtcgagaccttctccgagtatcctccactgggccgtttcgccgtgagggacatgaggcaaactgtggctgttggagtcatcaagagcgtggagaagaaggatcccagtggagccaaggttaccaaatctgctgccaagaagaaataaagctgaaatgaataactcccgagtcttgtttatgttataaggttatctatgtgttggtctaatccggtgcagctttccagtatcagattccagatccggtgcttgatatgctgtggcggtgaggttttggtgtcttttatgctttttgtttcatgcgactgtttaatttggttgagttgagaagact

SEQ ID NO: 1085 - DNA, 1856 bp, Papaver somniferum
ctaacagccgcatgtggttgggaaacaaatcttccaaagatggcaaaggtgagaacatcgaacgcaacactaagcgtggtcttcataataaagtaggtggcggtccacataagcgaataaaatcaacggtggaacattaattttcggaacatcatccaacgatagagaatgaaaccctaatcgcgttatagggtttataaagaaagaggcctcacaatttgcagtctctactacttttctgaagaagctctgtgctgcggagcttttcttatcgccgttctgttattttctaagaattcaatatgggtaaagagaaggttcacatcaacattgtcgtcattggacatgtcgactctggtaaatcgaccactactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgcactgtggaagtttgagaccaccaagtactactgcacagttattgatgctcctggacatcgtgactttatcaaaaaccatgattactggtacttctcaggctgattgtgctgtcctcattatcgattctaccactggaggtttgtaggctggtatctcaaaggatggtcagactcgtgagcatgctcttcttgctttcaccttggtgtcaagcagatgatctgtgttgtaacagatggatgccaccacccccaagtactcaaaggctaggtacgatgaaattgtgaaggaggtctcatcttacttgaagaaggttggatacaacccagacaaaattgcctttgttccccatctctggattcgagggagacaacatgattgagaggtccaccaaccttgactggtacaagggaccaactcttctcgaggctcttgacaatatctctgagccaaagagaccctcagacaagccccttcgtcttccccttcaggatgtttacaagattggaggtattggaactgtgccagtgggacgtgttgaaactggattcatcaagcctggtatggttgttacctttggacccactgggttgaccactgaagttaagtctgtggagatgcaccacgaagcccttcaagaagctcttccaggagacaatgttgggttcaatgtcaagaatgttgcagtgaaggatctcaagcgtggtttcgtcgcctccaactccaaggacgaccctgccagggaagctgccaacttcacctcccaggtcatcatcatgaaccatcctggtcagatcggtaacggttatgctccagtcctcgactgtcacacatctcacattgctgttaagtttgctgagatcctcaccaagattgataggcgatctggaaaggagcttgagaaggagcccaagttcttgaagaatggtgatgctggtatcattaagatgcttccaacaaagcccatggttgtagagaccttctctcagtacccacctcttggtcgttttgctgttagggacatgaggcagacagttgctgttggtgttatcaaggaagttgagaagaaggacccaacaggagccaaggttaccaagtctgctgtcaagaagaaatgaagtgtgctgccaaggttaactagagggagagggatggtgctaagaggatctacaggagggacttatttctttactattagtcagtttgttttttgttttcgggcattaggtatcagtgtggtcttttgttttgtttcacctttgttttgttgcgcattcagttgcaaacctgggtgcttgacaggcggtggcaacaaggtgttgggctgtt

SEQ ID NO: 1086 - DNA, 1786 bp, Gossypium raimondii
ttttctcaatatatatactaggcagagcccttaccgcttaccccaattcttcattttcattttattgttccttccttcgccgtctactgctcttgtgacatcgatttcaagtgaatcagaatgggtaaggaaaagagtcacattaacattgtggtcattggccacgtcgattccggaaaatcgaccaccactggccacctgatctacaagcttggtggtattgacaagcgtgtgattgaaaggtttgagaaagaagctgcggagatgaacaagaggtcattcaagtatgcttgggtgcttgacaagctcaaggctgaacgtgagcgtggtatcaccattgatattgccttgtggaaatttgagacgaccaaatactactgcactgtgattgatgcgcctggacaccgtgactttatcaagaacatgattactggtacctcgcaggctgattgtgctgttttgattattgattccaccactggtggttttgaggctggtatctccaaggatggtcagactcgtgagcatgctttgcttgcttttacccttggtgtcaagcaaatgatttgctgttgcaacaaggtaaaaatcattatctgtttacatttcccctaaatactcgaaggctaggtatgatgaaatcgtgaaggaagtctcttcctacttgaagaaggttggatacaaccctgacaagattccatttgttcccatttctggttttgagggtgataacatgattgagaggtctaccaacttggactggtacaagggccctacacttcttgaggctcttgaccagatcaatgagcccaagaggccttcagacaagcctctccgtctaccacttcaggatgtgtacaagattggtggtattggaactgtcccggttggtcgtgttgaaactggtgtcttgaagcctggtatggttgtgacctttggtcctactggtctgaccactgaagttaagtctgttgagatgcaccatgaagctcttacagaggcacttcctggtgataatgttgggttcaatgttaagaatgttgctgttaaggatctcaagcgtggttatgttgcatccaactccaaggatgatcctgctaaggaggctgcaaacttcacttctcaggtcatcattatgaaccatcctggacaaattggaaacggatatgccccagtcctcgactgccacacctcacacattgctgttaagtttgctgaacttttgaccaagattgacaggcgatctggtaaggagcttgagaaggaacccaagttcttgaagaatggtgatgctggtatgattaagatgattcccaccaagcccatggttgtggagaccttctccgagtacccacccttgggccgttttgctgtgagggacatgcgtcagaccgtggctgttggtgttatcaagaatgttgagaagaaggacccatccggtgcaaaggtcaccaagtctgctgctaaaaagaagtgaaccgtgctggctaaacctaatgaagtttccgcagatggagtattttattatgataataatagtttgatagactttatcatttatgatatagttggtcttttgcttggttttgcatgttatagtgtgttgccattgttgtctggtaactgttctcagtattgggtgcttgacagacggtggcatagctatggcgggtggtctctagcgttatctggttttgtttaatttactactgtatcttgtcattgtcaagaggtgcccccttggttttccaaggtggcttgaaacttttgtttatgattttcgttg

SEQ ID NO: 1087 - DNA, 1497 bp, Ambrosia trifida
aggaaagattcatatcagcattgttgtcattggtcatgtcgactccggtaagtcgaccacaaccggtcatctcatctacaagttgggtgggattgacaagagggttatcgagaggtttgagaaagaagctgctgagatgaacaagaggtccttcaagtacgcttgggttcttgacaaactaaaggctgagcgtgaacgtggtatcaccattgatatcgctctgtggaagtttgagaccaccaagtattactgcactgttattgatgctcctggacatcgtgatttcattaagaacatgattactggtacttcccaggctgattgtgctgtgctgattattgactccaccactggtggttttgaagctggtatttccaaggatggtcagacccgtgaacacgctctgcttgcttttactcttggtgtgaagcaaatgatctgctgttgtaacaagatggatgcaaccactcctaagtactcaaaggcaaggtatgacgaaattgtgaaggaagtgtcatcgtacttgaagaaggtcggttacaacccagacaaaattccatttgtgcccatctctggatttgagggtgacaacatgattgagaggtctaccaaccttgactggtacaagggtccaacccttcttgaagctcttgaccagatcaacgagcccaagagaccctcagacaagccacttcgtctcccacttcaggacgtgtacaagatcggtggtattggaactgtgccagtgggacgtgttgagactggtgtgatcaagcctggtatggttgttacctttggaccatctgggttgaccactgaagttaagtctgttgagatgcaccatgaagctttacaagaggctctccctggtgacaacgttgggttcaatgtcaagaacgttgctgtcaaggatctgaaacgtggttacgttgcatccaactcaaaggatgaccctgctaagggtgctgcaagtttcacctcccaagtcatcatcatgaaccaccctggtcaaatcggaaacggttatgctccggttttggattgccacacatctcacattgccgtcaagttttctgagcttttgaccaagattgacagacggtctggaaaagagctggagaaggagcccaaatttttgaagaatggtgatgctggtatggttaagatgcttccgacaaagcccatggttgttgagacctttgctgagtacccaccacttggtcggtttgctgtccgtgacatgcgtcagactgttgctgttggtgttatcaagagcgttgacaagaaggacccaactggagctaaggtgaccaaggctgcagtgaagaagggagctaaatgaaacggtttgagtggttttatattttatgtaagtttttatcgttattttggaacttattttcattatttggttaagtaatttttggtaattggtctttttggagcttgcacttctgtactctagcctcacttgtgaggatgggtggaggtattgag

SEQ ID NO: 1088 - DNA, 1807 bp, Aquilegia formosa
ctatttctgcctctccttactttttaaagcttattagggtttcttcttcttcttcttcttcttcgcggcgctttaacttccattcctaagaatgggaaaagagaaagttcatatcaacattgtggtcattggccatgtcgactctggcaaatctaccaccactggacatttgatctacaagctaggaggtattgacaagcgtgtcattgaaaggttcgagaaagaggctgctgaaatgaacaagaggtcattcaagtatgcttgggtccttgacaaactcaaggctgaacgtgaacgtggtatcaccattgatattgccctatggaagtttgagaccacaaagtactactgcactgtcattgatgctccaggacatcgtgatttcattaagaacatgattactggaacttcccaggctgactgcgctgttctcatcattgactcaaccactggtggttttgaagctggtatctctaaggatggacagactcgtgagcatgccctgcttgctttcacccttggtgtcaagcagatgatctgctgttgtaacaagatggatgccaccaccccaaagtactctaaggctaggtatgatgaaattgtcaaggaagtctcttcctacctgaaaaaggttggttacaaccctgacaagattccatttgtacctatctctggattcgagggtgataacatgattgagaggtccaccaaccttgattggtacaagggcccaacccttcttgacgctcttgacaatatctcagaacccaagaggccaacagacaagcccctccgtctcccacttcaggatgtttacaagattggtggtattggaactgtgccagttggtcgtgttgagactggtgttctcaagcctggtatggttgttacctttggccccactggactgaccactgaagttaagtctgttgagatgcatcatgaggcactcacagaagccctccctggtgacaatgtgggattcaatgtgaagaatgttgctgttaaggatcttaagcgtggatactgtgcctccaactccaaggatgatcctgccagggaagctgccaacttcacttcccaagttatcatcatgaaccaccctggacagattggaaatggatatgctccagttcttgactgccacacctgccacattgctgttaagtttggtgagatccttaccaagattgacagacgatcaggaaaggagcttgagaaggagcctaagttcttgaagaacggtgatgctgggttcgttaagatgtttcctaccaagcctatggtggttgagaccttttctgagtatcctccactaggtcgttttgctgtcagggacatgcgtcagacagttgctgtgggagttatcaagagtgttgagaagaaggatcccagtggtgccaaggtcaccaagtctgctgccaagaagaaatgaaccgtggcggagtccgctgcttttgaagactgctattattactatcataaagacttggtatggtctattagttgctttgttggtttactatgtggttgttttggtcactacagtctactgtcttctcaatctcttgttagtctcatccagaattgggtgcttgacaggcggtggcaaagctttagacttctttccctttcagtttgttgagtcctgttgtagcctacgtcggttttggttgttgtgacatttcctgttttgtaatatgttggagtttttacatggatgctcctgcactctgaatgttatcctctgtatttggaagtaatacaggtatcatctgtttgagttatgggttacgtgcagatttct

SEQ ID NO: 1089 - DNA, 1683 bp, Arnica chamissonis
aaatcggcgatccacccaattttgcaagcagactatccaccaagatatctgagaatgggtaaagagaagattcatgtcagcattgtggtcattgggcatgttgactctggcaagtcaaccacaacaggccacctgatatacaagttaggtggaatagacaaaagagtaattgagaggtttgagaaagaagctgctgaaatgaacaagaggtctttcaaatatgcatgggttcttgacaaactaaaagctgaacgtgaacgtggtatcactattgacattgctttgtggaagtttgagaccaataagtattattgtacggttattgatgctcctggacatcgtgatttcatcaagaacatgattacgggtacctctcaggctgattgtgctgttctgattattgactcaaccactggtggtttcgaagctggtatttccaaagatggccagacccgtgaacatgctctacttgcctttactcttggtgttaggcaaatgatctgctgctgtaacaagatggatgcaaccacccccaagtactcaaagtcaagatatgaagaaattgtgaaggaagtctcatcctacatgaagaaggttggctacaacccggacaaaattccatttgtacccatctctggatttgagggtgacaacatgattgagaggtcaacaaatcttgactggtacaagggcccaactctcctagaagctcttgaccagatctatgagcccaaaagaccatctgacaaaccacttcgtttaccacttcaagatgtctacaagattggtggtattggaactgtccctgttggccgtgttgaaactggggttatcaaacctggtatggttgtcacctttggtccaactgggttgaccactgaagtcaagtcagttgagatgcaccatgaggctctaactgaagctctccccggtgacaacgttgggttcaatgtcaagaacgttgcggtcaaggatttgaaacgtggttatgttgcatccaactcaaaggacgaccctgctaagggtgcagccagtttcacctcacaggtcatcatcatgaaccaccccgggcaaattggaaatggttatgcccctgttcttgattgccacacctctcacatcgcggtcaagtttaaagagcttttgaccaaaattgaccggcgatctggaaaggagctggagaaggagcccaaatttttgaagaatggagatgctgggatggtccagatgattccgaccaagcccatggttgttgaaactttcgctgagtacccaccccttggtcggtttgcagttcgtgacatgcgtcagactgttgctgttggtgtgatcaagagtgttgacaagaaggacccgactggagctaaagtgaccaaggctgcagtcaagaagggagttaaatgacacagtgtgtgtgttatattcctaagtgatggtgatcgaatatttatcatattttgggactattttcattatgtctacttttggtcaaggattttgaatatttggttgttttggtgcttgcatttctgtactctagcctcacttgtgaggatgggtggaggtattgagcaactttgttgcttgatgacattggtgcaagttatcaaggagccagcttttgttggttggttgtgttcaactttatgcttttactagacatctttttgttatatttttttt

SEQ ID NO: 1090 - DNA, 1454 bp, Brassica juncea
tttcagtttcgcagccgcaagtctcctttcagattcttactcgcagctatgggtaaagagaagtttcacatcaacattgtggtcatcggccatgtcgactctggaaaatcgaccaccactggtcacttgatctacaagcttggtggtattgacaagcgtgtcatcgagaggttcgagaaggaagctgctgagatgaacaagaggtccttcaagtacgcatgggtgttggacaaacttaaggccgagcgtgagcgtggtatcaccatcgacattgctctctggaagttcgagaccaccaagtactactgcaccgtcattgatgctccgggacatcgtgatttcatcaagaacatgattactggtacctcccaggctgattgtgctgtcctcatcattgactccaccactggtggttttgaagctggtatctccaaggatggtcagacccgtgagcatgctcttcttgctttcacccttggtgtcaagcagatgatttgctgttgtaacaagatggatgccactacccctaagtactcaaaggctaggtacgatgaaatcatcaaggaggtgtcttcctacttgaaaaaggttgggtacaaccctgacaaaatcccattcgtccccatctctggattcgagggtgacaacatgattgagaggtccaccaaccttgactggtataagggaccaactctccttgaggctcttgaccagatcaacgagccaaagaggccctcagacaagcccctccgtctcccacttcaggatgtctacaagatcggtggtattggaacggtgccagtgggacgtgttgagaccggtatgctcaagcccggtatggttgtcacctttgctccttcagggttgaccactgaggttaagtctgttgagatgcaccacgagtctcttgtggaggcacttccaggtgacaacgttggattcaatgttaagaatgttgctgtcaaggatcttaagcgtgggtatgttgcatccaactccaaggatgaccctgctaagggagctgccaacttcacatcccaggtcatcatcatgaaccaccctggtcagatcggtaacggatacgccccagttctcgattgccacacatcccacattgcagtcaagttctctgagatcttgaccaagattgacaggcgatctggtaaggagatcgagaaggagcccaagtttttgaagaatggtgatgctggtatggttaagatgaccccgaccaagcccatggttgtcgagactttctctgagtacccaccgttgggacgtttcgctgttagggacatgaggcagaccgttgctgttggtgtcatcaagagtgttgacaagaaggacccaaccggtgccaaggtgaccaaggccgcagtgaagaagggagccaaatgatgagagacttctctcgtctttgtgttttctttgctttagaaaaaaaactttgatgg

SEQ ID NO: 1091 - DNA, 1631 bp, Brassica juncea
tctcgcattcttacttgcagctatgggtaaagagaagtttcacatcaacatcgtggtcatcggccatgtcgactctggaaaatcgaccacgactggtcacttgatctacaagctcggtggtattgacaagcgtgtcatcgagaggttcgagaaggaggctgctgagatgaacaagaggtccttcaagtacgcatgggtgttggacaaacttaaggctgagcgtgagcgtggtatcaccattgacattgctctctggaagttcgagaccaccaaatactactgcacagttattgatgctcctggtcatcgtgatttcatcaagaacatgattactggtacctcccaggctgattgtgctgttctgatcattgattccaccactggtgggtttgaagctggtatctccaaggatggtcagacccgtgagcatgctcttcttgccttcacccttggtgtcaagcagatgatttgctgctgcaacaagatggatgccactacccccaagtactccaaggctaggtacgatgagatcatcaaggaggtttcttcctacttgaagaaggttgggtacaaccctgacaaaatcccatttgtccccatctctggtttcgagggtgacaacatgattgagaggtccaccaaccttgactggtacaagggaccgactcttcttgaggctcttgaccagatcaacgagcccaagaggccatcagacaaacccctccgtctgccacttcaggatgtctacaagattggaggtattggaacggtgccagtgggtcgtgttgagactggtatgctcaagcctggtatggttgtgacctttgctccttccgggttgaccactgaggttaagtctgttgagatgcaccacgagtctcttgtggaagcacttccaggtgacaatgttggattcaatgtcaagaatgttgctgtcaaggatcttaagcgtgggtatgttgcatccaactccaaggatgaccctgccaagggagctgctaacttcacttcccaggtcatcatcatgaaccaccctggtcagatcggaaacggatacgcaccagtccttgattgccacacatcccacattgcagtcaagttctcagagatcctgaccaagattgacaggcgttctggtaaagagatcgagaaggagcccaagtttttgaagaatggtgatgctggtatggtaaagatgactccaaccaagcccatggttgttgaaaccttctccgagtacccaccattgggtcgtttcgctgttagggacatgaggcagacggtggctgttggtgtcatcaagagcgttgataagaaggacccaaccggagccaaggtgaccaaggctgccgtcaagaagggtgccaagtaaagtacctttagcaagagtctatcatccgaagacgattttagtttttttacattagtgtggtgtttggtcgtttgtttgtgttatagcttcgtctcttgtccgtcagaactatgttctcgtaattgggttcttgatcggaggtggcggagctatgttgaagtctagctttactgttttttgtttttacttttgctatcggattatgaactattttggatgttatgttattatgaatatggcatgagatcatttcgtttgc

SEQ ID NO: 1092 - DNA, 1400 bp, Brassica juncea
ctctcgcttagtttcgtagccgcaagactccctctcagattcttacttgcagctatgggtaaagagaagtttcacatcaacattgtggtcattggccatgtcgactctggcaaatcgactacaactggtcacttgatctacaagcttggaggtattgacaagcgtgtcatcgagaggttcgagaaggaggctgctgagatgaacaagaggtccttcaagtacgcgtgggtcttggacaaacttaaggccgagcgtgagcgtggtatcaccattgacattgctctctggaagttcgggaccaccaagtactactgcactgtcattgatgcccctggacatcgtgatttcatcaagaacatgattactggtacctcccaggctgattgtgctgtcctcatcattgactccaccactggaggttttgaggctggtatctccaaggatggtcagacccgtgagcatgctcttcttgctttcacccttggtgtcaagcaaatgatttgctgctgtaacaagatggatgccactacccctaagtactccaaggctaggtacgatgaaattatcaaggaggtgtcttcctacttgaagaaggttgggtacaacccagacaaaatccccttcgtccccatctctggtttcgagggtgacaacatgattgagaggtcaaccaaccttgactggtacaagggaccaactctccttgaagctcttgaccagatcaacgagcccaagaggccctcagacaagcccctccgtctcccacttcaggatgtctacaagatcggtggtattggaacggtgccagtgggacgtgttgagaccggtatgctcaagcccggtatggttgtgacctttgctccatcagggttgaccactgaggtgaagtctgttgagatgcaccacgagtcccttgtggaggcacttcccggtgacaatgtcggattcaacgtcaagaatgttgctgtcaaggatcttaagcgtgggtatgttgcatccaactccaaggatgaccctgccaagggtgctgccaacttcacctcccaagtcatcatcatgaaccaccctggtcagatcggtaacggttacgccccggttcttgattgccacacatcccacattgcagtcaagttctctgagatcctcaccaagattgacaggcgatctggaaaagagattgagaaggagcctaagttcttgaagaatggtgatgctggtatggttaagatgactccgaccaagcccatggttgtcgagactttctcagagtacccaccgttgggacgtttcgctgtcagggacatgaggcagaccgttgctgttggtgtcatcaagagtgttgacaagaaggacccaaccggtgccaaggtgaccaaggccgcagtgaagaagggagccaa

SEQ ID NO: 1093 - DNA, 1739 bp, Brassica juncea
aaacacgtagctacctctttcattttactccatctcgatcttttcttcaaccctagccgcattagctccgagattttacttgacatttaaccatgggtaaagagaagtttcacatcaacattgtggtcatcggccacgtcgactctggaaagtcaaccaccactggtcacttgatctacaagctcggtggtattgacaagcgtgtgatcgagaggtttgagaaggaggctgctgagatgaacaagagatctttcaagtacgcgtgggtgttggacaaactgaaggctgagcgtgagcgtggtatcaccatcgacattgctctctggaagttcgagaccaccaagtactactgcactgtcattgatgctcctggacatcgtgatttcatcaagaatatgattactggtacctcccaggctgattgtgcggttctcatcattgactccaccactggtggtttcgaagctggtatctccaaggatggtcagacccgtgagcatgccctccttgctttcacacttggtgtcaagcaaatgatttgctgctgtaacaagatggacgccaccactcctaagtactccaaggctaggtacgatgagattatcaaggaggtgtcttcctacttgaagaaggttgggtacaaccccgacaaaatcccattcgtccccatctctggattcgagggtgacaacatgattgagaggtccaccaaccttgactggtacaagggaccaactcttcttgaggctcttgaccagatcaacgagcccaagaggccctctgacaagcccctccgtctgccacttcaggatgtctacaagattggtggtattggaacggtgccagtgggtcgtgttgagactggtatgctcaagcctggtatggttgtgacctttgctccttcaggtttgaccactgaggtcaagtctgttgagatgcaccacgagtctcttgtggaggcgcttccaggtgacaacgtcgggttcaacgttaagaatgttgctgtcaaggatcttaagcgtgggtatgttgcatccaactccaaggatgaccctgccaagggtgctgccaacttcacttcccaggtcatcatcatgaaccaccctggtcagattggtaacggttacgccccagttcttgattgccacacctcccacattgccgtgaagttctctgagatcctcaccaagattgacaggcgttccggtaaggagatcgagaaggagcccaagtttttgaagaatggtgatgctggtatggtgaagatgactccgactaagcccatggttgttgagaccttctctgagtacccacccctcggacgtttcgctgtgagggacatgaggcagactgttgctgtcggtgtcatcaagagcgtggacaagaaggacccaaccggagccaaggtgaccaaggctgccgtcaagaagggtgcgaagtaaagtacaatcatcaactctctatcatccgcagatgaatcaaagtcctattttagttttcttgcattattagtttggttttctgtcgcttgcttgtgtaacagcttcgtttcatctccgtcagaactttcttctcgtaattgggttcttgatcggaggtggcggagctactaacctctcaagctttctactttttgcttctcttttgcatttggattatgaactgttttgaatatttgttatgaaaatggtgacgttcctgcggttattgtctgttttatcttttactttctgtcagcg

SEQ ID NO: 1094 - DNA, 1683 bp, Brassica juncea
agtacgcgggggcgctctcatttcagtttcgtagccgcaagtcctcctctcagattcttacttgcagctatgggtaaagagaagtttcacatcaacatcgtggtcattggccatgtcgactctgggaaatcgaccaccactggtcacttgatctacaagcttggtggtattgacaagcgtgtcattgagaggttcgagaaggaagctgctgagatgaacaagaggtctttcaagtacgcgtgggtgttggacaaacttaaggccgagcgtgagcgtggtatcaccattgatattgctctctggaagttcgagaccaccaagtactactgcacggtcattgatgcccctggtcatcgtgatttcatcaagaacatgattactggtacctcccaggctgattgtgctgtcctcatcattgactccaccactggtggttttgaagctggtatctccaaggatggtcagacccgtgagcatgctcttcttgctttcacccttggtgtcaagcaaatgatttgctgctgtaacaagatggatgccactacccccaagtactccaaggctaggtacgatgagatcatcaaggaggtgtcttcctacttgaagaaggttgggtacaaccctgacaaaatcccattcgtccccatctctggattcgagggtgacaacatgattgagaggtccaccaaccttgactggtacaagggaccaactctccttgaggctcttgaccagatcaacgagccaaagaggccctcagacaagcccctccgtctcccacttcaggatgtctacaagatcggtggtattggaacggtgccagtgggtcgtgttgagactggtatgctcaaacctggtatggttgtcacctttgctccttcagggttgaccactgaggttaagtctgttgagatgcaccatgagtctcttgtggaagcacttccaggtgacaacgttggattcaatgtcaagaatgttgccgtcaaggatctcaagcgtgggtatgttgcatccaactccaaggatgatcctgccaagggtgccgctaacttcacatcacaggtcatcatcatgaaccaccctggtcagatcggtaacggttacgcaccagtccttgactgccacacttcccacattgcagtcaagttctctgagatcctgaccaagattgacaggcgatctggtaaggagattgagaaggagcccaagtttttgaagaatggtgatgccggtatggtgaagatgactccaaccaagcccatggttgttgagaccttctctgagtacccaccccttggacgttttgccgtgagggacatgaggcagactgttgcagtcggtgttatcaagagcgttgacaagaaggacccaaccggagccaaggttaccaaggctgccgtcaagaagggtgccaagtgaactatcatcatccagactctatcatcctcaactgcagatgaaccaaagaactttgtgtgttttcctactctagtttggtacgttgttgcttgtttgtgttacagtttcgtcccttctccgtcagaacgtaattctcgtaattgggttcttgataggaggtggcggagcttcgtcacataaaagcagcattgtttttgctttacatttgttatctgaattttgagacttcttttcatattatgttatcatatggtgacattcctg

SEQ ID NO: 1095 - DNA, 1776 bp, Brassica juncea
gttctctctctcagtttcttagccgcaagactccttccagattcttacttgcagctatgggtaaagagaagtttcacatcaacattgttgtcattggccatgtcgactctggaaaatcgactacaactggtcacttgatctacaagcttggtggtattgacaagcgtgtcatcgagaggttcgagaaggaggctgctgagatgaacaagaggtccttcaagtacgcgtgggtgttggacaaacttaaggctgagcgtgagcgtggtatcaccattgatattgctctctggaagttcgagaccaccaagtactactgcactgtcattgatgcccctggacatcgtgatttcatcaagaacatgattactggtacctcccaggctgattgtgctgttcttatcattgactccaccaccggaggttttgaggctggtatctctaaggatggtcagacccgtgagcatgctcttcttgctttcacccttggtgtcaagcaaatgatttgctgctgtaacaagatggatgccactacccccaagtactccaaggctaggtacgatgagatcatcaaggaggtgtcttcctacttgaagaaggtcggatacaaccctgacaaaatcccattcgtccccatctccggtttcgagggtgacaacatgattgagaggtccaccaaccttgactggtacaagggaccaactctacttgaggctcttgaccagatcaatgagccaaagaggccatcagacaagcccctccgtctcccactccaggatgtctacaagatcggtggtattggaacggtgccagtgggtcgtgttgagactggtatgctcaaacctggtatggttgtcacctttgctccttcagggttgaccactgaggttaagtctgttgagatgcaccatgagtctcttgtggaagcacttccaggtgacaacgttggattcaatgtcaagaatgttgccgtcaaggatctcaagcgtgggtatgttgcatccaactccaaggatgatcctgccaagggtgccgctaacttcacatcacaggtcatcatcatgaaccaccctggtcagatcggtaacggttacgcaccagtccttgactgccacacttcccacattgcagtcaagttctctgagatcctgaccaagattgacaggcgatctggtaaggagattgagaaggagcccaagtttttgaagaatggtgatgccggtatggtgaagatgactccgaccaagccaatggttgttgagactttctcagagtacccaccattgggacgttttgctgtcagagacatgagacagaccgtggctgttggagttatcaagagtgttgacaagaaggacccaaccggtgccaaggtcaccaaggctgctgtcaagaagggtgccaaatgatgagactctctccttaaaaaaaactttgattgtgtttgagcctttttaatatttttctgcgactctctctgcctttttggatagctctgagacatggtttcaattatgcagtttgtgtatgattttgcctaatgattgttagtgtttcttgttcttgattgtccttgtttgctattactcatccagagttttaacccaggctattcaagattttgttgggacgtaatgacagacatggtttcaataagcgtttggtaatcacaaacaataacccttggtgttcaagcttcacttttcaagagttttattgtaagggttgatagattgtgtggtttaaacgtttcagcacaaatctaagttaagattgttg

SEQ ID NO: 1096 - DNA, 1510 bp, Brassica juncea
gaccttagcctcgatctttcttcaacctagccgcaacactttactgagatttactaagtagccatgggtaaagagaagtttcacatcaacatcgtggtcattggccacgtcgactctggaaagtcgaccaccactggtcatttgatctacaagcttggtggtattgacaagcgtgtcattgagaggttcgagaaggaggctgctgagatgaacaagaggtccttcaagtacgcatgggtgttggacaaacttaaggctgagcgtgagcgtggtatcaccattgacattgctctctggaagttcgaaaccaccaagtactactgcacggtcattgatgcccctggacatcgtgatttcatcaagaacatgattactggtacctcccaggctgattgtgctgtcctcatcattgactccaccactggtggttttgaagctggtatctctaaggatggtcagacccgtgagcatgctcttcttgctttcacccttggtgtcaagcaaatgatttgctgttgtaacaagatggacgccactacccccaagtactccaaggctaggtacgatgaaatcatcaaggaggtgtcttcctacttgaagaaggtgggatacaaccctgacaaaatcccattcgtccccatctctgggttcgagggtgacaacatgattgagaggtccaccaacctcgactggtacaagggaccaactctccttgaggctcttgaccagatcaacgagcccaagagaccctcagacaagcccctccgtctcccacttcaggatgtctacaagatcggtggtattggaacggtgccagtgggacgtgttgagaccggtatgctcaagcccggtatggttgtgacctttgctccttcagggttgaccactgaggttaagtctgttgagatgcaccacgagtctcttgtggaggcacttccaggtgacaacgttgggttcaatgttaagaatgttgctgtgaaggatcttaagcgtgggtatgttgcatctaactccaaggatgacccagctaagggagctgccaacttcacatcccaggtcataatcatgaaccaccctggtcagatcggtaacggatacgccccagtcctcgattgccacacgtcccacattgcagtcaagttctctgagatcttgaccaagattgacaggcgatctggtaaggagatcgagaaggagcccaagtttttgaagaatggtgatgctggtatggttaagatgactccaaccaagcccatggttgtcgagactttctcagagtacccaccgttgggacgtttcgctgtcagggacatgaggcagaccgttgctgttggtgtcatcaagagtgttgacaagaaggacccaaccggtgccaaggtgaccaaggccgcagtgaagaagggagccaaatgatgagacttctctcgtctttgtgttttctttgcttttaaaaaaactttgatggcgtttgagcctttgttcttttattttctgtgactttctcatctct

SEQ ID NO: 1097 - DNA, 1561 bp, Brassica juncea
ctagatcttctgccgcatcgatatcgcttagctgagattagcttgacaagtagccatgggtaaagagaagtttcacatcaacattgtggtcattggtcatgtcgactctggaaaatcgaccacaactggtcatttgatctacaagcttggtgggattgacaagcgtgtgattgagaggttcgagaaggaagctgctgagatgaacaagaggtccttcaagtacgcatgggtgttggacaaacttaaggctgaacgtgagcgtggtatcaccattgacattgctttgtggaagtttgagaccaccaagtactactgtactgtcattgatgcacctggacatcgtgatttcatcaagaacatgattactggtacctcccaggctgattgtgctgtcctcatcattgactccaccactggtggttttgaagctggtatctccaaggatggtcagacccgtgagcatgctcttcttgctttcaccctcggtgtcaagcagatgatttgctgctgtaacaagatggatgccactacccccaaatactctaaggctaggtacgatgagattatcaaggaagtgtcttcctacttgaagaaggttgggtacaaccctgacaaaatcccattcgtccccatctctggattcgagggtgacaacatgattgagaggtccaccaaccttgactggtataagggaccaactctccttgaggctcttgaccagatcaacgagccaaagaggccctcagacaagcccctccgtctcccacttcaagatgtctacaagatcggtggtattggaacggtgccagtgggacgtgttgagaccggtatgctcaagcccggtatggttgtgacctttgctccttcagggttgaccactgaggttaagtctgttgagatgcaccacgagtctcttgtggaagcacttcctggtgacaacgttggattcaatgtcaagaacgttgctgtcaaggatcttaagcgtgggtatgttgcatccaactccaaggatgaccctgccaagggagctgccaacttcacttcccaggtcatcatcatgaaccaccctggccagatcggaaatggatacgccccagttcttgattgccacacctcccacattgcagtcaagttctctgagatcctcaccaagattgacaggcgttctggtaaagagatcgagaaggagcccaagtttttgaagaatggtgatgctggtatggtgaagatgactccgaccaagcccatggttgttgagacattctctgagtacccaccattgggtcgtttcgctgtcagggacatgaggcagaccgtggctgttggtgtcatcaagagtgtggacaagaaggacccaaccggagccaaggtgaccaaggctgccgtcaagaagggtgccaaataaagttccttctgtacaactctatcatccgcagttgaatcgaaagacagttttagttttattacattagtttggtatttggtcgcttgtttatgttgtagctttgtttcatctccatcacaactctgttctcgtaactgggttcttgatcggaggtgg

SEQ ID NO: 1098 - DNA, 1673 bp, Brassica juncea
ggtgctctcatttcagtttcgtagccgcaagtcctcctctcagattcttacttgcagctatgggtaaagagaagtttcacatcaacattgtggtcattggccatgtcgactctggaaaatcgaccaccactggtcacttgatctacaagcttggtggtattgacaagcgtgtgatcgagaggttcgagaaggaagctgctgagatgaacaagaggtccttcaagtacgcatgggtgttggacaaacttaaggctgagcgtgagcgtggtatcaccattgatattgctctctggaagttcgagaccaccaagtactactgcacagtcattgatgctcctggacatcgtgatttcatcaagaacatgattactggtacctcccaggctgattgtgctgtcctcatcattgactccaccactggtggttttgaggctggtatctccaaggatggtcagacacgtgagcatgctcttcttgctttcacccttggtgtcaagcagatgatttgctgctgtaacaagatggatgccaccacccccaagtactccaaggctagatacgatgagatcatcaaggaggtgtcttcttacttgaagaaggttggatacaaccctgacaaaatcccattcgtcccgatctctggttttgagggtgacaacatgattgagaggtccaccaacctcgactggtacaagggaccaactctccttgaggcacttgaccagatcaacgagcccaagaggccatcagacaagccgcttcgtctcccacttcaggatgtctacaagattggtggtattggaacggtgccagtgggtcgtgttgagacaggtatgctcaagcctggtatggttgtgacctttgctccttcagggttgaccactgaggttaagtccgtggagatgcaccacgagtctcttgtggaggcacttccaggtgacaacgtgggtttcaatgtcaagaatgtcgctgtcaaggatctcaagcgtgggtatgttgcgtccaactccaaggatgacccagctaagggtgctgccaacttcacttcccaggtcatcatcatgaaccacccgggtcagattggtaatggttacgcacctgttcttgactgccacacttcccacattgctgtcaagttctctgagatcctcaccaagattgacaggcgttctggtaaagagatcgagaaggagcccaagttcttgaagaatggtgacgctggtatggtgaagatgactccgaccaagcccatggttgttgagaccttctctgagtacccacctcttggacgttttgctgtgagggacatgaggcagactgttgcagtcggtgtcatcaagagcgttgacaagaaggacccgaccggagccaaggttaccaaggctgccgtcaagaagggtgccaagtgaactacctcgaggaaaactctatcatccgcagttgaatcaaaagacaattttagtttttttactttagtatggtatttggtcgcatgtttgtgtttcaggtttgtttcttccccgtcggagctctgttctcgtaactgggttcttgatcggaggtggcgaagctactcattactctagcttccttcttttttactttgttttgctttcggattctgaactattttggatactcttttataatgaatatggtattcctgcggttaa

SEQ ID NO: 1099 - DNA, 1505 bp, Brassica juncea
ggtctcactcatcagtttcgtagccgcatctctcacattctaactcgcagctatgggtaaagagaagtttcacatcaacattgtggtcatcggccatgtcgactctggaaaatcgaccaccactggtcacttgatctacaagctcggtggtattgacaagcgtgtcatcgagaggttcgagaaggaggctgctgagatgaacaagaggtccttcaagtacgcctgggtcttggacaaacttaaggccgagcgtgagcgtggtatcaccattgatatcgctctctggaagttcgagaccaccaagtactactgcacggtcattgacgctcctggacatcgtgatttcatcaagaacatgattactggtacctcccaggctgattgtgctgttttgatcattgactctaccactggtggtttcgaggctggtatctccaaggatggtcagacccgtgagcatgctcttcttgctttcacccttggtgtcaagcagatgatttgctgctgtaacaagatggatgctactacccctaagtactccaaggctaggtacgatgagatcatcaaggaggtgtcttcctacttgaagaaggttgggtacaaccctgacaaaatcccattcgttccaatctctgggttcgagggtgacaacatgattgagaggtccaccaaccttgactggtacaagggaccaactctccttgaggctcttgaccagatcaacgagccaaagaggccctcagacaagcccctccgtctcccacttcaggatgtctacaagatcggtggtattggaacggtgccagtgggacgtgttgagaccggtatgctcaagcccggtatggttgtgacctttgctccttcagggttgaccactgaggttaagtctgttgagatgcaccacgagtctcttgtggaggcactcccaggtgacaacgttgggttcaatgttaagaacgttgctgtcaaggatcttaagagagggtatgttgcatccaactccaaggatgaccctgctaagggagctgccaacttcacatcccaggtcatcatcatgaaccaccctggtcagatcggtaacggatacgccccagtcctcgattgccacacatcccacattgcagtcaagttctctgagatcttgaccaagattgacaggcgatctggtaaggagatcgagaaggagcccaagtttttgaagaatggtgatgctggtatggttaagatgactccgaccaagcccatggttgtcgagactttctcagagtacccaccattgggacgtttcgctgtcagggacatgaggcagaccgttgctgttggtgtcatcaagagcgttgacaagaaggacccaaccggtgccaaggtgaccaaggccgcagtgaagaagggagccaaatgatgagagacttctctcgtctttgtgttttctttgacttttaaaaaaaaaactttgatggcgtttgagcctttgttcttttattttctgttactttctataaaaa

SEQ ID NO: 1100 - DNA, 1731 bp, Brassica juncea
tagagctcgtagctataaatactctgtgttgttcattgagctcactctcctttcgttctctcgcttagtttcgtagccgcaaagactcctctcagattcttaacttgcagctatgggtaaagagaagtttcacatcaacattgtggtcattggccatgtcgactctggaaaatcgaccacaactggtcacttgatctacaagcttggtggtattgacaagcgtgtgatcgagaggttcgagaaggaggctgctgagatgaacaagaggtccttcaagtacgcgtgggttttggacaaacttaaggccgagcgtgagcgtggtatcaccattgacattgctctctggaagttcgagaccaccaagtactactgcactgtcattgatgctcctggtcatcgtgatttcatcaagaacatgattactggtacctcccaggctgattgtgctgttcttatcattgactctaccactggtggttttgaggctggtatctccaaggatggtcagacccgtgagcatgctcttcttgctttcacccttggtgtcaagcaaatgatttgctgctgtaacaagatggatgccactacccccaagtactccaaggctaggtacgatgagatcatcaaggaggtgtcttcctacttgaagaaggtcgggtacaaccctgacaaaatcccattcgtccccatctctggattcgagggtgacaacatgattgagaggtccaccaaccttgactggtacaagggaccaactctccttgaggctcttgaccagatcaacgagccaaagaggccttcagacaagcccctgcgtctaccacttcaggatgtctataagatcggtggtattggaacggtgccagtgggtcgtgtggagactggtatgctcaagcccggtatggttgtgacattcgctccttcagggttaaccactgaggtcaagtccgttgagatgcaccacgagtctcttgtggaagcgcttcctggtgacaatgtcggattcaatgtcaagaatgttgccgtcaaggatcttaagcgtgggtatgttgcatccaactccaaggatgatcctgctaagggagctgctaacttcacatcccaggtcatcatcatgaaccaccctggtcagatcggtaacggttacgcccctgtccttgattgccacacctcccacattgcagtcaagttctctgagatcctcaccaagattgacagacgatctggtaaagagatagagaaggagcccaagtttttgaagaatggagatgctggtatggtgaagatgactccgaccaagcccatggttgttgagacgttctcagagtacccaccattgggacgtttcgctgttagggacatgaggcagactgttgctgttggtgtcatcaagagcgttgacaagaaggacccaaccggtgccaaggtcaccaaggctgcagtcaagaagggtgctaaatgatgagacttctctattacttttaaaaaaactttgatggcgtttgagcctttttcttatattttctgcgacatggtttcaattatgcagtttgtggatggttttggctaatgatttttagtgcttctttgttcttgaatgtccttgttagttgcttttactcatctagagtttttagaccagtctgttcaagattttgttgggaagcaacgactagaaaacgtttaaaccccttggtgttcaatattcaattttcatgagatttataagac

SEQ ID NO: 1101 - DNA, 1570 bp, Brassica juncea
agctatgggtaaagagaagtttcacatcaacatcgtggtcattggccacgtcgactctggaaagtcgaccaccactggtcacttgatctacaagcttggtggtattgacaagcgtgtcatcgagaggttcgagaaggaagctgctgagatgaacaagaggtccttcaagtacgcgtgggtgttggacaaactgaaggctgagcgtgagcgtggtatcaccattgacattgctctctggaagttcgagaccaccaagtactactgcacggtcattgatgctcctggacatcgtgatttcatcaagaacatgattactggtacctcccaggctgattgtgctgtccttatcattgactctaccactggtggttttgaggctggtatctctaaggatggtcagacccgtgagcatgctcttcttgctttcacccttggtgtcaagcaaatgatttgctgctgtaacaagatggatgccacaacccccaagtactccaaggctaggtacgatgagatcatcaaggaggtgtcttcatacttgaagaaggttgggtacaacccagacaaaatcccattcgtccccatctctgggttcgagggtgacaacatgattgagaggtcaaccaaccttgactggtacaagggaccaactctccttgaagctcttgaccagatcaacgagcccaagaggccttcagacaagcccctccgtctcccacttcaggatgtctacaagatcggtggtattggaacggtgccagtgggacgtgttgagaccggtatgctcaagcccggtatggttgtgacattcgctccatcagggttgaccactgaggtgaagtctgttgagatgcaccacgagtctcttgtggaggcacttccaggtgacaacgttgggttcaatgttaagaatgttgctgtgaaggatcttaagcgtgggtatgttgcatctaactccaaggatgacccagctaagggagctgccaacttcacatcccaggtcataatcatgaaccaccctggtcagatcggtaacggatacgccccagtcctcgattgccacacgtcccacattgcagtcaagttctctgagatcttgaccaagattgacaggcgatctggtaaggagatcgagaaggagcccaagtttttgaagaatggtgatgctggtatggttaagatgactccaaccaagcccatggttgtcgagactttctcagagtacccaccgttgggacgtttcgctgtcagggacatgaggcagaccgttgctgttggtgtcatcaagagtgttgacaagaaggacccaaccggtgccaaggtgaccaaggccgcagtgaagaagggagccaaatgatgagacttctctcgtctttgtgttttctttgcttttaaaaaaactttgatggcgtttgagcctttgttcttttattttctgtgactttctcatctctacctcctttttttttcatatctctgagacttatgggttacaattatgcagtttctggataattttgcgtagtgtgttttagtgttttgttttgctacaaattaattttctttgttctgg

SEQ ID NO: 1102 - DNA, 1430 bp, Brassica juncea
catttacttctctcactcagtatcgtagccgcatctcgcattcttacttgcagctatgggtaaagagaagtttcacatcaacatcgttgtcattggccatgtcgactctggaaaatcgaccacgactggtcacttgatctacaagctcggtggtattgacaagcgtgtcatcgagaggttcgagaaggaggctgctgagatgaacaagaggtccttcaagtacgcgtgggtgttggacaaacttaaggccgagcgtgagcgtggtatcaccattgatatcgctctctggaagttcgagaccaccaagtactactgcacggtcattgatgctcccggacatcgtgatttcatcaagaacatgattactggtacctcccaggctgattgcgctgtcctcatcattgactctaccactggtggttttgaggctggtatctccaaggatggccagacccgtgagcacgctcttcttgctttcacccttggtgtcaaacaaatgatttgctgctgtaacaagatggatgccactacccccaagtactccaaggctaggtacgatgagatcatcaaggaggtgtcttcctacttgaagaaggtcggatacaaccctgacaaaatcccattcgtccccatctctgggttcgagggtgacaacatgattgagaggtccaccaaccttgactggtacaagggaccaactctccttgaggcacttgaccagatcaacgagcccaagaggccctcagacaagcccctccgtctcccacttcaggatgtctacaagatcggtggtattggaacggtgccagtgggacgtgttgagacaggtatgctcaagcctggtatggttgtgacattcgctccatcagggttgaccactgaggtcaagtctgttgagatgcaccacgagtctcttgtggaggcacttccaggtgacaacgttggattcaatgtcaagaatgttgccgtcaaggatctcaagcgtgggtatgttgcatcgaactccaaggatgaccctgccaagggtgctgctaacttcacttcccaggtcatcatcatgaaccaccctggtcagatcggtaacggttacgccccagtgcttgattgccacacctcccacattgcagtcaagttctctgagatcctcaccaagattgacagacgttctggtaaagagatcgagaaggagcctaagtttttgaagaatggagatgctggtatggtcaagatgactccaaccaagcccatggttgttgagactttctcagagtaccctccattgggacgtttcgctgtcagggacatgaggcagaccgttgctgtcggagtcatcaagagtgttgacaagaaggacccaaccggtgccaaggtcaccaaggctgctgtcaagaagggtgccaaatgatgagactttctctcttctttggttc

SEQ ID NO: 1103 - DNA, 1651 bp, Brassica juncea
gagttctctctcgctacagttttcacagccgcaagactgctctcagattcttacttgcagctatgggtaaagagaagtttcacatcaacattgtggtcattggccatgtcgactctggcaaatcgactacaactggtcacttgatctacaagcttggaggtattgacaagcgtgtcatcgagaggttcgagaaggaggctgctgagatgaacaagaggtccttcaagtacgcgtgggtcttggacaaacttaaggccgagcgtgagcgtggtatcaccattgacattgctctctggaagttcgagaccaccaagtactactgcactgtcattgatgcccctggacatcgtgatttcatcaagaacatgattactggtacctcccaggctgattgtgctgttcttatcattgactctaccactggtggttttgaagctggtatctccaaggatggtcagacccgtgagcatgctcttcttgccttcacccttggtgtcaagcaaatgatttgctgctgtaacaagatggatgccactacccccaagtactccaaggctaggtacgatgagatcatcaaggaggtgtcttcctacttgaagaaggtcgggtacaaccctgacaaaatcccattcgtccccatctctggattcgagggtgacaacatgattgagaggtccaccaaccttgactggtacaagggaccaactctccttgaggctcttgaccagatcaacgagccaaagaggccttcagacaagcccctgcgtctaccacttcaggatgtctacaagatcggtggtattggaacggtgccagtgggtcgtgtggagactggtatgctcaagcccggtatggttgtgacattcgctccttcagggttgaccactgaggtcaagtccgttgagatgcaccacgagtctcttgttgaagcgcttccaggtgacaacgtgggtttcaatgttaagaatgttgccgtcaaggatcttaagcgtgggtatgttgcatccaactccaaggatgaccctgccaagggagctgctaacttcacttcccaagtcatcatcatgaaccaccctggtcagatcggtaacggttacgcccctgtccttgattgccacacctcccacattgcagtcaagttctctgagatcctcaccaagattgacagacgatctggtaaagagatcgagaaggagcctaagtttttgaagaatggagatgctggtatggtgaagatgactccaaccaagcccatggttgttgagactttctcagagtacccacctttgggacgtttcgctgttagggacatgaggcagaccgtggctgttggtgtcatcaagagtgttgacaagaaggacccaaccggtgccaaggtcaccaaggctgcagtcaagaagggtgccaaatgatgagacttatctcttgcttggttcactttgctttaaaaaactttgatgtgtttgaggctttttttttttacaactctcatctctctacctttttttgatatctctgttacttatggttttagttatgcattttctggataattttgccaatgctttttagtgttcattgaatgtttattgaagttgcttgtccttatcttagagtttaacagtaggctgttcaagattttgtcggacaa

SEQ ID NO: 1104 - DNA, 1583 bp, Brassica juncea
atttcagtttcgtagccgcaagtcctcctctcagattcttacttgcagctatgggtaaagagaagtttcacatcaacattgtggtcattggccatgtcgactctggaaaatcgaccaccactggtcacttgatctacaagcttggtggtattgacaagcgtgtcatcgagaggttcgagaaggaagctgctgagatgaacaagaggtctttcaagtatgcgtgggtgttggacaaactgaaggctgagcgtgagcgtggtatcactattgacattgctctctggaagtttgagaccaccaagtactactgcactgtcattgatgctcctggacatcgtgatttcattaagaacatgattactggtacctcccaggctgattgtgctgtcctgatcattgattctaccactggtggttttgaagctggtatctccaaggatggtcagacccgtgagcatgctcttcttgccttcacccttggtgtcaagcagatgatttgctgctgtaacaagatggatgcaactactcccaagtactccaaggctaggtacgatgagatcatcaaggaggtgtcttcctacttgaagaaggttggatacaacccggacaaaatcccattcgtccccatctctggttttgagggagacaacatgattgagaggtccaccaaccttgactggtacaagggaccaactctccttgaggcacttgaccagatcaacgagcccaagaggccatcagacaagcccctccgtcttccacttcaggacgtctacaagattggtggtattggaacggtgccggtgggtcgtgttgagaccggtatgctcaagcctggtatggttgtgacctttgctccatcagggttgaccactgaggttaagtctgttgagatgcaccacgagtctcttgtggaggcacttccaggtgacaacgtcggattcaatgtcaagaatgttgctgtgaaggatcttaagcgtgggtatgttgcgtccaactccaaggatgaccctgccaagggagctgctaacttcacttcccaggtcatcatcatgaaccaccctggtcagatcggaaacggatacgcaccagtccttgattgccacacatcccacattgcagtcaagttctcagagatcctcaccaagattgacaggcgttctggtaaggagatcgagaaggagcccaagtttttgaagaatggtgatgctggtatggtgaagatgactccgaccaagcccatggttgtcgagaccttctctgagtacccaccccttggacgttttgccgtgagggacatgaggcagactgttgcagtcggtgtcatcaagagcgttgacaagaaggacccaaccggagccaaggtcaccaaggctgccgtcaagaagggtgccaaataaagtaccttgagcaaaactctatcatccgcagttgaatcgaaagactattttagttttgttttgttagtttggtatttggttgcttgtttgtgttgcagcttcgtttcgtctccgtcagaactacgttctcgtaactgggttcttgatcggaggtggcggagccacattgcatgctagcttcct

SEQ ID NO: 1105 - DNA, 1493 bp, Brassica juncea
ctcttcttccaacctagccgctacacctctgagatttttacttaagccatgggtaaagagaagtttcacatcaacattgtggtcatcggccacgtcgactccgggaagtcaaccaccacgggtcacttgatctacaagctcggtggtatcgacaagcgtgtgatcgagaggttcgagaaggaggctgctgagatgaacaagaggtccttcaagtacgcgtgggtgttggacaagcttaaggctgagcgtgagcgtggtatcaccattgatattgctctttggaagtttgagaccaccaagtactactgcacggttattgacgctcctggtcatcgtgatttcatcaagaacatgatcactggtacctcccaggctgattgtgctgttttgattattgactccactactggtgggttcgaggctggtatctctaaggatggtcagactcgtgagcatgctcttcttgctttcacacttggtgtcaagcagatgatttgctgctgtaacaagatggatgctactacccccaagtactccaaggcgaggtacgatgagattatcaaggaggtgtcttcctacttgaagaaggttgggtacaaccctgacaaaatccccttcgtccccatctctggtttcgagggtgacaacatgattgagaggtccaccaaccttgactggtacaagggaccaactctccttgaggcgcttgaccagatcaacgagccaaagaggccctcggacaagccccttcgtctaccacttcaggatgtctacaagattggtggtattggaacggtgccagtgggtcgtgttgagaccggtatgctcaagcctggtatggttgtgacctttgctccttcagggttgaccactgaggttaagtctgttgagatgcaccacgagtcacttgttgaggcgcttccaggtgacaatgtcgggttcaacgtgaagaatgttgctgtcaaggatctcaagcgtgggtatgttgcatccaactccaaggatgatcctgccaagggtgctgctaacttcacctcccaggtcatcatcatgaaccaccctgggcagatcggtaacggttacgccccggttcttgactgccacacgtcccacattgccgtgaagttctctgagatcctcaccaagatcgacaggcgttctggtaaggagattgagaaggagcccaagtttttgaagaatggtgatgctggtatggtgaagatgactccgaccaagcccatggttgttgagaccttctctgagtacccaccacttggacgtttcgctgtgagggacatgaggcagactgttgcagtcggtgtcatcaagagcgttgacaagaaggacccaaccggagccaaggtgaccaaggctgccgtcaagaagggtgccaagtaaagtacctcgaggaaaactctatcatccgcagttgaatcaaaagactaattttagtttgttttgttagtttggtatttggttgcttgtttgtgtcg

SEQ ID NO: 1106 - DNA, 1496 bp, Brassica juncea
atctcgatctttcttcaaccttagccgctactcactgagattcatttgacaagtagctatgggtaaagagaagtttcacatcaacattgtggtcatcggccacgtcgactctggaaagtcaaccaccactggtcacttgatctacaagcttggtggtattgacaagcgtgtgattgagaggttcgagaaggaggctgctgagatgaacaagaggtctttcaagtatgcgtgggtgttggacaaacttaaggctgagcgtgagcgtggtatcaccattgacattgctctctggaagtttgagaccaccaagtactactgcactgtcattgatgctcctggacatcgtgatttcatcaagaacatgattactggtacctcccaggctgattgtgctgtcctcatcattgactccaccaccggtggttttgaagctggtatctccaaggatggtcagacccgtgagcatgctcttcttgctttcacccttggtgtcaagcagatgatttgctgctgtaacaagatggatgctactactcctaagtactccaaggccaggtacgatgagatcatcaaggaggtgtcttcctacttgaagaaggttggatacaaccctgacaaaatcccattcgtccccatctctggatttgagggtgacaacatgattgagaggtccaccaaccttgactggtacaagggaccaactctccttgaggcacttgaccagatcaacgagccaaagaggccctcagacaagccccttcgtctcccacttcaggatgtctacaagattggtggtattggaacggtgcccgtgggtcgtgttgagactggtatgctcaagcctggtatggttgtgacctttgctccttcagggttgaccactgaggttaagtccgtggagatgcaccacgagtctcttgtggaggcacttccaggtgacaacgtgggtttcaatgtcaagaatgtcgctgtcaaggatctcaagcgtgggtatgttgcgtccaactccaaggatgacccagctaagggtgctgccaacttcacttcccaggtcatcatcatgaaccaccctggtcagattggtaacggttacgctccagttctcgactgccacacttcccacattgccgtcaagttctctgagatcctcaccaagattgacaggcgttctggtaaagagatcgagaaggagcccaagttcttgaagaatggtgacgctggtatggtgaagatgactccgaccaagcccatggttgttgagaccttctctgagtacccacctcttggacgttttgctgtgagggacatgaggcagactgttgcagtcggtgtcatcaagagcgttgacaagaaggacccgaccggagccaaggtgaccaaggctgccgtcaagaagggtgccaagtgaactatcatacatcgagactctatcatcatcaaccgcagctgaaccaaagaactttgtgtgttttctactctagtttggtacgttgttg

SEQ ID NO: 1107 - DNA, 1567 bp, Brassica juncea
ccgctacactgaaattttacttgacgagcagccatgggtaaagagaagtttcacatcaacattgtggtcatcggccacgtcgattccgggaagtctaccaccactggtcacttgatctacaagcttggtggtattgacaagcgtgtgatcgagaggttcgagaaggaggctgctgagatgaacaagaggtccttcaagtacgcgtgggtgttggacaaacttaaggctgagcgtgagcgtggtatcaccattgacattgctctctggaagttcgagaccaccaagtactactgcacagtcattgacgctcctggacatcgtgatttcatcaaaaacatgattactggtacctcccaggctgattgtgctgttttgatcattgactccaccactggtgggtttgaagctggtatctctaaggatggtcagacacgtgagcatgctcttcttgctttcacacttggtgtcaagcagatgatttgctgctgtaacaagatggatgcaactacccctaagtactctaaagctaggtacgatgagattatcaaggaggtgtcttcctacttgaagaaggttgggtacaaccctgacaaaatcccgtttgtccccatctctggtttcgagggtgacaacatgattgagaggtccaccaacctcgactggtacaagggaccaactctcctcgaggcacttgaccagatcaacgagcccaagaggccctcagacaagcccctccgtcttcctctccaggatgtgtacaagattggtggtattgggacggtgccagtgggacgtgttgagactggtatgctcaagcctggtatggttgtgacctttgctccttcagggttgaccactgaggttaaatctgttgagatgcaccacgagtctcttgtggaggcacttccaggtgacaacgtgggtttcaatgtcaagaacgttgctgtcaaggatctcaagcgtgggtacgttgcgtccaactccaaggatgacccagctaagggtgctgccaacttcacttcccaggtcatcatcatgaaccaccctggacagatcggtaacggatacgcgccagtgcttgattgccacacctcccacattgcggttaagttctctgagatcctcaccaagattgacaggcgttctggtaaggagatcgagaaggagcccaagtttttgaagaatggtgatgctggtatggtgaagatgactccgaccaagcccatggttgtcgagaccttctctgagtacccaccccttggacgttttgccgtgagggacatgaggcagactgttgcagtcggtgtcatcaagagcgttgacaagaaggacccaaccggagccaaggtcaccaaggctgccgtcaagaagggtgccaaataaagtaccttgagcaaaactctatcatccgcagttgaatcaaaagacaattttagttttgttttgttagtttggtatttggttgcttgtttgtgttgcagcttcgtttcgtctccgtcagaactacgttctcgtaactgggttcttgatcggaggtggcggagccacattgcatgctagcttcctg

SEQ ID NO: 1108 - DNA, 1760 bp, Brassica rapa
tccctatgtatataaacacgtatccactctcgtaacaacctctatctcaatctttcttcaacctagccgctacacactgagattcatttgacaagtagctatgggtaaagagaagtttcacattaacattgtggtcatcggccacgtcgactctggaaagtcaaccaccactggtcacttgatctacaagcttggtggtattgacaagcgtgtgattgagaggttcgagaaggaggctgctgagatgaacaagaggtccttcaagtacgcgtgggtgttggacaaacttaaggccgagcgtgagcgtggtatcaccattgacattgcgctctggaagttcgagaccaccaagtactactgcactgtcattgatgctcctggacatcgtgatttcatcaagaacatgattactggtacctcccaggctgattgtgctgtcctcatcattgactccaccactggtggttttgaagctggtatctccaaggatggtcagacccgtgagcatgctcttcttgctttcacccttggtgtcaagcagatgatttgctgctgtaacaagatggatgctactactcctaagtactccaaggccaggtacgatgagatcatcaaggaggtgtcttcctacttgaagaaggttggatacaaccctgacaaaatcccattcgtccccatctctggatttgagggtgacaacatgattgagaggtccaccaaccttgactggtacaagggaccaactctccttgaggcacttgaccagatcaacgagccaaagaggccctcagacaagccccttcgtctcccacttcaggatgtgtacaagattggtggtattggaacggtgcccgtgggtcgtgttgagactggtatgctcaagcctggtatggttgtgaccttcgctccttcagggttgaccactgaggtgaagtctgttgaaatgcaccacgagtctcttgtggaggcacttccaggtgacaacgtcggattcaacgtcaagaatgttgctgtgaaggatctcaagcgtgggtatgttgcatccaactctaaggatgaccctgccaagggtgctgccaacttcacttcccaggtcatcatcatgaaccaccctggtcagattggtaacggttacgctccagttcttgactgccacacctcccacattgccgtcaagttctctgagatcctcacgaagattgacaggcgttctggaaaagagatcgagaaggagcccaagttcttgaagaatggtgacgctggtatggtgaagatgactccaaccaagcccatggttgttgagaccttctctgagtacccaccccttggacgtttcgctgttagggacatgaggcagactgttgcagtcggtgtcatcaagagcgttgacaagaaggacccaacgggagccaaggtgaccaaggctgccgtcaagaagggtgccaagtgaactaccttgaggaaaactctatcacccgcagttgaatggaaagacaaatttagtttttatgttacattagttttgtatttggtcgcttgtttgtgttgcagcttcgttacttctccgtcagagctctgttcacgtaactgggttcttgatcggaggtggcgaagcttctcattactctagcttccttcttttttactttgttttgctttcggattctgaactattttggatcctctctttataatgaatatggtatgtcgttcctgcggttaatgtctcgtctaattctttatcgtttgtttcattcgtg

SEQ ID NO: 1109 - DNA, 2290 bp, Brassica rapa
gattcagcaccatatatatatatatatataaacacgtcgctcctcatccattatcctccatctcgatctcttcttccaacctagccgctacacctctgagatttttacttaagccatgggtaaagagaagtttcacatcaacattgtggtcatcggccacgtcgactccgggaagtcaaccaccacgggtcacttgatctacaagctcggcggtatcgacaagcgtgtgatcgagaggttcgagaaggaggctgctgagatgaacaagaggtccttcaagtacgcgtgggtgttggacaagcttaaggctgagcgtgagcgtggtatcaccattgatattgctctttggaagtttgagaccaccaagtactactgcacggttattgacgctcctggtcatcgtgatttcattaagaacatgatcactggtacctcccaggctgattgtgctgttttgattattgactccactactggtgggtttgaggctggtatctctaaggatggtcagactcgtgagcatgctcttcttgctttcacacttggtgttaagcagatgatttgctgctgtaacaagatggatgctactacccccaagtactccaaggctaggtacgatgagattatcaaggaggtgtcttcctacttgaagaaggttgggtacaaccctgacaaaatccccttcgtccccatctctggtttcgagggtgacaacatgattgagaggtccaccaaccttgactggtacaaggggccaaccctccttgaggctcttgaccagatcaacgagccaaagaggccttcagacaagcccctccgtctaccacttcaggatgtctacaagattggtggtattggaacggtgccagtgggtcgtgttgagaccggtatgctcaagcctggtatggttgtgacctttgctccttcaggcttgaccactgaggttaagtctgttgagatgcaccacgagtcacttgtggaggcgcttccaggtgacaacgtcgggttcaacgtgaagaatgttgctgtcaaggatctcaagcgtgggtatgttgcatccaactccaaggatgatcctgccaagggtgctgctaacttcacctcccaggttatcatcatgaaccaccctgggcagattggtaacggttacgccccggttcttgattgccacacgtcccacattgcggtgaagttctctgagatcctcaccaagatcgacaggcgttctggtaaggagattgagaaggagcccaagtttttgaagaatggtgatgctggtatggtgaagatgactccgaccaagcccatggttgttgagaccttctctgagtacccaccacttggacgtttcgctgtgagggacatgaggcagactgttgcagtcggtgtcatcaagagcgtggacaagaaggatcctaccggagccaaggtgaccaaggctgccgtcaagaagggtgcgaagtaaagttcggtcatcaagtctctatcatccgcagatgaatccaattcctattttagttttcttgcattgttagtatggttttgtgtcgcttgtttgagtaagagcttcgtttcgtctccgtcagaactctcttctcgtaattgggttcttgatcggaggtggcggagctactagtctctcaagctttctgattctttttgcttttggattatgaactgttttgaatattttgttatgaaaatgatgacattcctgcggttattgtctctcgtctaatttacttatgttgcctgtttcatttcctggtcgttaatcgcatatcacatctatcgatttaatactgatgttgcatgagctgtaactctacccatacgcttcttaaatgaattccacctctcgagtactacatattttttcttgcattttgaactaaatttgtaatgaataactcacatgcccatttcaaacctcatctctcgttcttacatctactaaactgattttggacaatgacaagttcttcttgatgcctgcgtttacaatatgttacagcatactccacacagtaataatgcttgcgttcacaatgttacacatgatccgggcgatagtaagtcatattgccgatcataaatttcaatgtagccaaattataaaaccttataatcttacaaactcgaactagtaaaaaaaaaaggtaatatattctagaaatgaactactgtatgtgaaatcacattatggattataaaggaatgtgaagattggccagatggaaccaaatgaccaggatatgactcaaattcccaaaggttcaggttaggttcc

SEQ ID NO: 1110 - DNA, 1683 bp, Brassica rapa
agtcttagggtgcgctctcatttcagcttcgtagccgcaagtcctcctctcagattcttacttgcagctatgggtaaagagaagtttcacatcaacatcgtggtcattggccatgtcgactctgggaaatcgaccaccactggtcacttgatctacaagcttggtggtattgacaagcgtgtcattgagaggttcgagaaggaagctgctgagatgaacaagaggtctttcaagtacgcgtgggtgttggacaaacttaaggccgagcgtgagcgtggtatcaccattgatattgctctctggaagttcgagaccaccaagtactactgcacggtcattgatgcccctggtcatcgtgatttcatcaagaacatgattactggtacctcccaggctgattgtgctgtcctcatcattgactccaccactggtggttttgaagctggtatctccaaggatggtcagacccgtgagcatgctcttcttgctttcacccttggtgtcaagcaaatgatttgctgctgtaacaagatggatgccactacccccaagtactccaaggctaggtacgatgagatcatcaaggaggtgtcttcctacttgaagaaggttgggtacaaccctgacaaaatcccattcgtccccatctctggattcgagggtgacaacatgattgagaggtccaccaaccttgactggtacaagggaccaactctccttgaggctcttgaccagatcaacgagccaaagaggccctcagacaagcccctccgtctcccacttcaggatgtctacaagatcggtggtattggaacggtgccagtgggtcgtgtggagactggtatgctcaagcccggtatggttgtgacattcgctccttcagggttaaccactgaggtcaagtccgttgagatgcaccacgagtctcttgtggaggcacttccaggtgacaacgttgggttcaatgttaagaatgttgctgtgaaggatcttaagcgtgggtatgttgcatctaactccaaggatgacccagctaagggagctgccaacttcacatcccaggtcataatcatgaaccaccctggtcagatcggtaacggatacgccccagtcctcgattgccacacgtcccacattgcagtcaagttctctgagatcttgaccaagattgacaggcgatctggtaaggagatcgagaaggagcccaagtttttgaagaatggtgatgctggtatggttaagatgactccaaccaagcccatggttgtcgagactttctcagagtacccaccgttgggacgtttcgctgtcagggacatgaggcagaccgttgctgttggtgtcatcaagagtgttgacaagaaggacccaaccggtgccaaggtgaccaaggccgcagtgaagaagggagccaaatgatgagacttctctcgtctttgtgttttctttgcttttaaaaaaactttgatggcgtttgagcctttgttcttttattttctgtgactttctcatctctacctcctttttttttcatatctctgagacttatgggttacaattatgcagtttctggataattttgcgtagtgtgttttagtgttttgttttgctacaaattaattttctttgttcttgaatgcctttttgttttagcttaaacccggccacgttctgtcgttaacc

SEQ ID NO: 1111 - DNA, 1706 bp, Brassica rapa
tgattgtttctgtttgattttgtcggtgtgcagattttacttgacgagcagccatgggtaaagagaagtttcacatcaacattgtggtcatcggccacgtcgattccgggaagtctaccaccactggtcacttgatctacaagcttggtggtattgacaagcgtgtgatcgagaggttcgagaaggaggctgctgagatgaacaagaggtctttcaagtacgcgtgggttttggacaaacttaaggctgagcgtgagcgtggtatcaccattgacattgctctctggaagttcgagaccaccaagtactactgcacagtcattgacgctcctggacatcgtgatttcatcaagaacatgattactggtacctcccaggctgattgtgctgttttgatcattgactctaccactggtgggtttgaagctggtatctctaaggatggtcagacccgtgagcatgctcttcttgctttcacccttggtgtcaagcagatgatttgctgctgtaacaagatggatgccactacccccaagtactccaaggctaggtacgatgagatcatcaaggaggtgtcttcctacttgaagaaggttggatacaaccctgacaaaatcccattcgtccccatctctgggttcgagggtgacaacatgattgagaggtccaccaaccttgactggtacaagggacctactctccttgaggctcttgaccagatcaacgagccaaagaggccatcagacaagcccctccgtctgccacttcaggacgtctacaagatcggtggtattggaacggtgccagtgggtcgtgtggagactggtatgctcaagcccggtatggttgtgacctttgctccttcagggttgaccactgaggttaagtctgttgagatgcaccacgagtctcttgtggaggcgcttccaggtgacaacgtgggattcaatgttaagaacgttgctgtcaaggatcttaagcgtgggtatgttgcatccaactccaaggatgatcctgccaagggagctgccaacttcacttcccaggtcatcatcatgaaccaccctggacagatcggtaacggatacgcgccagttcttgattgccacacctcccacattgcggttaagttctctgagatcctcaccaagattgacaggcgttctggtaaggagatcgagaaggagcccaagtttttgaagaatggtgatgctggtatggtgaagatgactccgaccaagcccatggttgtcgagaccttctctgagtacccaccccttggacgttttgccgtgagggacatgaggcagactgttgcagtcggtgtcatcaagagcgttgacaagaaggacccaaccggagccaaggtcaccaaggctgccgtcaagaagggtgccaaataaagtaccttgagcaaaactctatcatccgcagttgaatcgaaagactattttagttttgttttgttagtttggtatttggttgcttgtttgtgttgcagcttcgtttcgtctccgtcagaactacgttctcgtaactgggttcttgatcggaggtggcggagccacattgcatgctagcttcctctgtttttttttttcatttgctttttgtttctgaaatattttggatgatttgatataatgaatatgacattattcctgcggttattagctttgtgtcgttaatcaaacatcacatctatc

SEQ ID NO: 1112 - DNA, 1713 bp, Brassica rapa
actctcatttagttctctctcgctccgttttcacagccgcaagactgctctcagattcttacttgcagctatgggtaaagagaagtttcacatcaacattgttgtcattggccatgtcgactctggcaaatcgactacaactggtcacttgatctacaagcttggtggtattgacaagcgtgtcatcgagaggttcgagaaggaggctgctgagatgaacaagaggtccttcaagtacgcgtgggtgttggacaaacttaaggctgagcgtgagcgtggtatcaccattgatattgctctttggaagttcgagaccaccaagtactactgcactgtcattgatgcccctggacatcgtgatttcatcaagaacatgattactggtacttcccaggctgattgtgctgttctcatcattgactctaccactggtggttttgaggctggtatctctaaggatggtcagacccgtgagcatgctcttcttgctttcacccttggtgtcaagcaaatgatttgctgctgtaacaagatggatgccactacccccaagtattccaaggctaggtacgatgagatcatcaaggaggtgtcttcctacttgaagaaggtcgggtacaaccctgacaaaatcccattcgtccccatctccggattcgagggtgacaacatgattgagaggtccaccaaccttgactggtacaagggaccaactctccttgaggctcttgaccagatcaacgagccaaagaggccttcagacaagcccctgcgactaccacttcaggatgtctacaagatcggtggtattggaacggtgccagtgggtcgtgtggagactggtatgctcaagcccggtatggttgtgacattcgctccttcagggttaaccactgaggtcaagtccgttgagatgcaccacgagtctcttgtggaagcgcttccaggtgacaatgtcggattcaatgtcaagaatgttgctgtcaaggatcttaagcgtgggtatgttgcatccaactccaaggatgaccctgccaagggagctgctaacttcacttcccaagtcatcatcatgaaccaccctggtcagatcggtaacggttacgcccctgtccttgattgccacacctcccacattgcagtcaagttctctgagatactcaccaagattgacagacgatctggtaaagagatcgagaaggagcccaagtttttgaagaatggagatgctggtatggtgaagatgactccgaccaagcccatggttgtcgagacgttctcagagtacccaccattgggacgtttcgctgttagggacatgaggcagactgttgctgttggtgtcataaagagcgttgacaagaaggacccaaccggtgccaaggtcaccaaggctgcagtcaagaagggtgctaaatgatgagacttctctattacttttaaaaaaactttgatggcgtttgagcctttttttatattttctgcgacattgtttcaattatgctgtttgtggatggttttggctaatgatttttagtgcttctttgttcttgaatgtccttgttagttgcttttactcatctagagtttttagaccagtctgttcaagattttgttgggaagcaacgactagaaaacgtttaaaccaccttggtgttcaatattcaattttcatgagatttataagacaaattatccccttgtttgttaaaa

SEQ ID NO: 1113 - DNA, 1841 bp, Brassica rapa
gtaatatcgttatgttatgatgctaaaaccctactttcctttccaaccaggccattcacacacactatatatatatatacacacacgcatctcgatctctctctccaacctagccgctacacttatcttccctctaccacatcactgagattagccatgggtaaagagaagttccacatcaacatcgtggtcatcggccacgtcgactccggaaaatccacaaccaccggtcacttgatctacaagctcggcggtatcgacaagcgtgtcatcgagaggttcgagaaggaagccgccgagatgaacaagaggtctttcaagtacgcgtgggtccttgacaagctcaaggccgagcgcgagcgtggtatcaccatcgacattgctctctggaagttcgagaccaccaagtactactgcaccgtcatcgacgctcctggccatcgtgatttcatcaagaacatgatcactggtacctcccaggctgattgtgctgttctcattatcgattccaccacgggtgggtttgaggctgggatctctaaggatggtcagactcgtgagcatgctcttcttgctttcacgcttggtgttaagcaaatgatttgctgctgtaacaagatggatgctactactcctaagtactctaaggctaggtacgatgagattatcaaggaggtgtcttcttacttgaagaaggttggttacaaccctgataaaatcccgtttgttcccatctctggtttcgagggtgacaacatgattgagaggtccaccaaccttgactggtacaagggaccgactcttctcgaggctcttgatcagatcaacgagccaaagaggccgtcagacaagcctctccgtcttccactccaggatgtgtacaagattggtggtattggaacggtgccggtaggacgtgttgagaccggtatgctcaagcctggtatggttgtgacttttgctccttcgggtttgaccactgaggttaagtctgttgagatgcatcatgagtctcttgttgaggcgcttccaggtgacaacgttgggttcaatgttaagaacgttgctgtcaaggatcttaagcgtgggtacgttgcttccaactccaaggatgatcctgctaaaggtgctgctaacttcacctcacaggttatcatcatgaaccaccctggtcagattggtaacggttacgctccggttcttgattgccacacgtcccacattgctgtcaagttctctgagattttgaccaagattgataggcgttctggtaaggagattgagaaggagcccaagtttttgaagaatggtgatgctggtatggttaagatgactcccaccaagccaatggttgttgagactttctctgagtacccgccgcttggacgtttcgctgttagggacatgaggcagactgttgcagttggtgtcatcaagagcgttgacaagaaggacccgaccggagccaaggtgaccaaggctgccgtcaagaagggtgccaagtaaagcaccttcagcaagagtctttcatccgaagacgattttagtttttttacattagtgtggtgtttggtcgtttgtttgtgttatagcttcgtctcttgtccgtcagaaccatgttctcgtaattgggttcttgatcggaggtggcggagctatgttgaagtctagctttactgtttttttgttttacttttgctaccgggttatgaactattttggatgttatgttattatgaatatggcatgagatcatttcttgttgtctaatattgtttttatgcgtatcgtaaatctctgaagacatctaaattcattgttgaatccattttattacaaat

SEQ ID NO: 1114 - DNA, 1685 bp, Brassica napus
gtttcgtagccgcatctctcacattctaactcgcagctatgggtaaagagaagtttcacatcaacattgtggtcatcggccatgtcgactctggaaaatcgaccaccactggtcacttgatctacaagctcggtggtattgacaagcgtgtcatcgagaggttcgagaaggaggctgctgagatgaacaagaggtccttcaagtacgcctgggtcttggacaaacttaaggccgagcgtgagcgtggtatcaccattgatatcgctctctggaagttcgagaccaccaagtactactgcacggtcattgacgctcctggacatcgtgatttcatcaagaacatgattactggtacctcccaggctgattgtgctgttttgatcattgactccaccactggtggttttgaggctggtatctccaaggatggtcagacccgtgagcatgctcttcttgctttcacccttggtgtcaagcagatgatttgctgctgtaacaagatggatgctactacccctaagtactccaaggctaggtacgatgagatcatcaaggaggtgtcttcctacttgaagaaggttgggtacaaccctgacaaaatcccattcgttccaatctctgggttcgagggtgacaacatgattgagaggtccaccaaccttgactggtacaagggaccaactctccttgaggctcttgaccagatcaacgagccaaagaggccctcagacaagcccctccgtctcccacttcaggatgtctacaagatcggtggtattggaacggtgccagtgggacgtgttgagaccggtatgctcaagcccggtatggttgtgaccttcgctccttcagggttgaccactgaggttaagtccgttgagatgcaccacgagtctcttgtggaggcgcttccaggtgacaacgttgggttcaatgttaagaatgttgctgtcaaggatcttaagagagggtatgttgcatccaactccaaggatgaccctgccaagggtgctgccaacttcacctcccaggtcatcatcatgaaccaccctggtcagatcggtaacggatacgccccggttcttgattgtcacacatcccacattgcagtcaagttctctgagatcctcaccaagattgacaggcgatctggaaaggagattgagaaggagcccaagttcttgaagaatggtgatgctggtatggttaagatgactccaaccaagcccatggttgttgagactttctctgagtacccaccattgggtcgtttcgctgttagggacatgaggcagacggtggctgttggtgttatcaagagcgttgacaagaaggacccaaccggtgctaaggtcaccaaggctgcagtcaagaagggagccaaatgatgagtgacctctcagtctttggtttttctttgcattacaaaaactttgatggcgtttgagccttttccttattttctgcgacttttttctaccttgtttttggatctctgagactattgtggttttcaattatgcagcttctggataattttgcctaaatgctttatgctctcgagtgtacgttaagttgcttttcttttgtttaagatctgaattgatgacggattgtttgaaattactcaatgctgatagatgttaagtgttctttatacaagcgaacaagagtaatagcagata

SEQ ID NO: 1115 - DNA, 1800 bp, Brassica napus
gatttgcttgacaattagccatgggtaaagagaagtttcacatcaacattgtggtcattggtcatgtcgactctggaaaatcgaccaccactggtcacttgatctacaagcttggtggtattgacaagcgtgtgattgagaggttcgagaaggaggctgctgagatgaacaagaggtctttcaagtatgcgtgggtgttggacaaactgaaggctgagcgtgagcgtggtatcaccattgacattgctctttggaagtttgagaccaccaagtactactgcactgtcattgatgctcctggacatcgtgatttcattaagaacatgattactggtacctcccaggctgattgtgctgtcctcatcattgactccaccaccggcgggtttgaagctggtatctccaaggatggtcagacccgtgagcatgctcttcttgctttcacccttggtgtcaagcagatgatttgctgctgtaacaagatggatgctactacccctaagtactccaaggctaggtacgatgagattatcaaggaggtgtcttcatacctgaagaaggttggatacaaccctgacaaaatcccattcgtccccatctctgggttcgaaggtgacaacatgattgagaggtccaccaaccttgactggtacaagggaccaactctccttgaagcacttgaccagatcaacgagcccaagaggccatcagacaagcccctccgtctcccacttcaggatgtctacaagatcggtggtattggaacggtgccagtgggtcgtgttgagacgggtatgctaaagcctggtatggttgtgacctttgctccttcagggttgaccactgaggttaagtctgttgagatgcaccacgagtctcttgtggaggcacttccaggtgacaacgtgggattcaatgtcaagaacgttgctgtcaaggatctcaagcgtgggtatgttgcatccaactccaaggatgatccagcaaagggtgctgccaacttcacctcccaggtcatcatcatgaaccaccctggtcagattggtaacggttacgctccagttctcgactgccacacttcccacattgccgtcaagttctctgagatcctcaccaagattgacaggcgttctggtaaagagatcgagaaggagcctaagttcttgaagaatggtgacgctggtatggtgaagatgactccaaccaagcccatggttgttgagaccttctctgagtacccaccccttggacgttttgccgtgagggacatgaggcagactgttgcagtcggtgttatcaagagcgttgacaagaaggacccaaccggagccaaggttaccaaggctgccgtcaagaagggtgccaagtgaactatcatcatcgagactctatcatcatcaaccgcagatgaactaaagaactttgtgtgttttcttgctctagtttggtacgttgttggctgtttgtgttacagtttcgtcccttctccgtcagaacgtaattctcgtaattgggttcttgataggaggtggcggagcttcgtcacataaaagcaacattgtttttgctttacatttgttatctgaattttgagacttcttttcatattatgttatgatatggtgacattcctgcggtattattgttacttttccgttttgttttgttttagtagtacgtaatgtaattcttcgtttggttacggtacttccttccctaccctacttccttaccttacccaaacgaacgaaactaagtagttcgttcgttcgttcgttttcggtttttactcccgaacgg

SEQ ID NO: 1116 - DNA, 1531 bp, Brassica napus
tctctcgctccgtttttcacagccgcaagactgctctcagattcttacttgcagctatgggtaaagagaagtttcacatcaacattgtggtcattggccatgtcgactctggaaaatcgaccacaactggtcacttgatctacaagctcggtggtattgacaagcgtgtgatcgagaggttcgagaaggaggctgccgagatgaacaagaggtccttcaagtacgcgtgggtgttggacaaacttaaggccgagcgtgagcgtggtatcaccattgacattgctctctggaagttcgagaccaccaagtactactgcactgtcattgatgcccctggtcatcgtgatttcatcaagaacatgattactggtacctcccaggctgattgtgctgttcttatcattgactctaccactggtggttttgaggctggtatctccaaggatggtcagactcgtgagcatgctcttcttgctttcacccttggtgtcaagcaaatgatttgctgctgtaacaagatggatgccacaacccccaagtactcaaaggctaggtacgatgagatcatcaaggaggtgtcttcctacttgaagaaggttgggtacaaccctgacaaaatcccattcgtccccatctccggattcgagggtgacaacatgattgagaggtccaccaaccttgactggtacaagggaccaactctccttgaggctcttgaccagatcaacgagccaaagaggccttcagacaagcccctgcgtctaccacttcaggatgtctacaagatcggtggtattggaacggtgccagtgggtcgtgtggagactggtatgctcaagcccggtatggttgtgacattcgctccttcagggttgaccactgaggtcaagtccgttgagatgcaccacgagtctcttgtggaggcacttccaggtgacaacgtcggattcaatgttaagaatgttgccgtcaaggatcttaagcgtgggtatgttgcatccaactccaaggatgaccctgccaagggtgctgccaacttcacttcccaggtcatcatcatgaaccaccctggtcagatcggtaacggttacgccccagtgcttgattgccacacctcccacattgcagtcaagttttctgagatcctcaccaagattgacaggcgatctggtaaagagatcgagaaggagcctaagtttttgaagaatggagatgctggtatggtgaagatgactccaaccaagcccatggttgttgagactttctcagagtacccaccattgggacgttttgctgttagggacatgaggcagacggttgctgttggagttatcaagagtgttgacaagaaggacccaaccggtgctaaggttaccaaggctgcagtcaagaagggtgccaaatgatgagacttctctattactttaaaaaaaactttgatggcgtttgagccttttttttatatattttctgcgacatggtttcagttatgcagtttgtggatggttttggctaatgatttttagtgctt

SEQ ID NO: 1117 - DNA, 1615 bp, Brassica napus
atttagccatgggtaaagagaagtttcacatcaacattgtggtcatcggccacgtcgactccgggaagtcaaccaccaccggtcacttgatctacaagctcggtggtatcgacaagcgtgtcatcgagaggttcgagaaggaggctgctgagatgaacaagaggtctttcaagtacgcttgggtgttggacaagcttaaggccgagcgtgagcgtggtatcaccatcgacattgctctttggaagtttgagaccaccaagtactactgcactgtgatcgacgctcctggtcatcgtgatttcatcaagaacatgatcaccggtacctcccaggcggattgtgctgttttgattattgactccaccaccggtggtttcgaggctggtatttcaaaggatggtcagacccgtgagcatgctcttcttgctttcacacttggtgtcaagcagatgatttgctgctgtaacaagatggatgctactacccccaagtactccaaggctaggtacgatgagattatcaaggaggtgtcttcctacttgaagaaggttgggtacaaccctgacaaaatcccattcgtccccatctctggtttcgagggtgacaacatgattgagaggtccaccaaccttgactggtacaagggaccaaccctccttgaggctcttgaccagatcaacgagcccaagaggccctcggacaagcccctccgtctcccacttcaggacgtctacaagattggtggtattggaacggtgccagtgggtcgtgttgagaccggtatgctcaagcctggtatggttgtgaccttcgctccttcagggttgaccactgaggtcaagtctgttgagatgcaccacgagtctcttgtggaggcgcttccaggtgacaacgtgggattcaacgttaagaatgttgctgtcaaggatctcaagcgtgggtacgttgcatccaactccaaggatgaccctgccaagggtgctgctaacttcacctcccaggtcatcatcatgaaccacccgggccagatcggtaacggttacgccccggttcttgattgccacacctcccacattgcggtgaagttctctgagatcctcaccaagattgacaggcgttctggtaaggagattgagaaggagcccaagtttttgaagaatggtgatgctggtatggtgaagatgactccgaccaagcccatggttgtggagaccttctctgagtacccaccacttggacgtttcgctgtgagggacatgaggcagactgttgcagtcggtgtcatcaagagcgttgacaagaaggacccaaccggagccaaggtgaccaaggctgccgtcaagaagggtgcgaagtaaagttcggtcatcaactctctatcatccgcagatgaatcaaagtcctattttagttttcttgcattgttagtttggttttctgttgcttgtttgtgtaacagactcgtctcgtctccgtcagaactttcttctcgtaattgggttcttgatcggaggtggcggagcttctctcaagctttctgttttctttttgcttttggattatgaactgttttgaatattttgttatgaaaatgatgacattcctgcggttattt

SEQ ID NO: 1118 - DNA, 1561 bp, Brassica napus
gcatctcacattctaactcgcagctatgggtaaagagaagtttcacatcaacattgtggtcatcggccatgtcgactctggaaaatcaaccaccactggtcacttgatttacaagctcggtggtattgacaagcgtgtcatcgagaggttcgagaaggaggctgctgagatgaacaagaggtccttcaagtacgcgtgggtgttggacaaacttaaggccgagcgtgagcgtggtatcaccattgatatcgctctctggaagttcgagaccaccaagtactactgcacggtcattgacgctcctggacatcgtgatttcatcaagaacatgattactggtacctcccaggctgattgtgctgttttgatcattgactctaccactggtggttttgaggctggtatctccaaggatggtcagacccgtgagcatgctcttcttgctttcacccttggtgtcaagcagatgatttgctgctgtaacaagatggatgctactactcctaagtactccaaggctaggtacgatgagatcatcaaggaggtgtcttcctacttgaagaaggttgggtacaaccctgacaaaatcccattcgtcccaatctctggtttcgagggtgacaacatgatcgagaggtcaaccaaccttgactggtacaagggaccaactctccttgaggctcttgaccagatcaacgagccaaagaggccctctgacaagcccctccgtctgccacttcaggatgtctacaagatcggtggtattggaacggtgccagtgggacgtgttgagaccggtatgctcaagcccggtatggttgtgaccttcgctccttcagggttgaccactgaggttaagtccgttgagatgcaccacgagtctcttgtggaggcgcttccaggtgacaacgtcgggttcaatgttaagaatgttgccgtcaaggatcttaagagagggtatgttgcatccaactccaaggatgaccctgccaagggtgccgccaacttcacctcccaggtcatcatcatgaaccaccctggtcagatcggtaacggttacgccccggttctcgattgccacacatcccacattgcagtcaagttctctgagatcctcaccaagattgacaggcgatctggaaaagagattgagaaggagcccaagttcttgaagaatggtgatgctggtatggttaaaatgactccgaccaagcccatggttgttgagactttctctgagtacccaccattgggtcgtttcgctgttagggacatgaggcagacggtggctgttggtgttatcaagagcgttgacaagaaggacccaaccggtgctaaggtcaccaaggctgcagttaagaagggagctaaatgatgagacttgctctcgtctttggtttttcttttcattacaaaaaactttgatggcgtttgaggctttttcttattttctgcgactttcttttaccttgtttgtggatctctgagactattgtggttttcgattatgcagcttctggataattttgcctaatgctttagtttatgttctcttgctcga

SEQ ID NO: 1119 - DNA, 1682 bp, Brassica napus
gattctacatccgagccgctactactatcttcttctctgtgacattactgtgattttacttgacgagcagccatgggtaaagagaagtttcacatcaacattgtggtcatcggccacgtcgattccgggaagtctaccaccactggtcacttgatctacaagcttggtggtattgacaagcgtgtgatcgagaggttcgagaaggaggctgctgagatgaacaagaggtctttcaagtacgcgtgggttttggacaaacttaaggctgagcgtgagcgtggtatcaccattgacattgctctctggaagttcgagaccaccaagtactactgcacagtcattgacgctcctggacatcgtgatttcatcaagaacatgattactggtacctcccaggctgattgtgctgttttgatcattgactccaccactggtgggtttgaagctggtatctccaaggatggtcagacccgtgagcatgctcttcttgctttcacccttggtgtcaagcagatgatttgctgctgtaacaagatggatgccactacccccaagtactccaaggctaggtacgatgagatcatcaaggaggtgtcttcctacttgaagaaggttgggtacaaccctgacaaaatcccattcgtccccatctctggtttcgagggtgacaacatgattgagaggtccaccaaccttgactggtacaagggaccaactctccttgaggctcttgaccagatcaacgagccaaagaggccatcagacaagcccctccgtctgccacttcaggacgtctacaagattggtggtattggaacggtgccagtcggtcgtgtcgagactggtatgctcaagcctggtatggttgtgacctttgctccttcagggttgaccactgaggttaagtctgttgagatgcatcacgagtctcttgtggaggcgcttcccggtgacaacgtgggattcaatgttaagaacgttgctgtgaaggatcttaagcgtgggtatgttgcttccaactccaaggatgatcctgctaaaggtgctgccaacttcacttcccaggtcatcatcatgaaccaccctggtcagatcggtaatggatacgcaccagtccttgattgccacacatcccacattgcagtcaagttctctgagatcctcaccaagattgacaggcgttctggtaaggagatcgagaaggagcccaagtttttgaagaatggtgatgctggtatggtgaagatgactccgaccaagcccatggttgtcgagaccttctctgagtacccaccccttggacgttttgccgtgagggacatgaggcagactgttgcagtcggtgtcatcaagagcgttgacaagaaggacccaaccggagccaaggtcaccaaggctgccgtcaagaagggtgccaaataaagtaccttgagcaaaactctatcatccgcagttgaatcaaaagacaattttagttttgttttgttagtttggtatttggttgcttgtttgtgttgcagcttcgtttcgtctccgtcagaactctgttctcgtaactgggttcttgatcggaggtggcggagccacattggatgctagcttcgtctgtgtttttttcttttgcttttcgtttttgaagaaatattatggatgtttggttattatgaatatgacattattcc

SEQ ID NO: 1120 - DNA, 1684 bp, Brassica napus
gtgcaggccatttaggccgtgcagcccccccccccgagggtgcgctctcatttcagcttcgtagccgcaagtcctcctctcagattcttacttgcagctatgggtaaagagaagtttcacatcaacatcgtggtcattggccatgtcgactctgggaaatcgaccaccactggtcacttgatctacaagcttggtggtattgacaagcgtgtgatcgagaggttcgagaaggaagctgctgagatgaacaagaggtctttcaagtacgcgtgggtgttggacaaacttaaggccgagcgtgagcgtggtatcaccattgatattgctctctggaagttcgagaccaccaagtactactgcacggtcattgatgctcctggacatcgtgatttcatcaagaacatgattactggtacctcccaggctgattgtgctgtcctcatcattgactccaccactggtggttttgaagcaggtatctccaaggatggtcagacccgtgagcatgctcttcttgctttcacccttggtgtcaagcaaatgatttgctgctgtaacaagatggatgccactacccccaagtactccaaggctaggtacgatgagatcatcaaggaggtgtcttcctacttgaagaaggttgggtacaaccctgacaaaatcccattcgtccccatctctggattcgagggtgacaacatgattgagaggtccaccaaccttgactggtacaagggaccaactctccttgaggctcttgaccagatcaacgagcccaagaggccctcggacaagcccctccgtctcccacttcaggatgtctacaagatcggtggtattggaacggtgccagtgggacgtgttgagaccggtatgctcaagcccggtatggttgtgacctttgctccttcagggttgaccactgaggttaagtctgttgagatgcaccacgagtctcttgtggaggcacttccaggtgacaacgttggattcaatgttaagaacgttgctgtgaaggatcttaagcgtgggtatgttgcatctaactccaaggatgacccagctaagggagctgccaacttcacatcccaggtcatcatcatgaaccaccctggtcagatcggtaacggatacgccccagtcctcgattgccacacgtcccacattgcagtcaagttctctgagatcttgaccaagattgacaggcgatctggtaaggagatcgagaaggagcccaagtttttgaagaatggtgatgctggtatggttaagatgactccaaccaagcccatggttgtcgagactttctcagagtacccaccgttgggacgtttcgctgtcagggacatgaggcagaccgttgctgttggtgtcatcaagagtgttgacaagaaggacccaaccggtgccaaggtgaccaaggccgcagtgaagaagggagccaaatgatgagacttctctcgtctttgtgttttctttgcttttaaaaaaactttgatggcgtttgagcctttgttcttttattttctgtgactttctcatctctacctcctttttttttcatatctctgagacttatgggttacaattatgcagtttctggataattttgcctagtgtgttttagtgttttgttttgctaacaaaattaaattttactttagttactaacgaaaaaaaaaaa

SEQ ID NO: 1121 - DNA, 1638 bp, Brassica napus
atggacgcctgaggtacggtccggattttcgggtcgaccacgcgtccgtttcagtttcgtagccgcaagtcctcttctctgattcttacttgcagctatgggtaaagagaagtttcacatcaacattgtggtcattggccatgtcgactctgggaaatcgaccaccactggtcacttgatctacaagcttggtggtattgacaaacgtgtcatcgagagattcgagaaggaagctgctgagatgaacaagaggtctttcaagtacgcttgggtgttggacaaacttaaggccgagcgtgagcgtggtatcaccattgacattgctctctggaagttcgagaccaccaagtactactgcacggtcattgatgcccctggacatcgtgatttcatcaagaacatgattactggtacctcccaggctgattgtgccgtcctcatcattgactccaccactggtggttttgaagctggtatctccaaggatggtcagacccgtgaacatgctcttcttgctttcacccttggtgtcaagcaaatgatttgctgctgtaacaagatggatgccactacccccaagtactctaaggctaggtacgatgagatcatcaaggaggtgtcttcctacttgaagaaggttgggtacaaccctgacaaaatcccattcgtccccatctctggattcgagggtgacaacatgattgagaggtccaccaaccttgactggtacaagggaccaactctccttgaggctcttgaccagatcaacgagcccaagaggccctcagacaagcccctccgtctcccacttcaagatgtctacaagatcggtggtattggaacggtgccagtgggacgtgttgagaccggtatgctcaagcccggtatggttgtgaccttcgctccttcagggttgaccaccgaggttaagtctgttgagatgcaccacgagtctcttgtggaggcactcccaggtgacaacgttgggttcaatgttaagaacgttgctgtcaaggatcttaagagagggtatgttgcatccaactccaaggatgatcctgccaagggtgctgccaacttcacatcccaggtcatcatcatgaaccaccctggtcagatcggtaacggatacgccccagtcctcgattgccacacgtcccacattgcagtcaagttctctgagatcttgaccaagattgacaggcgatctggtaaggagatcgagaaggagcccaagtttttgaagaatggtgatgctggtatggttaagatgactccgaccaagcccatggttgtcgagactttctcagagtacccaccattgggacgtttcgctgtcagagacatgaggcagaccgttgctgttggtgtcatcaagagcgttgacaagaaggacccaaccggtgccaaggtgaccaaggccgcagtgaagaagggagcaaaatgatgagacttctctcgtctttgtgttttctttgctttaaaaaaaaaactttgatggcgtttgagcctttgttcttttattttctgttactttctcatctctacctcctttttattatatctctgagacttatgggttacaattatgcagtttctggataattttgcctagtgtttcgttttgctacaaattaa

SEQ ID NO: 1122 - DNA, 1641 bp, Brassica napus
cgctacactatctcccctctgcaacaatcacttagataattcagccatgggtaaagagaagttccacatcaacatcgtggtcatcggccacgtggattccggaaaatcgacaaccaccggtcacctgatctacaagctcggcggtatcgacaagcgtgtcatcgagaggttcgagaaggaagccgccgagatgaacaagaggtctttcaagtacgcgtgggtcctggacaagctcaaggccgagcgtgagcgtggtatcaccatcgacattgctctctggaagttcgaaaccaccaagtactactgcaccgtcatcgacgctcctggccatcgcgatttcatcaagaatatgatcaccggtacctcccaggctgattgtgctgttctaattatcgattccaccaccggtgggtttgaggctggaatctctaaggatggtcagacccgtgagcatgctcttctcgctttcacgcttggtgttaagcaaatgatttgctgctgtaacaagatggatgcaacgactcctaagtactctaaggctaggtacgatgagattatcaaggaggtgtcttcttacttgaagaaggttggttacaaccctgacaagatcccgtttgtccccatctctggtttcgagggtgacaacatgattgagaggtccaccaacctcgactggtacaaggggccgactctcctcgaggctcttgaccagatcaacgagcccaagaggccttcagacaagcccctccgtcttcccctccaggatgtctacaagattggtgggattggaacggtgccggttggtcgtgttgagactggtatgctcaagcctggtatggttgtgacattcgctccttcgggtttgaccactgaggttaagtctgttgagatgcaccatgagtctcttgtggaggcgcttccgggtgacaacgttgggttcaatgttaagaacgttgctgtcaaggatcttaagcgtgggtacgttgcgtccaactccaaggatgatcctgctaaaggcgctgctaacttcacctcccaggtcatcatcatgaaccaccctggtcagattggtaatggttacgccccggttcttgattgccacacctcccacattgctgtcaagttctctgaaatcttgaccaagattgatagacgttctggtaaggagattgagaaggaacctaagtttttgaagaatggtgatgctggtatggtgaagatgactcccaccaagcctatggttgttgagactttctctgagtacccaccgcttggacgtttcgctgttagggacatgaggcagactgttgctgtcggtgtcatcaagagtgttgacaagaaggacccgaccggagctaaggtgaccaaggctgccgtcaagaagggtgccaagtaaagtaccttcagcaagagtctttcatccgaagacaattttagttttttcacagtagtttggtgtttggtcgcttgtttgtgttatagcttcgtctcttgtccgtcagaactatgttctcgtaactgggttctcgatcggaggtggcggagctacgttgaactctagcttgctgttttttgttttacttttgctatcgggttatgaactattttggatgtttagttattatgaatatggcatgagat

SEQ ID NO: 1123 - DNA, 1663 bp, Brassica napus
aatctcgatctttcttcaacctagccgctacactgagattcatttgacaagtagctatgggtaaagagaagtttcacatcaacattgtggtcattggccatgtcgattctgggaaatcgactaccactggtcatttgatctacaagcttggtggtattgacaagcgtgtgattgagaggttcgagaaggaagctgctgagatgaacaagaggtccttcaagtatgcgtgggtgttggacaaattgaaggctgagcgtgagcgtggtatcaccattgacattgctctttggaagtttgagaccaccaagtactactgcacagtcattgatgctcctggacatcgtgatttcatcaagaacatgattactggtacctcccaggctgattgtgctgtcttgatcattgactccaccactggtggtttcgaagctggtatctccaaggatggccagacacgtgagcatgctctccttgctttcacccttggtgtcaagcagatgatttgctgctgtaacaagatggatgctactactcccaagtactccaaggctaggtacgatgagattatcaaggaggtgtcttcctacttgaagaaggttgggtacaacccggacaaaatcccattcgtccccatctctggtttcgagggtgacaacatgattgagaggtccaccaaccttgactggtacaagggaccaactctccttgaggcacttgaccagatcaacgagcccaagaggccatcagacaagcccctccgtctaccacttcaggatgtctacaagattggtggtattggaacggtgccagtgggtcgtgttgagaccggtatgctcaagcctggtatggttgtgacctttgctccttctgggttgaccactgaagttaagtctgttgagatgcaccacgagtctcttgtggaggcacttccaggtgacaatgtcggattcaatgttaaaaatgtcgctgtgaaggatctcaagcgtggttacgttgcatccaactccaaggatgacccagctaagggtgctgctaacttcacttcccaggtcatcatcatgaaccaccctggtcagatcggaaacggttacgctccagttcttgactgccacacttcccacattgccgtcaagttctctgagatcctcaccaagattgacaggcgttctggtaaagagattgagaaggagcccaagttcttgaagaatggggacgctggtatggtgaagatgactccgaccaagcctatggttgttgagaccttctctgagtacccacctcttggacgtttcgccgtgagggacatgaggcagactgttgcagtcggtgtcattaagagcgttgacaagaaggacccaaccggagccaaggtgaccaaggctgccgtcaagaagggtgccaagtgaactaccttgaggaaaactctatcatccgcagttgaaaacaattttagttttttggttacattagttttgtatttggccgcttgtttgtgttgcagcttcgttacttctccgtcagagctttgttcacttaactgggttcttgatcggaggtggtgaagctactcattactctagcttccttcttttttactttgttttgctttcggattctgaactattttggatgctctctttataatgaatatggtatgtcgttc

SEQ ID NO: 1124 - DNA, 1612 bp, Brassica napus
gagttctctcgcttagtttcgtagccgcaagactccctctcagattcttacttgcagctatgggtaaagagaagtttcacatcaacattgtggtcattggccatgtcgactctgggaaatcgaccaccactggtcacttgatctacaagcttggtggtattgacaagcgtgtcatcgagaggttcgagaaggaggctgctgagatgaacaagaggtccttcaagtacgcatgggtcttggacaaacttaaggctgagcgtgagcgtggtatcaccattgacattgctctctggaagttcgagaccaccaagtactactgcaccgtcattgacgcccctggacatcgtgatttcatcaagaacatgattactggtacctcccaggctgattgtgctgttcttatcattgactctaccactggtggttttgaggctggtatctccaaggatggtcagacccgagagcacgctcttcttgctttcacccttggtgtcaagcaaatgatttgctgctgtaacaagatggatgccacaacccccaagtactccaaggctaggtacgatgagatcatcaaggaggtgtcttcctacttgaagaaggttgggtacaaccctgacaaaatcccattcgtccccatctccggattcgagggtgacaacatgattgagaggtccaccaaccttgactggtacaagggaccaactctccttgaggcacttgaccagatcaacgagcccaagaggccttcagacaagcccctccgtctcccacttcaggatgtctacaagatcggtggtattggaacggtgccagtgggtcgtgttgagactggtatgctcaagcccggtatggttgtcacctttgctccatcagggttgaccactgaggttaagtctgtcgagatgcaccacgagtctcttgttgaggcacttccaggtgacaacgtcggattcaatgtcaagaatgttgccgtcaaggatctcaagcgtgggtatgttgcatccaactccaaggatgatcctgccaagggagctgcgaactttacttcccaggtcatcatcatgaaccaccctggtcagatcggtaacggttacgcccctgtccttgattgccacacctcccacattgcagtgaagttctctgagatccttaccaagattgacagacggtctggtaaagagatcgagaaggagcctaagtttttgaagaatggagatgctggtatggtgaagatgactccaaccaagcccatggttgttgagactttctcagagtacccaccactgggacgattcgctgttagggatatgaggcagaccgtggctgttggtgtcatcaagagtgttgacaagaaggacccaaccggtgccaaggtcaccaaggctgcagtcaagaagggtgccaaatgatgagacttatcatgcttggttcactttgcttcaaaaaaaactttaatggtgtttgagcatttttttttcttttgcaactcatctttttacctttttgatatgatggttttagttatgcagtttccggataattttgcttaatgctttctagtgttcattgaatgtttattcaagttccttgtttctatcttagactgttcaag

SEQ ID NO: 1125 - DNA, 1683 bp, Brassica napus
tcagatatatatatacacacacgcatctcgatctctctctccaacctagccgctacacttatcttccctctaccacatcactgagattagccatgggtaaagagaagttccacatcaacatcgtggtcatcggccacgtcgactccggaaaatccacaaccaccggtcacttgatctacaagctcggcggtatcgacaagcgtgtcatcgagaggttcgagaaggaagccgccgagatgaacaagaggtctttcaagtacgcgtgggtccttgacaagctcaaggccgagcgcgagcgtggtatcaccatcgacattgctctctggaagttcgagaccaccaagtactactgcaccgtcatcgacgctcctggccatcgtgatttcatcaagaacatgatcactggtacctcccaggctgattgtgctgttctcattatcgattccaccacgggtgggtttgaggctgggatctctaaggatggtcagactcgtgagcatgctcttcttgctttcacgcttggtgttaagcaaatgatttgctgctgtaacaagatggatgctactactcctaagtactctaaggctaggtacgatgagattatcaaggaggtgtcttcttacttgaagaaggttggttacaaccctgataaaatcccgtttgttcccatctctggtttcgagggtgacaacatgattgagaggtccaccaaccttgactggtacaagggaccgactcttctcgaggctcttgatcagatcaacgagccaaagaggccgtcagacaagcctctccgtcttccactccaggatgtgtacaagattggtggtattggaacggtgccggtaggacgtgttgagaccggtatgctcaagcctggtatggttgtgacttttgctccttcgggtttgaccactgaggttaagtctgttgagatgcatcatgagtctcttgttgaggcgcttccaggtgacaacgttgggttcaatgttaagaacgttgctgtcaaggatcttaagcgtgggtacgttgcttccaactccaaggatgatcctgctaaaggtgctgctaacttcacctcacaggttatcatcatgaaccaccctggtcagattggtaacggttacgctccggttcttgattgccacacgtcccacattgctgtcaagttctctgagattttgaccaagattgataggcgttctggtaaggagattgagaaggagcccaagtttttgaagaatggtgatgctggtatggttaagatgactcccaccaagccaatggttgttgagactttctctgagtacccgccgcttggacgtttcgctgttagggacatgaggcagactgttgcagttggtgtcatcaagagcgttgacaagaaggacccgaccggagccaaggtgaccaaggctgccgtcaagaagggtgccaagtaaagcaccttcagcaagagtctttcatccgaagacgattttagtttttttacattagtgtggtgtttggtcgtttgtttgtgttatagcttcgtctcttgtccgtcagaaccatgttctcgtaattgggttcttgatcggaggtggcggagctatgttgaagtctagctttactgtttttttgttttacttttgctaccgggttatgaactattttggatgttatgttattatgaatatggca

SEQ ID NO: 1126 - DNA, 2304 bp, Brassica napus
gctccatcccaattaaaagccatagctgatctaatcaatgttccaaggttccctggatcctgtatgctgtcaagaacaagaactctgtgagcagaagggaaccatttcttacaatctgttataatgtcttcatcatctttaagatcgatgaagctgctagggattctcatcaaggcaacggcttcaacagattctatagactgcacaccagcgagtttcttcatcaccaaagaactaactcgaacgacgcggacacctagactctccaacccttgtggaatctgagcttcctcgtggagaagaagacactcaatctcagtggcgactcctccttgcttgttcgtttggaacatacacacttccctgatcgggatagctccgacgacgagaacagagccgtgggcgtagcggtaagaggcgctttgacggagcttcaagcagtgtttgacaaatgggttcgatgtgctggtgatggagtccacgtgagagggtaacgaaaccctcgtcgccggagatttctctgtgagatcatcggtatcgcttaagctgagatttgcattgacaagtagccatgggtaaagagaagtttcacatcaacattgtggtcattggtcatgtcgactctgggaaatcaaccaccactggtcacttgatctacaagcttggtggtattgacaagcgtgtgattgagaggttcgagaaggaggctgctgagatgaacaagaggtctttcaagtatgcgtgggtgttggacaaactgaaggctgagcgtgagcgtggtatcaccattgacattgctctttggaagtttgagaccaccaagtactactgcactgtcattgatgctcctggacatcgtgatttcattaagaacatgattactggtacctcccaggctgattgtgctgtcctcatcattgactccaccaccggcgggtttgaagctggtatctccaaggatggtcagacccgtgagcatgctcttcttgccttcacccttggtgtcaagcagatgatttgctgctgtaacaagatggatgcaactactcccaagtactccaaggctaggtacgatgagatcatcaaggaggtgtcttcctacttgaagaaggttggatacaacccggacaaaatcccattcgtccccatctctggttttgagggagacaacatgattgagaggtccaccaaccttgactggtacaagggaccaactctccttgaggcacttgaccagatcaacgagcccaagaggccatcagacaagcccctccgtcttccacttcaggacgtctacaagattggtggtattggaacggtgccggtgggtcgtgttgagaccggtatgctcaagcctggtatggttgtgacctttgctccatcagggttgaccactgaggttaagtctgttgagatgcaccacgagtctcttgtggaggcacttccaggtgacaacgtcggattcaatgtcaagaatgttgctgtgaaggatcttaagcgtgggtatgttgcgtccaactccaaggatgaccctgccaagggtgctgccaacttcacctcccaggtcatcatcatgaaccaccctggtcagattggtaacggttacgctccagttctcgactgccacacttcccacattgccgtcaagttctctgagatcctcaccaagattgacaggcgttctggtaaagagatcgagaaggagcctaagttcttgaagaatggtgacgctggtatggtgaagatgactccaaccaagcccatggttgttgagaccttctctgagtacccaccccttggacgttttgccgtgagggacatgaggcagactgttgcagtcggtgttatcaagagcgttgacaagaaggacccaaccggagccaaggttaccaaggctgccgtcaagaagggtgccaagtgaactatcatcatccagactctatcatcctcaactgcagatgaaccaaagaactttgtgtgttttcctactctagtttggtacgttgttgcttgtttgtgttacagtttcgtcccttctccgtcagaacgtaattctcgtaattgggttcttgataggaggtggcggagcttcgtcacataaaagcagcattgtttttgctttacatttgttatctgaattttgagacttcttttcatattatgttatgatatggtgacattcctgcggatattgattaccttgtttgttttttcactccgtgcttattggtcttgaaaaaatttcaagaggtattcataaaaagaattatacatgagggcacattgaacgtgtgccaagcctac

SEQ ID NO: 1127 - DNA, 1532 bp, Brassica napus
cagctatgggtaaagagaagtttcacatcaacattgtggtcattggccatgtcgactctgggaaatcgaccaccactggtcacttgatctacaagcttggtggtattgacaaacgtgtcatcgagagattcgagaaggaagctgctgagatgaacaagaggtctttcaagtacgcttgggtgttggacaaacttaaggccgagcgtgagcgtggtatcaccattgacattgctctctggaagttcgagaccaccaagtactactgcacggtcattgatgcccctggacatcgtgatttcatcaagaacatgattactggtacctcccaggctgattgtgccgtcctcatcattgactccaccactggtggttttgaagctggtatctccaaggatggtcagacccgtgaacatgctcttcttgctttcacccttggtgtcaagcaaatgatttgctgctgtaacaagatggatgccactacccccaagtactctaaggctaggtacgatgagatcatcaaggaggtgtcttcctacttgaagaaggttgggtacaaccctgacaaaatcccattcgtccccatctctggattcgagggtgacaacatgattgagaggtccaccaaccttgactggtacaagggaccaactctccttgaggctcttgaccagatcaacgagcccaagaggccctcagacaagcccctccgtctcccacttcaggatgtctacaagatcggtggtattggaacggtgccagtgggacgtgttgagaccggtatgctcaagcccggtatggttgtgaccttcgctccttcagggttgaccactgaggttaagtctgttgagatgcaccacgagtctcttgtggaggcgcttccaggtgacaacgttgggttcaatgttaagaatgttgctgtcaaggatcttaagagagggtatgttgcatccaactccaaggatgacccagctaagggagctgccaacttcacatcccaggtcatcatcatgaaccaccctggtcagatcggtaacggatacgccccagtcctcgattgccacacgtcccacattgcagtcaagttctctgagatcttgaccaagattgacaggcgatctggtaaggagatcgagaaggagcccaagtttttgaagaatggtgatgctggtatggttaagatgactccgaccaagcccatggttgtcgagactttctcagagtacccaccattgggacgtttcgctgtcagagacatgaggcagaccgttgctgttggtgtcatcaagagcgttgacaagaaggacccaaccggtgccaaggtgaccaaggccgcagtgaagaagggagcaaaatgatgagacttctctcgtctttgtgttttctttgctttaaaaaaaaactttgatggcgtttgagcctttgttcttttattttctgttactttctcatctctacctcctttttattatatctctgagacttatgggttacaattatgcagtttctggataattttgcctagtgtttcgttt

SEQ ID NO: 1128 - DNA, 1655 bp, Brassica napus
atcttctcttccaacctagccgctattacctctcagatttttacttagccatgggtaaagagaagtttcacatcaacattgtggtcatcggccacgtcgactccgggaagtcaaccaccacggggcacttgatctacaagctcggcggtatcgacaagcgtgtgatcgagaggttcgagaaggaggctgctgagatgaacaagaggtctttcaagtacgcgtgggtgttggacaagcttaaggctgagcgtgagcgtggtatcaccattgatattgctctttggaagtttgagaccaccaagtactactgcacggttattgacgctcctggtcatcgtgatttcattaagaacatgatcactggtacctcccaggctgattgtgctgttttgattattgattccactactggtgggttcgaggctggtatctctaaggatgggcagactcgtgagcatgctcttcttgctttcacacttggtgtcaagcagatgatttgctgctgtaacaagatggatgctactacccccaagtactccaaggcgaggtacgatgagattatcaaggaggtgtcttcctacttgaagaaggttgggtacaaccctgacaaaatccccttcgttcccatctctggtttcgagggtgacaacatgattgagaggtccaccaaccttgactggtacaagggaccaactctccttgaggctcttgaccagatcaacgagccaaagaggccttcagacaagcccctccgtctaccacttcaggatgtctacaagattggtggtattggaacggtgccggtgggtcgtgttgagaccggtatgctcaagcctggtatggttgtgacctttgctccttcagggttgaccactgaggttaagtctgttgagatgcaccacgagtctcttgtggaggcgcttccaggtgacaatgtcgggttcaacgttaagaatgttgctgtgaaggatctcaagcgtgggtacgttgcatccaactccaaggatgatcctgccaagggtgctgctaacttcacctcccaggttatcatcatgaaccaccctgggcagattggtaacggttacgccccggttcttgactgccacacgtcccacattgccgtgaagttctctgagatcctcaccaagatcgacaggcgttctggtaaggagattgagaaggagcccaagtttttgaagaatggtgatgctggtatggtgaagatgactccgaccaagcccatggttgttgagaccttctctgagtacccaccacttggacgtttcgctgtgagggacatgaggcagactgttgcagtcggtgtcattaagagcgttgacaagaaagacccaaccggagccaaggtgaccaaggctgccgtcaagaagggtgcgaagtaaagttcggtcatcaactactctctatcatccgcagatgaatcaaagtcctattttagttttcttgcattgttagtttggttttgtgtcgcttgtttgtgtaagagcttcgtttcgtctccttcagaactctcttctcgtaattgggttcttgatcggaggtggcggagctactagtctctcaagctttctgtttctttttgcttttggattatgaactgttttgaatattttgttatgaaaatgatgacattcctg

SEQ ID NO: 1129 - DNA, 1690 bp, Brassica napus
gataatttggggagttgggggtgtttgttattgttgtatatgagatgatccctgcagtacggcccggaatttagtgccgacaaaagagtccgagccgcatctctcacattctaactcgcagctatgggtaaagagaagtttcacatcaacattgtggtcatcggccatgtcgactctggaaaatcgaccaccactggtcacttgatctacaagctcggtggtattgacaagcgtgtcatcgagaggttcgagaaggaggctgctgagatgaacaagaggtccttcaagtacgcctgggtcttggacaaacttaaggccgagcgtgagcgtggtatcaccattgatatcgctctctggaagttcgagaccaccaagtactactgcacggtcattgacgctcctggacatcgtgatttcatcaagaacatgattactggtacctcccaggctgattgtgctgttttgatcattgactctaccactggtggtttcgaggctggtatctccaaggatggtcagacccgtgagcatgctcttcttgctttcacccttggtgtcaagcagatgatttgctgctgtaacaagatggatgctactacccctaagtactccaaggctaggtacgatgagatcatcaaggaggtgtcttcctacttgaagaaggttgggtacaaccctgacaaaatcccattcgttccaatctctgggttcgagggtgacaacatgattgagaggtccaccaaccttgactggtacaagggaccaactctccttgaggctcttgaccagatcaacgagccaaagaggccctcagacaagcccctccgtctcccacttcaggatgtctacaagatcggtggtattggaacggtgccagtgggacgtgttgagaccggtatgctcaagcccggtatggttgtgaccttcgctccttcagggttgaccactgaggttaagtccgttgagatgcaccacgagtctcttgtggaggcgcttccaggtgacaacgttgggttcaatgttaagaatgttgctgtcaaggatcttaagagagggtatgttgcatccaactccaaggatgaccctgccaagggtgctgccaacttcacctcccaggtcatcatcatgaaccaccctggtcagatcggtaacggatacgccccggttcttgattgtcacacatcccacattgcagtcaagttctctgagatcctcaccaagattgacaggcgatctggaaaggagattgagaaggagcccaagttcttgaagaatggtgatgctggtatggttaagatgactccaaccaagcccatggttgttgagactttctctgagtacccaccattgggtcgtttcgctgttagggacatgaggcagacggtggctgttggtgttatcaagagcgtcgacaagaaggacccaaccggtgctaaggtcaccaaggctgcagttaagaagggagctaaatgatgagacttctcagtctttggtttttctttgcattacaaaaactttgatggcgtttgagcctttttcttattttctgcgacttttttctaccttgtttttggatctctgagactattgtggttttcaattatgcagcttttggataattttgcctaaatgctttacgctctcgagttgttcgttaagttgcttaaaagaggagaagttcttgttacgt

SEQ ID NO: 1130 - DNA, 1669 bp, Brassica napus
gaatctcgatctttcttcaacctagccgctacactgagattcatttgacaagtagctatgggtaaagagaagtttcacatcaacattgtggtcattggccatgtcgattctgggaaatcgactaccactggtcatttgatctacaagcttggtggtattgacaagcgtgtgattgagaggttcgagaaggaagctgctgagatgaacaagaggtccttcaagtatgcgtgggtgttggacaaattgaaggctgagcgtgagcgtggtatcaccattgacattgctctttggaagtttgagaccaccaagtactactgcacagtcattgatgctcctggacatcgtgatttcatcaagaacatgattactggtacctcccaggctgattgtgctgtcttgatcattgactccaccactggtggtttcgaagctggtatctccaaggatggtcagacacgtgagcatgctctccttgctttcacccttggtgtcaagcagatgatttgctgctgtaacaagatggatgccacaactcccaagtactctaaggccaggtacgatgagatcatcaaggaggtgtcttcatacctgaagaaggttgggtacaaccctgacaaaatcccattcgtccccatctctggttttgagggtgacaacatgattgagaggtccaccaaccttgactggtacaagggaccaactctccttgaggcacttgaccagatcaacgagcccaagaggccatcagacaagcccctccgtcttccacttcaggatgtctacaagattggtggaattggaacggtgccagtgggtcgtgttgaaaccggtatgctcaagcctggtatggttgtcacctttgctccttcagggttgaccactgaggttaagtctgttgagatgcaccacgagtctcttgtggaggcacttccaggtgacaacgtcggattcaatgtcaagaatgttgctgtcaaggatctcaagcgtgggtacgttgcatccaactccaaagatgacccagctaagggtgctgctaacttcacttcccaggtcatcatcatgaaccaccccggtcagattggtaacggttacgcaccagttcttgactgccacacttcccacattgccgtcaagttctctgagatcctcaccaagattgacaggcgttctggtaaagagatcgagaaggagcccaagttcttgaagaatggtgatgctggtatggtgaagatgactccaaccaagccaatggttgttgagaccttctctgagtacccacctcttggacgtttcgccgtgagggacatgaggcagactgttgcagtcggcgtcatcaagagcgttgacaagaaggacccaaccggagccaaggtgaccaaggctgccgtcaagaagggtgccaagtgaactaccttgaggaaaactcaatcatccgcagttgaatggaaagacaattttagttttttggttacattagttttgtatttggccgcttgtctgtgttgcagcttcgttacttctccgtcagagctttgttcacttaactaggttcttgatcggaggtggtgaagctactcattactctagcttccttcttttttactttgttttgctttcggattctgaactattttggatgctctctttataatgaatatggtatgtcgtt

SEQ ID NO: 1131 - DNA, 1629 bp, Brassica napus
tatctgagatttgcattgacaattagccatgggtaaagagaagtttcacatcaacattgtggtcattggtcatgtcgactctggaaagtcaaccaccactggtcacttgatctacaagcttggtgggattgacaagcgtgtgatcgagaggttcgagaaggaagctgctgagatgaacaagaggtctttcaagtatgcgtgggtgttggacaaattgaaggctgagcgtgagcgtggtatcaccattgatattgctctctggaagttcgagaccactaagtactactgcacagtcattgatgctcctggacatcgtgatttcatcaagaacatgattactggtacctcccaggctgattgtgctgtccttatcattgattctaccactggtggttttgaagctggtatctccaaggatggtcagacccgtgagcatgctcttcttgctttcacccttggtgtcaagcagatgatttgctgctgtaacaagatggatgctactacccctaagtactccaaggctaggtacgatgagattatcaaggaggtgtcttcctacttgaagaaggttgggtacaacccggacaaaatcccattcgtccccatctctggtttcgagggtgacaacatgattgagaggtccaccaaccttgactggtacaagggaccaactctccttgaggcacttgaccagatcaacgagcctaagaggccatcagacaagcccctccgtctgccacttcaggacgtctacaagatcggtggtattggaacggtgccagtgggtcgtgttgagaccggtatgctcaagcctggtatggttgtaacctttgctccttcagggctgaccactgaggttaagtctgttgagatgcaccacgagtctcttgtggaggcacttccaggtgacaacgtcggattcaatgtcaagaatgttgctgtgaaggatctcaagcgtgggtatgttgcatccaactccaaggatgaccctgccaagggtgctgccaacttcacttcccaggtcatcatcatgaaccacccgggtcagattggtaacggttacgctccagttcttgactgccacacttcccacattgccgtcaagttctctgagatcctcaccaagattgacaggcgttctggtaaagagatcgagaaagagccgaagttcttgaagaatggagatgctggtatggtgaagatgactccaaccaagccaatggttgttgagaccttctctgagtacccacctcttggacgtttcgccgtgagggacatgaggcagactgttgcagtcggtgttatcaagagcgttgacaagaaggacccaaccggagccaaggttaccaaggctgcggtcaagaagggtgccaagtgaactatcatcatcgagactctatcatcatcaaccgcagatgaactaaagaactttgtgtgttttaatactctagtttggtacgttgttgcttgtttgtgttacagtttcatcccttctccgtcagaacgtaattctcgtaaatgggttcttgataggaggtggcggagcttcgttacataaaatcagcattgttttcgcgttaaaccgccatctgcacccgagagatccctcacctacctctacagtggtcc

SEQ ID NO: 1132 - DNA, 1680 bp, Brassica napus
tcagatatcgcttatctgagatttgcattgacaattagccatgggtaaagagaagtttcacatcaacattgtggtcattggtcatgtcgactctggaaagtcaaccaccactggtcacttgatctacaagcttggtgggattgacaagcgtgtgatcgagaggttcgagaaggaagctgctgagatgaacaagaggtctttcaagtatgcgtgggtgttggacaaattgaaggctgagcgtgagcgtggtatcaccattgatattgctctctggaagttcgagaccactaagtactactgcacagtcattgatgctcctggacatcgtgatttcatcaagaacatgattactggtacctcccaggctgattgtgctgtccttatcattgattctaccactggtggtttcgaagctggtatctccaaggatggccagacccgtgagcatgctcttcttgctttcacccttggtgtcaagcagatgatttgctgctgtaacaagatggatgctactacccctaagtactccaaggctaggtacgatgagattatcaaggaggtgtcttcctacttgaagaaggttgggtacaacccggacaaaatcccattcgtccccatctctggtttcgagggtgacaacatgattgagaggtccaccaaccttgactggtacaagggaccaactctccttgaggcacttgaccagatcaacgagcccaagaggccctcagacaagcccctccgtctcccacttcaggatgtctacaagattggtggtattggaacggtgccagtgggtcgtgttgaaaccggtatgctcaagcctggtatggttgtcacctttgctccttcagggttgaccactgaggttaagtccgttgagatgcaccacgagtctcttgtggaggcacttccaggtgacaacgtcggattcaatgtcaagaatgttgctgtcaaggatctcaagcgtggttacgttgcatccaactccaaggatgatccagcaaagggtgctgccaacttcacttcccaggtcatcatcatgaaccacccggggcagattggtaacggttacgctccagttcttgactgccacacttctcacattgccgtcaagttctctgagatcctcaccaagattgacaggcgttctggtaaagagatcgagaaggagcccaagttcttgaagaatggtgacgctggtatggtgaagatgactccaaccaagcccatggttgttgagaccttctctgagtacccacctcttggacgttttgccgtgagggacatgaggcagacagttgcagtcggtgttatcaagagcgttgacaagaaggacccaaccggagccaaggttaccaaggctgccgtcaagaagggtgccaagtgaactatcatcatcgagactctatcatcatcaaccgcagctgaaccaaagaactttgtgtgttttcttactctagtttggtacgttgttgcttgtttgtgttacagtttcgtcccttctccgtcagaacgtaattctcgtaattgggttcttgataggaggtggcggagcttcgtcacataaaagcagcattgtttttgcgtttcatttgttatctgaattttgagacttcttttcatattatgttatgatatggtgacattcctgcggatattgatttccttgtttgtttt

SEQ ID NO: 1133 - DNA, 1634 bp, Brassica napus
acctctgagatttttacttagccatgggtaaagagaagtttcacatcaacattgtggtcatcggccacgtcgactccgggaagtcaaccaccacgggtcacttgatctacaagctcggtggtatcgacaagcgtgtgatcgagaggttcgagaaggaggctgctgagatgaacaagaggtctttcaagtacgcgtgggtgttggacaagcttaaggctgagcgtgagcgtggtatcaccattgatattgctctttggaagtttgagaccaccaagtactactgcacggttattgacgctcctggtcatcgtgatttcattaagaacatgatcactggtacctcccaggctgattgtgctgttttgattattgactccactactggtgggtttgaggctggtatctctaaggatgggcagactcgtgagcatgctcttcttgctttcacacttggtgtcaagcagatgatttgctgctgtaacaagatggatgctactacccccaagtactccaaggctaggtacgatgagattatcaaggaggtgtcttcctacttgaagaaggttgggtacaaccctgacaaaatccccttcgttcccatctctggtttcgagggtgacaacatgattgagaggtccaccaaccttgactggtacaagggaccaactctccttgaggctcttgaccagatcaacgagccaaagaggccttcagacaagcccctccgtctaccacttcaggatgtctacaagattggtggtattggaacggtgccggtgggtcgtgttgagaccggtatgctcaagcctggtatggttgtgacctttgctccttcagggttgaccactgaggttaagtctgttgagatgcaccacgagtctcttgtggaggcgcttccaggtgacaatgtcgggttcaacgttaagaatgttgctgtgaaggatctcaagcgtgggtatgttgcatccaactccaaggatgatcctgccaagggtgctgctaacttcacctcccaggtcatcatcatgaaccaccctgggcagattggtaacggttacgccccggttcttgactgccacacgtcccacattgcggtgaagttctctgagatcctcaccaagattgacaggcgttctggtaaggagattgagaaggagcccaagtttttgaagaatggtgatgctggtatggtgaagatgactccgaccaagcccatggttgttgagaccttctctgagtacccaccacttggacgtttcgctgtgagggacatgaggcagactgttgcagtcggtgtcatcaagagcgttgacaagaaagacccaaccggagccaaggtgaccaaggctgccgtcaagaagggtgcgaagtaaagttcggtcatcaactactctctatcatccgcagatgaatcaaagtcctattttagttttcttgcattgttagtttggttttgtgtcgcttgtttgtgtaagagcttcgtttcgtctccttcagaactctcttctcgtaattgggttcttgatcggaggtggcggagctactagtctctcaagctttctgtttctttttgcttttggattatgtactgttttgaatattttgttatgaaaatgatgacattcctgcggtta

SEQ ID NO: 1134 - DNA, 1695 bp, Brassica napus
tcagatatatatatacacacacgcatctcgatctctctctccaacctagccgctacacttatcttccctctaccacatcactgagattagccatgggtaaagagaagttccacatcaacatcgtggtcatcggccacgtcgactccggaaaatccacaaccaccggtcacttgatctacaagctcggcggtatcgacaagcgtgtcatcgagaggttcgagaaggaagccgccgagatgaacaagaggtctttcaagtacgcgtgggtccttgacaagctcaaggccgagcgcgagcgtggtatcaccatcgacattgctctctggaagttcgagaccaccaagtactactgcaccgtcatcgacgctcctggccatcgcgatttcatcaagaacatgatcactggtacctcccaggctgattgtgctgttttgatcatcgattccaccaccggtgggtttgaggctgggatctctaaggatggtcagactcgtgagcatgctcttctcgctttcacgcttggtgttaagcaaatgatttgttgttgtaacaagatggatgctactactcctaagtactctaaggctaggtacgatgagattatcaaggaggtttcttcttacttgaagaaggttggttacaaccctgacaagattccttttgttcccatctctggtttcgagggtgacaacatgattgagaggtcaaccaaccttgactggtacaaggggccgactctcctcgaggctcttgaccagatcaacgagcccaagaggccctctgacaagcccctccgtcttcccctccaggatgtctacaagattggtgggattggaacggtgccggtgggacgtgttgagaccggtatgctcaagcccggtatggttgtgacattcgctccttcgggtttgaccactgaggttaagtctgttgagatgcaccacgagtctcttgttgaggcgcttccgggtgacaacgttgggttcaatgttaagaacgttgctgtcaaggatcttaagcgtgggtacgttgcgtccaactccaaggatgaccctgctaaaggtgctgctaacttcacctcacaggttatcattatgaaccaccctggtcagattggtaacggttacgctccggttcttgattgccacacgtcccacattgctgttaagttctctgagattttgaccaagattgataggcgttctggtaaggagattgagaaggagcccaagtttttgaagaatggtgatgctggtatggttaagatgactccgaccaagccaatggttgttgagactttctctgagtacccgccgcttggacgtttcgctgttagggacatgaggcagactgttgcagttggtgtcatcaagagtgttgacaagaaggacccgaccggagctaaggtgaccaaggctgccgtcaagaagggtgccaagtaaagtacctttagcaagagtctatcatcagaagacaattttagttttttacattagtgtggtgtttggtcgtttgtttgtgttatagcttcgtctcttgtccgtcagaaccatgttctcgtaattgggttcttgatcggaggtggcggagctatgttgaagtctagctttactgtttttttgtttacttttgctaccgggttatgaactattttggatgttatgttattatgaatatggcatgagatcatttctt

SEQ ID NO: 1135 - DNA, 1410 bp, Brassica napus
gagttctctctcgctcagttttcacagccgcaagactgctctcagattcttactagcagctatgggtaaagagaagtttcacatcaacattgtggtcattggccatgtcgactctggcaaatcgaccactaccggtcacttgatctacaagcttggtggtattgacaagcgtgtcatcgagaggtttgagaaggaggctgctgagatgaacaagaggtccttcaagtacgcgtgggtgttggacaaacttaaggccgagcgtgagcgtggtatcaccattgacattgctctctggaagttcgagaccaccaagtactactgcaccgtcattgatgcccctggtcatcgtgatttcatcaagaacatgattactggtacctcccaggctgattgtgctgtcctcatcattgactccaccactggtggttttgaggctggtatctccaaggatggccagactcgtgagcatgctcttcttgctttcacccttggtgtcaagcaaatgatttgctgctgtaacaagatggatgccacaacccccaagtactccaaggctaggtacgatgagatcatcaaggaggtgtcttcctacttgaagaaggttgggtacaaccctgacaaaatcccattcgtccccatctccggattcgagggtgacaacatgattgagaggtccaccaaccttgactggtacaagggaccaactctccttgaggctcttgaccagatcaacgagccaaagaggccttcagacaagcccctgcgtctaccacttcaggatgtctacaagatcggtggtattggaacggtgccagtgggtcgtgtggagactggtatgctcaagcccggtatggttgtgacattcgctccttcagggttaaccactgaggtcaagtccgttgagatgcaccacgagtctcttgtggaagcgcttcctggtgacaatgtcggattcaatgtcaagaatgttgccgtcaaggatcttaagcgtgggtatgttgcatccaactccaaggatgatcctgctaagggagctgctaacttcacatcccaggtcatcatcatgaaccaccctggtcagatcggtaacggttacgcccctgtccttgattgccacacctcccacattgcagtcaagttctctgagatcctcaccaagattgacagacgatctggtaaagagatagagaaggagcccaagtttttgaagaatggagatgctggtatggtgaagatgactccgaccaagcccatggttgttgagacgttctcagagtacccaccattgggacgtttcgctgttagggacatgaggcagactgttgctgttggtgtcatcaagagcgttgacaagaaggacccaaccggtgccaaggtcaccaaggctgcagtcaagaagggtgctaaatg

SEQ ID NO: 1136 - DNA, 2457 bp, Distylium racemosum
cccttctcttgatttaaatttaatcttaatggattttttgcaaaggttttgaaatacccatgacaacacttatccaggtaaatacaacatgaattcactccttagtagttggtccctcttggatgaacttccctagagtattaccaatatcttttttttttatttgagtaaatacttcttatacatatacatatccgtcatggggattgaacccgggtcacatcactgatattgcacgggggggtttagagcgagtatatgttggcgaggaagggattgaacaaaccctctctcatattttcattcagtgagcattcgtcgcttcgttccgccgctcgctctctgggttctctgcaagcctcaggctctcctgcaagtttttgagttcgagtaaacatgggtaaagagaagactcacatcaacattgtggtcattggccatgtcgactctggaaagtcaactaccactggtcaccttatctataagttgggtggtattgacaagcgtgtcattgaacggtttgagaaggaagctgctgagatgaataaaagatcattcaagtatgcttgggtgcttgacaagctcaaggctgagcgagaacgtggtatcaccattgatattgcattgtggaagtttgagaccaacaaatattattgcactgttattgatgctcctggtcaccgtgacttcattaagaacatgatcacggggacctcgcaggctgattgcgcagtgctgattattgattcaactaccggaggttttgaggctggtatttccaaggatggtcaaaccagagagcatgcattgctggcgtttacattgggagtcaagcaaatgatttgctgttgtaacaagatggatgctaccactcccaagtattcaaaaggtcggtatgaggaaattgtcaaggaagtgtcttcctacctgaagaaggttgggtataatcctgacaaaattccatttgtgcccatctctggttttgagggggataacatgattgagcgatcaagtaaccttgattggtacaagggtccgaccttgttggaagctcttgaccaggtttctgagcccaagcgtcctacagacaagcctctcaggctgcctcttcaggacgtttacaagattggaggtatcggaactgtgcctgtgggacgagttgaaacgggtgttttgaaaccaggtacggttgtaacgtttggtcctacagggctgaccactgaagttaagtctgtagagatgcaccatgaagctctgcaagaggcattgccaggtgacaatgttggattcaatgtgaaaaacgttgctgttaaggatctcaagcgaggatatgtggcatctgattctaaaaatgacccagcaaaggaggcagccaacttcacatcccaggtcattatcatgaatcatcccggacagattggtaatgggtatgctcctgtgcttgattgccacacttgccacattgccgtgaaatttgctgagattttgaccaaggttgataggcggtctggcaaagagcttgagaaggagcccaagttcattaaaaatggagatgctggatttgtgaagatggttccaaccaagcccatggttgtggaaactttctccgagtatcctccactgggtcgatttgctgtgagggatatgcgtcagactgttgctgtcggagtcatcaaggctgttgagaagaaggaccctactggtgctaaagtcaccaaggcagctgccaagaaaaagtgaaagtccatgggacttttgcagaagttcaggggcgcaagcagcatcttgcgtgtttgcatgcttgatttttgcattaatagtgtggtaataggaatgttattagcttgtcatatgcaaaattgggttcttgataggcggtggcatatttattttatgttagtggtttagggaagaaactattgagatttctcagttgcggggaaatttttgatttgtctgcactgctaggaaatctatgcagtctgagttgagtggggagtttaataatttttaagtactttgatttgtcatgaaaactttttaaagagattcaatgttttgatattcgtcgagatttaaaatgaatgcatatgagatatgagtcttccgttggcacatagaattgttcacttggtggtgggatctttagtgcaatccttcaattggtccattcctaatgaggatgttggtattgatatgagtgagaagtttgggttgactctgctgaaagccattcctttgatggctatcgcttctccgcgcatttccatgaaaaatcacccttgaattcggcgaagttgtctaaattataagttttattctacttgtttgctgcaagaattttattgcaagtcaaaggattaaagcagataatgacatcctttatctttttacgacgaagaactacgtctgttgtgactaccctttgactataaataaagatttaatggttataaa

SEQ ID NO: 1137 - DNA, 1619 bp, Epimedium sagittatum
agagctttctagggtttctttgtcttccttcttttgtttgcatctttcggtagaacatcatgggtaaagagaagattcatatcagcattgtggtcattggccatgtggactctgggaagtccaccaccactggacatctcatctataagcttggtggtattgacaagcgtgtgattgagaggtttgagaaggaagcagctgagatgaacaaaaggtcattcaagtatgcatgggtacttgacaagcttaaggcagagcgtgaacgtggtatcactattgatattgccttgtggaagtttgagaccacaaagtactactgcactgttattgatgcccctggacatcgtgatttcatcaagaacatgatcactggaacttctcaggctgattgtgctgtcctcatcattgattccacaactggtggttttgaagctggtatttccaaggatggacagactcgtgagcatgcactgcttgctttcaccttgggagttaagcagatgatctgttgctgcaacaagatggatgccaccacaccaaagtattcaaagggtaggtatgacgaaattgtgaaggaggtgtcttcctacctgaagaaggtcggttacaaccctgacaaaattccttttgtcccaatatctggttttgagggagacaacatgattgagaggtctacaaacctcgactggtacaagggcccaactctccttgatgctttggaccagatttcagagcccaagcgtcctacagacaagccactccgtcttccattgcaagacgtgtacaagattggaggaattggaactgtgccagtcggtcgtgttgagactggaattattaagcctggtatggtttgcacttttggaccttctgggttgaccactgaagtcaagtctgtggagatgcaccacgaggctctccaagaggcacttcctggtgacaatgttggtttcaatgtgaagaatgttgctgtcaaggatctcaagcgtggttatgttgcttccaactcaaaggatgatccagcaaaggaagctgccaacttcacctcccaagtcatcatcatgaaccatcctggacagatcggtaacggttatgccccagttctcgactgccacacttgccacattgctgtcaagttccaggaaatattgaccaagatcgacaggcgatctggaaaggagctggagaaggagcccaagtttttgaagaacggtgatgccgggtttgtgaagatgattccaaccaagccaatggtggtggagaccttttctgagtatcctccccttggtaggtttgctgtgagggacatgagacagactgttgccgttggtgtcatcaagagtgttgagaagaaggacccatccggtgccaaggttaccaagtctgcagcaaagaagaagtaaatttgatttctagtagagtctttatcctagagacgggtcggttgtttctttttccatgttattgagtcggtgtcaggtcaagaactaagtgtctagtgtggtaatgtcctttttgtgctactgttgtgtcattttaattgctttttggtctgcattctgagataatttctaagttttgagctgaatgcatatatgtctgctgcataatttatttat

SEQ ID NO: 1138 - DNA, 1731 bp, Euonymus alatus
gacaatgggtaaagagaagattcacatcagcattgtggttattggccatgtcgactctggtaagtcaacaactactggccacttgatctacaagcttggaggcattgacaagcgtgttattgagagatttgagaaagaagctgctgagatgaacaagagatcattcaagtatgcctgggtgcttgataagcttaaagctgagcgtgaacgtggtatcaccattgatattgccttatggaagtttgagaccacaaagtactactgcactgtcattgatgcccctggacatcgtgacttcattaagaacatgattactggtacctcccaggctgactgtgctgttctgattattgactccactactggaggttttgaagctggtatctcgaaggatgggcagactcgtgagcatgctcttcttgcctttactcttggtgtcaaacaaatgatttgctgctgcaacaagatggatgccaccaccccaaagtactcaaaagctagatatgaggaaattgtcaaggaagtttcgtcctacctaaagaaggttggatacaaccctgataagattccatttgtccccatatctggatttgagggtgataacatgattgagaggtccaccaaccttgattggtacaagggtccaacccttcttgatgcccttgaccaggtcagtgaacccaagagacccacagacaagccactccgcctcccacttcaagatgtatataagattggtggaattggaactgttccagtgggccgtgttgagactggtatcctcaagcctggtatggttgttacctttggtccctctgggttgacaacggaagttaagtctgtggagatgcaccatgaagctttgcaagaggctcttcctggcgacaatgtcggtttcaatgtgaagaatgttgctgtcaaggatctcaagcgtggttttgttgcctcaaattctaaggatgatcctgccaaggaggctgccaacttcactgcccaagttatcatcatgaatcacccgggacaaattggaggtggttatgccccagtgcttgattgccacacttcccacattgcagtcaagttcgctgagttgcttaccaagattgacaggcgatcaggcaaggagcttgaaaaggagcccaaattcttgaagaatggtgatgctgggttcgtgaagatgattcccaccaagcccatggtggtggaaaccttctctgagtaccctcctctgggtcgttttgctgtcagggacatgcgtcagactgttgctgttggtgtcatcaaggctgtcgagaagaaggatcctagtggagctaaggtgacaaaatctgctgccaagaagggtggcaagtgaatcgtgctggctggccgtaataataaagactgggcttttgtccagatttcatctactgaatgtttacttctttgtttccatggttatagttttaagtcggctccatcatcgcgttcatactgttcacagaactgggtactggaccgacggtggcctgttattttcgcccttcatgatttggggcgtttgttgaatttttcatgttgaaacttgagtatgttgccactgtttcttaagccagcttaatagtttgtagctttttcctgtgctggatgagtgattttatctgcattttacaatttatatctagtatgtgtgttaaaattgtggatcagatactgcttttttgcgaatatggaagtggttcagttttagtt

SEQ ID NO: 1139 - DNA, 1732 bp, Euonymus alatus
cggccggggctctgccatctctctcactcaagccggcgagagagacacagtcgatcgttcttctagacttctatttgtcagctacagctagaatttcattatgggtaaggagaagactcacatcaacattgtggtcattggccatgtcgattccggaaagtcaaccacaactgggcacttgatttacaagcttggtggaattgacaagcgtgttattgagagatttgagaaggaagctgctgagatgaacaagagatcattcaagtatgcatgggtgttggacaaactcaaggctgagcgcgaacgtggtataaccattgatattgctctatggaagtttgagaccacaaagtactattgcactgttattgatgctcctggacatcgtgactttattaagaatatgatcactggtacctcacaagctgactgtgctgtcctcatcattgactcaaccactggtggttttgaagctggtatttccaaggatggccagacccgtgagcatgcactgcttgcttttactcttggtgtgaaacaaatgatttgttgctgcaacaagatggacgccactacacccaaatactctaaggctaggtatgaggaaattgtgaaggaagtttcttcctacttgaagaaggttggttacaaccctgacaagatcccatttgttcccatctctggttttgagggtgacaacatgatcgagagatctaccaaccttgactggtacaagggcccaaccctccttgaagctcttgaccagatctcggaacccaagaggccctcagacaagcccctccgtctcccccttcaggatgtttacaagattggtggtattggaactgtcccagtcggacgtgttgagactggcatcctgaagcctggtacggttgtgacctttggtcctactggactcacaactgaagttaaatctgttgagatgcaccacgaggctctccaggaggccctgccaggtgacaatgtgggtttcaatgtcaagaatgttgctgtgaaggatctgaagcgtggttttgttgcttctgactcgaaaaatgaccctgctaagggggctgccagcttcacctctcaggtcatcatcatgaaccaccctgggcagattggaaatggctatgccccagtccttgattgtcacacatcccacattgctgtgaagtttgctgagatcttgactaagattgacaggcgatctggtaaggagattgagaaggaaccaaaatttttgaagaatggtgatgcaggaatagtgaagatgattccaaccaagcctatggtggtggagaccttctctgcgtaccctcctcttggtcgttttgctgtacgggacatgcgccagactgtggctgtgggtgtcgttaagagtgttgacaagaaagaagcatctgctgctaaggtcaccaagtctgctgccaagaagaagtgactcatgggagttcactgtttgacatcttctgctgaagtctacttccatacgaataatcgtctttccgttgttactgtcatatttggttgtttatttcgttttatatggtacagttttgtgccgtctttgttgggttcctggtttgagaactgggtacttgacaggcggtggcacagcttatagcatgaagttttattagtgtttttagagattgtattagtgttgattttctgttaagattactatgtttgaggtgtgttggtttttcccctgacgatttgaagttct

SEQ ID NO: 1140 - DNA, 2070 bp, Marchantia polymorpha
gccttcctcttcggctcgtcgagctcgagaaaagagctctagcagctctcactgtcagttggtcggatcgtcgagagctcttgcgtgcgagctcgttgggagattgcaagttagcaagatgggaaaggagaaatttcacatcaacatcgtggtcatcggacatgtcgactccggaaagtcgacgacgacgggtcacttgatctacaagctgggaggaatcgacaagcgagtgatcgagaggttcgagaaggaggcggcggagatgaacaagaggtcgttcaagtacgcgtgggtgctggacaagctgaaggctgagcgcgagcgcggtatcacgatcgatatcgctctgtggaaattcgagacgaacaagtactactgcactgtgatcgacgcccctggacacagggatttcatcaagaacatgatcacggggacgtcgcaggctgactgcgccgtgctgattatcgactcgacgacgggagggttcgaggccggaatctccaaggacgggcagacccgcgagcacgcgctgctggccttcacgctgggagtgaagcagatgatttgctgctgcaacaagatggacgcgacgacgcccaagtactccaagggaaggttcgaggagatctcgaaggaggtgtcgaactacctgaagaaggttgggtacaaccccgataagatcccgttcgtgcccatctccgggttcgagggcgacaacatgatcgagaggtcgacgaacctggactggtacaaggggccgactctgctggacgcgttggacaacatctccgagcccaagaggccgtcggacaagcccctgaggctgccgctgcaggacgtgtacaagatcggaggaatcggaaccgtgccggtggggcgggtggagacgggagtgatcaagcccggcatggtggtgtgcttcgcgcccaccggtctgacgacggaggtgaagtcggtggagatgcaccacgaggcgctgctggaggcgctgcccggtgacaacgtcgggttcaacgtcaagaacgtggcggtgaaggacctgaagcgtgggttcgtggcctcggactcgaagaacgaccccgcgaaggaggccgccaacttcacgtcgcaggtcatcatcatgaaccacccgggccagatcggcaacgggtacgcgccggtgctggactgccacacctcgcacattgctgtgaagttcgccgagatcttgaccaaggtggaccgacggtctggtaaggagatcgagaaggagcctaagttcctgaagaacggtgacgccgggttcgtgaagatgattccgaccaagcccatgacggtagagacgttcgccgagtacccgcccctgggtcgtttcgccgtgcgcgacatgaggcaaacggtggccgtcggtgtcatcaaggccgtcgagaagaaggagcccaccggcgccaaggtcaccaaggccgccgccaagaagaagtagtcactaacgcctgacgagctacttcacagttttgacactaccattatcttccattgttcgtcatttcccagacagggtcgagctggtcggaaccaaagttgggtgctggacaggcggtggcaaggcttagatgaggtggttcccggtggcttagtcgcattcgtaggatcagtaggtgtctcgcctaaattcaggtcgctcgatttcaagcagagcttgttcgcattacatttcgttacccattgcattggaggagtcgattcatcatttaccagagaaggaccgggaaagagcaagaacgatgagacgtgtttctcttagtcggagaatatcgaaaactttctctcaaaatgaacgtcagcgagctacaactactttgcagaagaggatggaggaaggggcagccatagtgcagttttggaagacaagacggactggagatttgtaagccaggataggaaatagaaccgggaaatagcaagaggttacagtgggatgcacggacaagctgtctgagagcagttctaggaatgtttgagatcgaagaccttcaaaacagaggatttggaataaattattcacagctggatcatacatatcgtcgcctc

SEQ ID NO: 1141 - DNA, 1366 bp, Tropaeolum majus
aaggcggcgagagagatttcatcaactccggattctcacttttagctcaccatgggtaaggaaaaggttcatatcaacattgttgtcatcggacatgtcgactccgggaaatcgaccaccactggtcacttgatctataagctaggaggtattgacaagcgtgtcatcgagagattcgagaaggaagctgctgagatgaacaaaaggtcattcaagtacgcatgggtgttggacaagctcaaggctgagcgtgagcgtggtatcaccatcgatattgctttatggaagtttgagaccaccaaatattactgcacagtcatcgatgctcccggacatcgtgatttcatcaagaacatgattactggaacctcacaggctgactgtgctgtccttattattgattccaccactggtggttttgaagctggtatctccaaggatgggcagactcgtgagcacgctttgcttgcattcactctaggtgtcaagcagatgatttgctgctgtaacaagatggatgccaccacccccaagtactccaaggctaggtttgatgaaatcaccaaggaagtttcttcctacctgaagaaggttggatacaaccctgacaaaattgccttcgttcccatctccgggtttgagggtgacaacatgattgagagatctaccaaccttgactggtacaagggaccaactcttcttgaggctcttgacttaatcaacgagcccaagaggccctcagacaagccactccgtctaccacttcaggatgtttacaagattggtggtattggaacggtgccagtgggtcgtgttgagactggtgttgtgaagccaggtatggttgtgacttttggccccactggactgaccactgaggttaagtcggttgagatgcaccacgaagctctccaggaggctcttcccggtgacaatgttggctttaatgtcaagaatgttgctgtgaaggatctcaagcgtggtttcgttgcatccaactcaaaggatgaccctgctaaggaagctgccaacttcacttcccaggttatcatcatgaaccaccctggtcaaatcggaaatggatatgccccagtcctcgattgccacacttcccacattgctgttaagtttggtgagatcttgaccaagattgacaggcgttctggaaaggagcttgagaaggaacccaagtttttgaagaatggtgatgctggtatggttaagatgattccgtcaaagcccatggttgtcgagacttttgccacctacccaccacttggtcgttttgctgtgagggacatgaggcaaactgttgctgttggtgttatcaagagtgttgagaagaaagacccaactggagccaagg

SEQ ID NO: 1142 - DNA, 1656 bp, Avena sativa
cctcccctcccctccccgccgccgccagtgccaatatctattagttaagagctccatcaaccatggggaaggagaagattcacatcagcattgtggtcattggccatgtcgactctggcaagtcgacaaccactggccacctcatctacaagcttggaggcatcgacaagcgtgtgatcgagaggttcgagaaggaagctgctgagatgaacaagaggtctttcaagtacgcctgggtgctggacaagctcaaggctgagcgtgagaggggtatcaccatcgatattgccctctggaagtttgagactaccaagtactcctgcactgtcatcgatgctcctggacaccgtgacttcatcaagaacatgatcactgggacctcccaggccgattgtgctgtgcttatcattgactccaccactggtggttttgaggctggtatctccaaggatggccagacccgtgagcacgctctccttgctttcacccttggagtgaagcagatgatctgctgctgcaacaagatggatgccaccactcccaagtactccaagggccgttttgaggaaattgtcaaggaagttggctcctacttgaagaaggtgggctacaaccctgacaaggtcccatttgtccccatctctggatttgagggtgacaacatgattgagaggtccagcaaccttgactggtacaagggccccacccttcttgaggcgcttgaccagatcaatgagcccaagagaccctcagacaagcccctccgccttccccttcaggatgtctacaagattggtggcattggaactgtgccagtggggcgtgttgagaccggagtgatcaagcctggcatgcttgtcacctttggcccaactgggctgaccactgaggtgaagtctgtggagatgcaccatgagtccatgctggaggctgtgccaggtgacaacgttggcttcaacgtgaagaacgttgctgtgaaggatatcaagcgtgggtacgtcgcctccaatgccaaggacgaccctgccaaggaggctgccaactttgtcgcccaggtcatcatcatgaaccaccctggccagatcggcaatgggtacgccccagtgctggactgccacacgtcccacatcgccgtcaagttctctgagatccagaccaaggtggacaggcgttctggcaaggagatcgaggccttccccaagttcctcaagaacggtgacgctggcttcgtgaagatgattcccaccaagcccatggtggtggagaccttctcacagtaccctccccttggccgctttgctgtccgtgacatgaggcagaccgtcgctgttggtgtgatcaagagcgtggagaagaaggaacccaccggtgccaaggtgaccaaggctgccgccaagaagaaatgagatgatgcccggtggttgtacactgctacacctgtagtaatggcggtagtttatggtgatggtggtcgtgttaggcgtttcgggaactgttttgagttttgttgtgtgggtcgagcatccttcgtgctgctcattattctgtctttcagttgtgttggtgaactattggcatgctatgttcggttaaagttgctacttctatatatagtatgtcagggatttcggagtcaaatattatttgtctttagtt

SEQ ID NO: 1143 - DNA, 1689 bp, Avena sativa
tttccccgccgcggctttgacttcatcctcttcgcctgctcggagctccagccagttagttaacagctccagcagccatggggaaggagaagattcacatcagcattgtggtcattggccatgtcgactctggcaagtcaacaaccactggccacctcatctacaagcttggaggcatcgacaagcgtgtgatcgagaggtttgagaaggaagctgctgagatgaacaagaggtctttcaagtacgcctgggtgctggacaagctcaaggctgagcgtgagaggggtatcaccattgatatcgccctctggaagtttgagacgaccaagtactcctgcactgtcattgatgctcctggacaccgtgacttcatcaagaacatgatcactgggacctcccaggctgattgtgccgtgcttatcattgactccaccactggtggttttgaggctggtatctccaaggatggccagacccgtgagcatgctctccttgctttcacccttggtgtcaggcagatgatctgctgctgcaacaagatggatgccaccacccccaagtactccaagtctcgctttgaagaaattgtcaaggaagttggctcctacttgaagaaggtgggttacaaccctgacaagatcccctttgttccaatctctggctttgagggagacaacatgattgagaggtccaccaaccttgactggtacaagggccccacccttcttgaggcccttgaccaggtcaatgagcccaagaggccctcagacaagcccctccgccttccccttcaggatgtctacaagattggtggtattggaactgtgccagtggggcgtgttgagaccggagtgatcaagcctggcatgcttgtcacctttggcccaactgggctgaccactgaggtgaagtctgtggagatgcaccacgagtccatgctggaggctctgccaggtgacaacgtcggcttcaacgtgaagaacgtggctgtgaaggatatcaagcgcgggtacgtcgcctccaacgccaaggacgaccctgccaaggaggctgccaacttcgttgcccaggtcatcatcatgaaccaccctggccagatcggcaacggctacgccccagtgctggactgccacacgtcccacatcgctgtcaagttctctgagatccagaccaaggtcgacaggcgttctggtaaggagattgaggcctttcccaagttcctcaagaacggcgacgctggctttgtgaagatgattcccaccaagcccatggtggtggagaccttctcccagtaccctccccttggccgctttgccgtgcgtgacatgaggcagaccgttgccgtcggtgtgatcaagagcgtggagaagaaggaccccactggcgccaaggtgaccaaggctgccgccaagaagaaatgagatggtgcccggtggttgtccactactacaaccgtagtggtggtatatggcgatggtagtcgtgttagtgaatctgggaacttgcccgttctctggagtttggttatgtgcgtcgtccagccttcgtgctgcttatcattctatctttcggttatgttggtgaaacaatgtcctgctatgttacattattgttgctactctctatatatacgtcaggtattcgaagttcatattatttgttgtcttggtatggccgtttattttttac

SEQ ID NO: 1144 - DNA, 1725 bp, Avena sativa
gcccgccgccgccgctctgtcttcgtcctgttcgtcttctcggagctcaagccagttagctaagagctccatcagccatgggtaaggagaagattcacatcagcattgtggtcattggccatgtcgactctggcaagtcgacaaccactggccacctcatctacaagcttggaggcatcgacaagcgtgtgattgagaggttcgagaaggaagctgctgagatgaacaagaggtccttcaagtacgcgtgggtgctggacaagctcaaggctgagcgtgagaggggtatcaccatcgatattgccctctggaagttcgagactaccaagtactcctgcactgtcatcgatgctcctggacaccgtgacttcatcaagaacatgatcaccggtacctcccaggccgattgtgctgtgcttatcattgactccaccactggtggtttcgaggctggtatctccaaggatggccagacccgtgagcacgctctccttgctttcactcttggagtgaagcagatgatctgctgttgcaacaagatggatgccaccacccccaagtactccaagggccgttttgaggaaattgtcaaggaagttggctcctacttgaagaaggtgggctacaaccctgacaaggtcccatttgtccccatctctggatttgagggtgacaacatgattgagaggtccagcaaccttgactggtacaagggccccacccttcttgaggctcttgaccagatcaacgagcccaagagaccctcagacaagcccctccgtcttccccttcaggatgtctacaagattggtggcattggaactgtgccagtggggcgtgttgagactggagtgatcaagcctggtatgcttgtcacctttggcccaactgggctgaccactgaggtgaagtctgtggagatgcaccacgagtccatgctggaggctgtgccaggtgacaacgttggcttcaacgtcaagaacgttgctgtgaaggatatcaagcgtgggtatgttgcctccaacgccaaggacgaccctgccaaggaggctgccaactttgttgcccaggtcatcatcatgaaccaccctggccagatcggcaatggctatgccccagtgctggactgccacacgtcccacattgctgtcaagttctctgagatccagaccaaggtcgacaggcgttctggcaaggagatcgaggccttccccaagttcctcaagaacggtgacgctggcttcgtgaagatgattcccaccaagcccatggtggtggagaccttctcccagtaccctccccttggccgctttgcagtgcgtgacatgaggcagactgttgctgttggtgttatcaagagcgtggagaagaaggaacccactggcgcgaaggtgaccaaggctgctgccaagaagaaatgagaagatgatgcccggtggttggctaccactacacccgtagtggttgcggcatatcgtgtagtcgagttagtgaatttgggaacttgtcccgttttgagtttattatcctgctcgtagtacctttcagttgtgttgtgaaacaatgttctgctatcttcgattaaaagttgctaccctatacctatttttggttcacctttaatctgttgtgcctgtggattcgtttttaaatctgtttgcctgctatcatctttggaaaacatgcaaactccatgttagatttgacaggaaaaattcattccaa

SEQ ID NO: 1145 - DNA, 1610 bp, Avena sativa
aggcctcccaccctcgcccgccgccgctgctctgtcttcgtcctgttcgtcttctcggagctcaagcaagttagctaagagctccatcagccatgggtaaggagaagattcacatcagcattgtggtcattggccatgtcgactctggcaagtcgacaaccactggccacctcatctacaagcttggaggcatcgacaagcgtgtgatcgagaggtttgagaaggaagctgctgagatgaacaagaggtccttcaagtacgcgtgggtgctggacaagctcaaggctgagcgtgagaggggtatcaccatcgatattgccctctggaagttcgagactaccaagtactcctgcactgtcatcgatgctcctggacaccgtgacttcatcaagaacatgatcaccggtacctcccaggccgattgtgctgtgcttatcattgactccaccactggtggtttcgaggctggtatctccaaggatggccagacccgtgagcacgctctccttgctttcactcttggagtgaagcagatgatctgctgttgcaacaagatggatgccaccacccccaagtactccaagggccgttttgaggaaattgtcaaggaagttggctcctacttgaagaaggtgggctacaaccctgacaaggtcccatttgtccccatctctggatttgagggtgacaacatgattgagaggtccagcaaccttgactggtacaagggccccactcttcttgaggcgcttgaccagatcaacgagcccaagagaccctcagacaagcccctccgccttccccttcaggacgtttacaagattggtggcattggaactgtgccagtggggcgtgttgagaccggagtgatcaagcctggtatgcttgtcacctttggcccaactgggctgaccactgaggtgaagtctgtggagatgcaccacgagtccatgctggaggctgtgccaggtgacaacgttggcttcaacgtgaagaacgttgctgtgaaggatatcaagcgtgggtatgtcgcctccaatgccaaggacgaccctgccaaggaggctgccaactttgttgcccaggtcatcatcatgaaccaccctggccagatcggcaacggctatgccccagtgctggactgccacacgtcccacattgctgtcaagttctctgagatccagaccaaggttgacaggcgttctggcaaggagattgaggccttccccaagttcctcaagaacggtgatgctggcttcgtgaagatgattcccaccaagcccatggtggtggagaccttctcccagtatcctccccttggccgctttgctgtgcgtgacatgaggcagactgttgctgttggtgttatcaagagtgtggagaagaaggaacccactggcgcgaaggtgaccaaggctgctgccaagaagaaatgaggagatgatgcccggtggttggctactgctacacccgtagtggttgcggcatatcgtgtagtctgagttagtgaatttgggaacttgtcccgttttgagtttgttatcctgctcgtagtacctttcggttgtgttgtgaaacaatgttctgctatcttcgattaaaagttgcta

SEQ ID NO: 1146 - DNA, 1720 bp, Avena sativa
ccaccttttccccgccgcggctttgacttcatcctcttcgcctgctcggagctccagccagttagttaacagctccagcagccatggggaaggagaagattcacatcagcattgtggtcattggccatgtcgactctggcaagtcaacaaccactggccacctcatctacaagcttggaggcatcgacaaacgtgtgatcgagaggttcgagaaggaagctgctgagatgaacaagaggtctttcaagtacgcctgggtgcttgacaagctcaaggctgagcgtgagaggggtatcaccattgatattgccctctggaagttcgagactaccaaatattcctgcactgttattgatgctcctggacaccgtgatttcatcaagaacatgatcactgggacctcccaggctgactgtgctgtgcttatcattgactctaccactggtggttttgaggctggcatctccaaggacggccaaacccgtgagcatgctctccttgctttcactcttggtgtcaggcagatgatctgctgctgcaacaagatggatgccaccacccccaagtactccaagtctcgctttgaagaaattgtcaaggaagttggctcctacttgaagaaggtgggctacaaccctgacaagatcccatttgttccaatctctggctttgagggcgacaacatgattgagaggtccaccaaccttgactggtacaagggccccacccttcttgaggcccttgaccaggtcaatgagcccaagaggccctcagacaagcccctccgtcttccccttcaggatgtctacaagattggtggtattggaactgtgccagtggggcgtgttgagaccggagtgatcaagcctggcatgcttgtcacctttggcccaactgggctgaccactgaggtgaagtctgtggagatgcaccacgagtccatgctggaggctctgccaggtgacaacgtcggcttcaacgtgaagaacgtggctgtgaaggatatcaagcgtggatacgtcgcctccaacgccaaggacgaccctgccaaggaggctgccaacttcgttgcccaggtcatcatcatgaaccaccctggccagatcggcaatggctacgccccggtgctcgactgccacacgtcccacatcgctgtcaagttctctgagatccagaccaaggtcgacaggcgttccggtaaggagattgaggccttcccgaagttcctcaagaatggcgacgctggctttgtgaagatgattcccaccaagcccatggtggtggagaccttctcccagtaccctccccttggccgctttgctgtgcgtgacatgaggcagaccgttgccgtcggtgtgatcaagagcgtggagaagaaggaccccactggcgccaaggtgaccaaggctgccgccaagaagaaatgagatggtgcccggtggttgtccactactacaaccgtagtggtggtatatggcgatggtagtcgtgttagtgaatctgggaacttgcccgttctctggagtttggttatgtgcgtcgtccagctttcgtgctgcttatccttctatctttcggttatgttggtgaaacaatgtcctgctatgttccattattgttgctactctatatatacgtcagaaatttcgagtcatattatttgttgctggtatgccgttattttttatcactaaaaatggacaataaagtctgctgtgtt

SEQ ID NO: 1147 - DNA, 1623 bp, Avena sativa
tccccgccgccgccgccagtgccaatatctattagttaagagctccatcagccatggggaaggagaagattcacatcagcattgtggtcattggccatgtcgactctggcaagtcgacaaccactggccacctcatctacaagcttggaggcatcgacaagcgtgtgatcgagaggtttgagaaggaagctgctgagatgaacaagaggtccttcaagtacgcctgggtgctggacaagctcaaggctgagcgtgagaggggtatcaccattgatattgccctctggaagttcgagactaccaagtactcgtgcactgtcatcgatgctcctggacaccgtgacttcatcaagaacatgatcactgggacctcccaggccgattgtgctgtgcttatcattgactccaccactggtggttttgaggctggtatctccaaggatggccagacccgtgagcacgctctccttgctttcacccttggagtgaagcagatgatctgctgctgcaacaagatggacgccaccactcccaagtactccaagggccgttttgaggaaattgtcaaggaagttggctcctacttgaagaaggtgggctacaaccctgacaaggtcccatttgtccccatctctggatttgagggtgacaacatgattgagaggtccagcaaccttgactggtacaagggccccacccttcttgaggcgcttgaccagatcaatgagcccaagagaccctcagacaagcccctccgccttccccttcaggatgtctacaagattggtggcattggaactgtgccagtggggcgtgttgagactggagtgatcaagcctggcatgcttgtcacctttggcccaactgggctgaccactgaggtgaagtctgtggagatgcaccatgagtccatgctggaggctgtgccaggtgacaacgttggcttcaacgtgaagaacgttgctgtgaaggatatcaagcgtgggtatgttgcctccaatgccaaggacgaccctgccaaggaggctgccaacttcgttgcccaggtcatcatcatgaaccaccctggccagattggcaacggctatgccccagtgctggactgccacacgtcccacattgctgtcaagttctctgagatccagaccaaggtggacaggcgttctggcaaggagatcgaggccttccccaagttcctcaagaacggtgacgctggcttcgtgaagatgattcccaccaagcccatggtggtggagaccttctcccagtaccctccccttggccgctttgcagtgcgtgacatgaggcagaccgtcgctgttggtgtgatcaagagcgtggagaagaaggaacccaccggtgccaaggtgaccaaggctgccgccaagaagaaatgagatgatgcccggtggttgtccactgctacacccatagtagtggcggtagtttatggtgatggtcgtgttaggcgtttcgggaactgttttgagttttgttgtgtgcgtcgagcagccttcgtgctgcttattctgtctttcagttgtgttggtgaactattggcatgctatgttcggttaaagttgctacttctatatatagtatgtcagagatttcggagtcaaa

SEQ ID NO: 1148 - DNA, 1864 bp, Populus trichocarpa
gatatatttggtattcaaaattattctgagggtaatctaggaagaacaaaatatcactttagtagtaatataaatatatcaaaccctacaatctctccaatccgtcattagctactctcctccttccatctctctcgcggccagggtttaatccattctctcgtaaggttggattttctgttcagctctaatatatcatcatgggtaaggaaaagagtcacatcaacattgtggtcattggccatgtcgactctggaaaatcaaccaccactggccacttgatctacaagcttggaggtattgacaagcgtgtcatcgagaggttcgagaaggaagctgctgagatgaacaagaggtcattcaagtatgcctgggtgctcgacaagctcaaggctgagcgcgagcgtggtatcaccattgacattgccttgtggaagttcgagaccaccaagtactactgcactgtcattgatgcccctggacatcgtgactttatcaagaacatgattactgggacttcccaggctgactgtgccgtgcttatcattgattccaccactggtggttttgaagctggtatctccaaggatggccagacccgtgagcacgcactccttgccttcacccttggtgtgaggcaaatgatctgctgctgtaacaagatggatgccacaactccaaagtactccaaggcaaggtatgatgaaattgtcaaggaggtgtcatcctacttgaagaaggttggttacaaccctgacaagattccctttgtccccatctctggatttgagggtgacaacatgattgagaggtccaccaaccttgactggtacaagggcccaactctcctggatgccctggaccagatccaggagcccaagaggccctcagacaagcccctccgtctcccgcttcaggacgtgtacaagattggtggtatcggaactgtcccagtgggtcgtgttgaaactggtatcatcaagcccggcatggttgtcacattcggtccaactggactgagtactgaagtcaagtctgttgagatgcaccacgaggctctcctagaggcacttcccggtgacaatgtcgggttcaatgttaagaatgtagctgttaaggatctgaagcgtggttttgttgcctcgaactccaaggacgatcctgccaaggaggctgccaacttcaccgcccaagttatcatcatgaaccatcctgggcagatcggaaacggttacgcccctgttcttgactgccacacctgtcacattgctgtgaagtttgctgagatcctcaccaagattgacaggcggtctgggaaggaactggagaaggagcccaagttcctgaagaatggtgatgctggtatgattaagatgattcccaccaagcccatggtggtggagtctttctcagagtatcctccacttggtcgatttgctgtgagggacatgcgccagaccgttgctgtgggagttatcaagagcgtggagaagaaggatccctctggtgccaaggtgaccaaatctgctgccaagaagggtgccaagtaatcattgtgttgtgcaattactggtttgtttttttgttaattgtccctgagctgtgtcatgagaattgtagttttattttgtggaatcttgttctaaaattttggagattggattatgtttctagattcattatcggctcgtgaaatttaggtctcgagcatttggacactaagatctccatgtcatgtttttgtttatgggcgttgaatttacatttgtgcccgcctgctcatatattcagccttctttctagttttataccctttcctttctgtctgcttatattcagttgtcgtaaacttgtcgatctcttt

SEQ ID NO: 1149 - DNA, 1760 bp, Sequoia sempervirens
gttgttggccttggcgggagcgtaagagattctcgcgttgcagttaaagtttttgaagcagtcatgggaaaagagaagacccacatcaacattgttgtcattggacatgtcgactctgggaagtcgaccaccactggtcaccttatctacaagcttggaggtattgacaagcgtgtgattgagcgtttcgagaaagaagctgctgagatgaacaagaggtcattcaagtatgcctgggttcttgacaagcttaaggcggagagggagcgtggtattaccatcgatattgctctctggaagttcgagactacaagatactattgcactgtcatcgatgcacccgggcacagagatttcattaagaacatgattactggtacatcacaggccgattgtgctattctgattattgattccaccactggaggttttgaggctggtatctccaaggatggtcaaaccagagagcacgcccttctggccttcactcttggtgtgagacagatgatttgctgctgtaataagatggatgccactacccccaagtactccaaggcccgatatgacgaaattgtcaaggaagtttcttcatacctgaagaaggttggttacaaccctgagaaaatccccttcgtacccatctctggttttgagggagacaacatgattgagcgctcttctaacctggattggtacaaaggacccaccttgttggacgctctggaccaggtgaatgagcccaagagaccctcggacaaacctctgcgattgccccttcaggatgtgtacaagattggtggtattggaactgtgccagtaggacgggttgaaactggtgttcttaagcctggtacagtggtcacctttggcccaactggactgacaactgaagtcaagtctgtggaaatgcaccatgaagccttacaggaagcactgcctggtgacaatgtgggtttcaacgtcaagaatgtggctgtcaaggatcttaagcgtggctatgtggcatctgactctaagaacgatcctgcgaaggaagctgcaaactttaccgcgcaggtgatcatcatgaaccaccctggccagattggcaatggctatgcccctgtgctggactgccacacttgccacattgcagtcaagtttgctgaaatattgaccaaggtggacaggcgatctggaaaggagctggagaaggagcccaagttccttaaaaatggagatgctggatttgtgaagatgattcccaccaagcccatggtggtggagaccttttctgagtatcctcctctgggacgttttgctgtgagagacatgcgacagactgttgctgtgggtgtcatcaagagtgttgagaagaaggatcctaccggtgccaaggttaccaaggctgctatcaagaagaaatgaagaacggtggactgtgcaatggaagaggcatggcacggtcatcatttgtggttgtgtctgtctcggccttctgcacgggatctgctagtgaggtgttctgtagctaggcgcatgcaaacttgggttcttgacaggcggtggcataatattgcaagtaatattatttgttgttgttatactagtagtagtagtaataattttgatagggatgagagattgaggggtatttttcacttttgtcagacactgctgcaaattagagtcatgcagtatgtttaatgttggtgttcttgtttgaagacttttatgtgctgagtaatttatactttatattgttaaaaagtgtccttgta

SEQ ID NO: 1150 - DNA, 2383 bp, Taxus baccata
tcaacgctaaataaaatatatccatacgatacaattcgctgcaattttcagccgccaattggcggagcttcaaatccattattcacatggctaacaggcataccattattctaatgcaaacaggtcaaaaccgcgcaactcggacgttcatggattttgattctatcagtttagctatggatggtatttgtggattatatgaacggaaattgaaggaattgaaccccgctatacagaatattacatatgacattgaagatctctacagcttcattgatggtctagcagacctgagtgcacttgtgttggatcactcattacaagcttatctgccaaatgatcgcaagtggattaaacagcaacttatgaagcacttgaagaaacttgctgtcagtgattggaatggcagtagagtgaatgactggaatggcagtagagtgaatgactggaacggtggtaaacggaatatgtacaaagatatggtcccgtatgactagaaaattttagtcagcatctagttaattgtaatcttattgggaggagtgttatgaaatttgttttagatttaagtttcagttctttgactctaatattatttgggcagtgctctgaaatttatccagtttttgctaggtgctctatttttgagtattcgtttctcctccatttttctgttccgccgcaccgaggataaccttcttcgatctgccaggcgcttctgcaacaagtttttaatctcaagcaaccatgggaaaagaaaaggttcatatcaacattgttgttattggccatgttgactctggaaagtcaactactactgggcatctgatttataagttgggtggtattgacaagcgtgtgattgagcgttttgagaaggaagctgctgaaatgaacaaaaggtcattcaagtatgcttgggtgcttgataagctaaaggctgagcgtgaacgtggtattaccattgatattgcactatggaagtttgagaccactagatactactgcactgtcattgatgctccaggacatcgtgatttcattaagaacatgattactggaacttctcaggctgattgtgcggtgctgattattgattcaacaactggaggttttgaagctggtatttccaaagatggtcagacccgagaacatgctcttctagcatttacactgggagtgaagcaaatgatttgctgctgtaacaagatggatgctactaccccaaaatactcgaaggctcggtatgaagaaattgtcaaggaagtgtcttcttatttgaagaaggttggatacaatccagacaagatcccttttgtgccaatctctggttttgagggtgataacatgattgagagatcaagtaaccttgattggtacaagggtccaacactgttggatgcccttgaccaggtttcagagcccaaacgtccatcagacaagccactcaggttgccacttcaggatgtttacaagattggtggtattggaactgtacctgtggggcgagttgagactggagtgattaagccaggtatggttgtaacctttggtccatctgggttgacaactgaagttaagtctgttgaaatgcatcatgaagctttgttagaggcattgcctggtgacaatgttggattcaatgtcaagaatgttgctgtgaaagatctcaagcgagggtatgtagcctctgattcaaagaatgacccagcgaaagaggctgcaaacttcacttcacaggtcatcatcatgaaccatccaggacaaattggaaatggttatgcacctgtgctggattgccacacatgccacattgctgttaagtttgctgagatcttgactaaggttgacagacgatctggtaaggaacttgagaaggaaccaaagttcattaagaatggggatgctgcatttgtcaagatgattccaaccaagcccatggtcgtggaaacattctctgagtaccctccattgggtcgttttgctgtgagggatatgcgtcagactgttgctgttggagtcatcaaggctgttgagaagaaggaaccttctggtgctaaggttaccaaggctgctgctaaaaagaagtgaaagtttgtgcaatttgtgcaggaactggggcatgccagaagctttttgcctgcttgtatgctggatttttgcacatatggtacggtagtaggaatattagcttgtcatatgcaaaattgggttcttgatagacggtggcattgttcatttgtttccttttaaagcatttagtagtttaagaaaggtacttgatttctctgcggggaatttttttggttgtctgcactgctaggaaatttatgcagtctgagcagaggaggatttaaataattttaatttctaatgactggta

SEQ ID NO: 1151 - DNA, 1862 bp, Populus trichocarpa
cctcgctctcacccctgcttctcctttttctatcctcttgccgctagggtttttgcatcttacttcagttaagcgctgagatttcattatgggtaaagagaagagtcacattaacattgtggtcattggccatgtcgactctggcaagtcaaccaccactggacacttgatctacaagcttggaggtattgacaagcgtgtcatcgagaggttcgagaaggaagctgctgagatgaacaagaggtcattcaagtatgcttgggtgcttgacaagctcaaggctgagcgtgaacgtggtattaccattgatattgctctgtggaagttcgagaccaccaggtactactgcactgtcatcgatgctcctggacatcgtgactttatcaagaacatgattaccggaacctcccaggctgactgtgcagtcctcatcattgactctaccactggtggttttgaggctggtatctccaaggatggtcagacccgtgagcatgctcttcttgccttcacccttggtgtcaagcaaatgatctgctgctgtaacaagatggatgccaccacaccaaaatactccaaggctaggtatgatgaaattatcaaggaagtgtcatcctatttgaagaaagtcggttacaaccctgacaagattcccttcgtgcctatctctggatttgagggtgataacatgattgagaggtccaccaacctggactggtacaagggaccaactctcctcgaagccctcgaccagatccaggagcccaagaggccctcagacaagcccctccgtctcccacttcaggacgtgtacaagattggtggtatcggaacagtcccagtgggtcgtgtggaaactggtgtcatcaagcctggtacggttgtcactttcgggccaactggactaactactgaagtcaagtctgttgagatgcaccacgaagcactccaagaggctcttcctggtgacaatgttggattcaacgttaagaatgttgccgtgaaggatctgaagcgtggttttgttgcctcaaactcgaaggatgatcccgccaaggaggctgcgaacttcacctcccaggtgatcatcatgaaccatcctgggcagattggaaatggttatgcccctgttcttgactgccacacctgtcacattgctgtcaaatttgctgagatcctcaccaagattgacaggcgatcagggaaggagttggagaaggaacccaaattcctgaagaacggtgatgcaggtatgattaagatgattcccacgaagcccatggtggtggagactttctcagagtatcccccacttggtcgttttgctgtgagggatatgcgccagactgttgctgtgggagtgatcaagagcgtggagaaaaaggatgcttctagtgctaaggtgacaaaatctgctgccaagaagggtggcaagtgaaccgtgcaggttgattctactgaaatctatttgaaaaataatgacttggtgtctttttgttgtctatccaaaggatgcatttctgtgtatcatgagatttttagttttgtgtcttcaccatcatcacaaggcttttcacagaattgggttcttgatcggcggtggcgtatacaagtcttgaggcagtttcttcatttttgtcgtgtcgctcaaattaagatggtggtgatatatttctagtttcataacagcttgtattttcaatcaagtctagtattttgataatgagaaaccccccatatgaagttttgtgatctataggtttttttatcgttagtattttaaattaagtctatagtttttatgttcagtctatttttatcgttaattattatgttaattgcatgccatgttttcctttgca

SEQ ID NO: 1152 - DNA, 2001 bp, Populus trichocarpa
caggatgatatatttggtattcaaaattattctgagggtaatctaggaagaacaaaatatcactttagtagtaatataaatatatcaaaccctacaatctctccaatccgtcattagctactctcctcctaccatctctctcgcggccagggtttaatccattctctcttaaggttggattttctgttcagctctaatatatcatcatgggtaaggaaaagagtcacatcaacattgtggtcattggccatgtcgactctggaaaatcaaccaccactggtcacttgatctacaagcttggaggtattgacaagcgtgtcattgagaggttcgagaaggaagctgctgagatgaacaagaggtcattcaagtatgcctgggtgctcgacaagctcaaggctgagcgcgagcgtggtatcaccattgacattgccttgtggaagttcgagaccaccaagtactactgcactgtcattgatgcccctggacatcgtgactttatcaagaacatgattactgggacttcccaggctgactgtgccgtgcttatcattgattccaccactggtggttttgaagctggtatctccaaggatggccagacccgtgagcacgcactccttgccttcacccttggtgtgaggcaaatgatctgctgctgtaacaagatggatgccacaactccaaagtactccaaggcaaggtatgatgaaattgtcaaggaggtgtcatcctacttgaagaaggttggttacaaccctgacaagattccctttgtccccatctctggatttgagggtgacaacatgattgagagatccaccaaccttgactggtacaagggcccaactctcctggaagccctcgaccagatccaggagcccaagaggccctcagacaagcccctccgtctcccgcttcaggacgtgtacaagattggtggtatcggaactgtcccagtgggtcgtgttgaaactggtatcatcaagcccggcatggttgtcacattcggtccaactggactgagtactgaagtcaagtctgttgagatgcaccacgaggctctccaagaggcacttcccggtgacaatgtcgggttcaatgttaagaatgtagctgttaaggatctgaagcgtggttttgttgcctcgaactccaaggacgatcctgccaaggaggctgccaacttcaccgcccaagttatcatcatgaaccatcctgggcagatcggaaacggttacgcccccgtccttgactgccacacctctcacattgctgtgaagtttgctgagatcctcaccaagattgacaggcggtctggtaaggaactggagaaggagcccaagttcctgaagaatggtgatgctggtatgattaagatgattcccaccaagcccatggtggtggagtctttctcagagtatcctccacttggtcgatttgctgtgagggacatgcgccagaccgttgctgtgggtgtgatcaagagcgtggagaagaaggaaccctctggtgccaaggtgaccaaatctgctgccaagaagggtggcaagtgaacggagcaggttgatgctactggaatctattttacaaataacgacttggttcttcttagttctcaatttcttggatgtttatccatgtgtcttgatctctgtagttctatgtcactactctcatcaagaggctgttcgcagaattgggttcttgatcggcggtggcgatgtatatctttagatatcttctgcacttttttgtcttaaaagttaaaggttttgtcagacttttctattttcatgaactggtcgcgactgggaggtcttgttaccgaggattctacatcttctatattgtacttgaatagtgttgtgttttgtttggtctctgtcgttggcctgttactggtaaccttcccagggttttctgcattttcttccttcttttccgcttcttgtaggtgaatttacaatttgctgcctgaagctgttagaagcctgtttg

SEQ ID NO: 1153 - DNA, 1393 bp, Prunus persica
cgcacaattcacttcttctttgctgcagatttggtcaccttggctccacttggatccttcttctccacactcttgatcactcccacagcaacagtctgtcgcatgtcccggacagcgaaacgaccaagtgggggatactcggagaaggtctccaccaccattggcttggtaggaatcatcttaacaaatccagcatcaccattcttcaaaaacttgggctccttctcaagctccttgccggatcgtctgtcaatcttggttagaatctcattgaacttgactgcaatgtgggaggtgtggcaatccagcacaggggcatagccatttccaatctggccggggtggttcatgatgattacttgggaagtgaagttggctgcctccctggctggatcatccttagaattcgaggcaacgaaaccacgcttcagatccttgactgcgacgttcttcacgttgaagccaacattgtctcctggaagagcctccggaagagcttcgtggtgcatctccacagacttaacttcagttgtcagcccagaagggccaaaggtcacaaccataccaggcttgatgataccagtttcaacacgtccgacagggacggtaccaatgccaccaatcttgtagacatcctgaagtgggaggcggaggggcttgtctgtgggcctcttgggctcattgatcaagtcaagggcctcaagaagggtaggacccttgtaccagtcaaggttgctagacctctcaatcatgttgtcaccctcaaacccagagatgggaacaaaggggatcttgtctgggttgtagccaaccttcttcaaataggatgagacttccttaataatttcatcgtaccttgccttcgagtactttggagtggtagcatccatctgtaccttgttgcagcagcaaatcatttgcttaacaccaagggtgaaagctaggagagcatgctcacgagtctgaccgtccttggaaataccagcttcaaaacctccagtggtggagtcaataatgaggacagcacagtcagcctgggaagttccagtaatcatgttcttaatgaagtcacgatgtccgggagcatcaatgacagtgcagtagtacttgttagtttcaaacttccagagggcaatatcaatggtaataccacgctcacgctcggccttgagcttgtcaagcacccaggcatacttgaatgatctcttgttcatctcagcggcctccttctcgaacctctcaatcacacgcttgtcaatacctccaagcttgtagatcaaatggccagtggtggtagacttcccagagtcgacatggccaatgaccacaatgttaatgtgaatcttttcttttcccattataaaagctgtttatgaattaagagaagaaaaaa

SEQ ID NO: 1154 - DNA, 1379 bp, Cicer arietinum
ttcttagtctagatatcatgggtaaggaagaagttacatatcaacaattgtcgtcattggacattgtcgactctggaaaatcaaccaccactggtcacttgatctacaagcttggaggtattgacaagcgtgtcattgagaggttcgagaaggaggctgctgagatgaacaaacgttcattcaagtacgcctgggtgctcgacaagcttaaggctgagcgtgaaagaggtattaccatcgatattgccttgtggaaattcgagaccaccaagtactactgcacagtcatcgatgcccccggacatcgtgatttcattaagaacatgattactggtacctcccaagctgattgtgctgtccttatcattgactccaccactggtggttttgaggctggtatctctaaggatggacagacccgtgagcacgcccttcttgctttcactcttggagtgaaacagatgatctgttgttgtaacaagatggatgccactacacccaagtactcaaaggccaggtacgatgaaatcgtgaaggaagtttcttcatacttgaagaaggttggttacaaccctgacaaaatccccttcgttccaatctctggatttgagggagacaacatgattgagaggtccaccaaccttgactggtacaagggaccaactctccttgaggctcttgaccagatcaacgagcccaagagaccctcagacaagcccctcaggcttccattgcaagatgtttacaagatcggtgtattggaactgtgccagtcggacgtgttgagactggagtcatcaagcctggtgtgattgttacctttggcctaccggtctgacaactgaagttaagtctgttgagatgcaccacgaggctctcaccgaagctctccccggagacaatgttggattcaatgttaagaatgttgcagtgaaggatctcaagcgtggtttcgttgcatccaactccaaggatgaccctgctaaggaagctgccaacttcacttcccaagtcatcatcatgaaccatccaggacagattggaaacggttatgccccagtcctcgactgtcacacctcccacattgctagttaagttcgctgagcttcccaccaagattgacagacgatctggtaaggaacttcgagaaggagcctaagtttttgaagaatggtgattgctggtcttgtttaagatgattccaacaaagcctatggttgtggaaaactttcgtccgaagtatccaccaacttggtcgtttgactgtgagggacatgcgtcaaactgttgctgtcgtgtcattaagcgtgttgagaagaaggatacaataggagaccaagatcaacaaggctgcagtcaagaagaagtgagttgctaac

SEQ ID NO: 1155 - DNA, 1394 bp, Ricinus communis
catcaatagaatttggggatcgcaatattcatttccctcccttcttggcagcagacttcgtaaccttagcaccactcgggtccttcttctcgacgctcttaataacacccacagcaacagtctgacgcatgtcccgcacagcaaaacgtcccaacggagggtactcagagaaagtctcgacaaccatgggcttggttggaatcatctttacaaacccagcatcaccattcttcaagaacttaggctccttctcaagctccttgccagatcggcgatcgatcttggtcaagatctcagcaaacttcacagcaatgtgggaggtgtggcagtccaagactggagcatatccatttccaatctggccagggtggttcatgatgataacctgggatgtgaagttggcagcttccttggcaggatcatccttggagtttgatgcaacataacctctcttcaaatctttcacagcaacattcttcacgttaaatccaacattgtcgccagggagggcctcctggagagcctcgtgatgcatctcaactgacttaatttcagttgtcaacccactgggtccaaaggtcacaaccataccaggcttgaggacaccagtctctacacgacccacaggaacagttccaataccaccaatcttgtatacgtcttgaagtgggagacggagaggtttgtctgagggcctctttggctcattgatctggtcaagagcttcaagtagggttggacccttgtaccagtcaaggttggtggacctctcaatcatattgtcaccttcgaacccagagatgggaacgaaaggaatcttgtcggggttatatcccaccttcttaagataggatgaaacttccttgacaatttcatcgtacctggccttagagtacttgggaacagattgaccattaccttgttgcagcagcaaatcatttgtttgacaccaagggtaaaagcaagaagagcatgctcacgggtctgcccatccttagaaataccagcttcaaaaccaccagtagtggaatcaatgataagaacagcacagtcagcctgtgaagtaccagtaatcatgttcttaataaagtcacgatgcccaggagcatcaatgacagtacagtagtacttggtggtctcgaatttccacaaggcaatatcaatggtgataccacgctcacgctcagccttaagcttgtccagcacccaagcatacttgaatgacctcttgttcatctcagcagcctccttctcgaacctctcaatcacacgcttgtcaatacctccgagcttgtagatgagatgtccagtggtggtggacttgccagagtcgacatgtccaatgaccacgatgctgatgtgaatcttctccttacccattatagatatctaaa

SEQ ID NO: 1156 - DNA, 1365 bp, Brassica juncea
tcacattcttacttgcagctatgggtaaagagaagtttcacatcaacattgtggtcattggccatgtcgactctgggaaatcgaccaccactggtcacttgatctacaagcttggtggtattgacaagcgtgtcatcgagagattcgagaaggaagctgctgagatgaacaagagatctttcaagtacgcttgggtgttggacaaacttaaggccgagcgtgagcgtggtatcaccattgacattgctctttggaagttcgagaccaccaagtactactgcacggtcatcgatgcccctggacatcgtgatttcatcaagacatgattactggtacctcccaggctgattgtgctgtcctcatcattgactccaccactggtggttttgaagctggtatctccaaggatggtcagacccgtgagcatgctcttcttgctttcacccttggtgtcaagcaaatgatttgctgctgtaacaagatggatgccactacccccaagtactccaaggctaggtacgatgagatcatcaaggaggtgtcttcctacttgaagaaggttgggtacaaccctgacaaaatcccattcgtccccatctctggattcgagggtgacaacatgattgagaggtccaccaaccttgactggtacaagggaccaactctccttgaggctcttgaccagatcaacgagcccaagaggccctcggaaaagcccctccgtctcccacttcaggatgtctacaagatcggaggtattggaacggtgccagtgggacgtgtggagacaggtatgctcaagcctggtatggttgtgacctttgctccatcagggttgaccactgaggtcaagtccgttgagatgcaccacgagtctcttgtggaggcacttccaggtgacaacgttgggttcaatgttaagaatgttgctgtgaaggatcttaagcgtgggtatgttgcatctaactccaaggatgacccagctaagggagctgccaacttcacatcccaggtcatcatcatgaaccaccctggtcagatcggtaacggttacgcccctgtccttgattgccacacctcccacattgcagtcaagttctctgagatcctcaccaagattgacagacgatctggtaaagagatagagaaggagcccaagtttttgaagaatggagatgctggtatggtgaagatgactccgaccaagcccatggttgttgagacgttctcagagtacccaccattgggacgtttcgctgttagggacatgaggcagactgttgctgttggtgtcatcaagagcgttgacaagaaggacccaaccggtgccaaggtcaccaaggctgcagtcaagaagggtgctaa

SEQ ID NO: 1157 - DNA, 2617 bp, Musa acuminata
aacgtggccgttcgttgtattggaatcgtagttgaatgatagagcttgggctagcagttttacatgtgttacaatgaattgggtcgaccatccgctcgtctttttcttcgtctttaagttgaagggtgtcggatctactttctattgctctgatggtctttggtttgctttccttactgaatcattcatgttctggccatttttttccctgctgttgttgcatgttgtgcacacataagtagttcttatctttgaaactgaagtaaaaaaagataattttttcatgttagcataccggtcaccgagcacatgtatctcaggaagcaaaactgaaggaaaaatatcattttttttatttattattttcatgttagtatgctggtcaccgtgcatatgtatctcaggaagctttgcctctgctttcagctgcaagtatttttgactgagttattatttgtggctttgtcctagaggcatacaataaggatcgatgaggaggttttcatgtcctgcgttccattctggttgcctcaggatatcattactaccttacatatatgcaggattgcattcatcgtatgctttagttaattgtttggttttttttattatttttggggagaactgattgctggagttagtacactagccacagcttgaatatgcgatgtcataaagtctgccagtgttcggaattgtttatatcattaccctctacatatttacaggaacatgttcgttttatgtttgagtttatgttatggatcaatgccactgtaaaactgatttttggagttagtctattcagccccgattttgatatgcaaaggcataaagtctgtgaaattttgggaattctttctggtgttgccagtgatgatagattaacttcatattttccatttcttgtctttgtaatatcaagaaacaagtcacttggcaaatgaaaatgattcttttgctatttgagacacgctcaaatgtaatatttgtttccaactacttgatgcttgtctttaaagtaaatttctttttaaaaaaatgttttcttcgctgttaatttatttcatttttgatcttctcttatcatattcttgccttccagccatcatgggtaaggaaaaggtacacataaacattgtggtcatcggccatgtcgactctgggaagtcaaccaccaccggccatctcatttacaagttgggcggcattgacaagcgtgtaattgaaaggtttgaaaaggaggcagcagaaatgaacaagaggtaattcaagtacgcttgggttcttgataagcttaaggctgagcgggagcgtggtatcaccatcgatattgcactttggaagtttgagaccacaaaatactactgtacagtgattgatgctcctgggcatcgtgactttatcaagaacatgatcacaggaacctctcaggctgactgtgctgttctcagtatagattctactacaggtggttttgaggcaggtatttcaaaggatggtcagacaagggaacatgcccttcttgcattcactctcggtgtcaaacagatgatttgctgctgcaataagatggatgccaccacaccaaagtactccaaggctagatatgatgagattgtgaaggaggtttcttcttacctgaagaaaattggatacaatcctgacaagattccctttgttcccatttctggttttgaaggtgataacatgattgagaggtctaccaacctggactggtacaagggtccaacccttcttgacgcccttgacatgattcaggaaccaaaaaggccctcggacaagcctcttcgtcttcctctccaggatgtctacaagattggtggcattggaactgtccctgttggacgagttgaaactggtatcctcaagcctggtatggttgtcacttttggtccaaccggtcttacaactgaagtcaagtcagtcgaaatgcatcatgaggcattgcaagaggccttccctggtgacaatgtagggtttaatgttaagaatgttgccgtcaaggatctcaagcgtgggtttgttgcttccaactccaaggaagatcctgccaaggaggcagctagcttcacatcacaggttattatcatgaaccatcccggtcagatcggcaatggatatgcacctgtgcttgactgccacacctcccacattgctgttaagtttgctgagcttctcaccaagatcgataggcggtccagtaaggaacttgagaaggaaccaaagttcttaaagaatggtgatgctggttttgtcaagatgattcccaccaagcccatggtcgtcgaaaccttctccgagtacccacccctcggtcgttttgctgtgagggacatgaggcaaacggtggcgtgggtgttatcaaggcagttgagaagaaggatcctactggtgccaagatcaccaaagctgctgccaagaagaaatgagttatgacatcaaaattttcctttgaatagatattagtgtcaggtcttttttttgtagtgtagtggttgaagtgtaatctggacaatttgatcatttgattttgagtcggacatgttgattaatattttgagagacagttgttgttgcattaatggatcgtatc

SEQ ID NO: 1158 - DNA, 1631 bp, Fraxinus spp
gctcttgacagaaatcaaaactctctctgcagtcggcggcgggtgagagatttctctatactacattcgaagctttctttttaaaagcaaaaatcatgggaaaggaaagattcacattagcattgtggtcattggccacgtcgactctggaaagtcaaccaccactggccatttgatctacaagcttggtggtattgacaagcgtgttattgaaaggttcgagaaggaggctgctgagatgaacaagaggtcattcaagtatgcctgggtgctcgacaagctcaaggctgagcgtgagcgtggtattaccattgatattgccttgtggaaatttgagaccaccaaatattactgcacagttatcgatgctccaggacatcgtgactttatcaagaacatgattactggtacttcacaggctgactgtgctgtcctcatcattgactctaccactggtggttttgaagctggtatttccaaggatggtcagacccgtgagcatgcattgcttgccttcacccttggtgtcaagcaaatgatttgctgctgcaacaagatggatgccaccacacctaaatactcaaagcccaggtatgatgaaattgtgaaggaagtgtcatcctacatcaagaaggttggatacaaccctgacaagatcccatttgttcccatatctggttttgagggtgacaacatgattgagaggtccaccaaccttgattggtacaagggcccaaccctccttgaagctcttgaccagattcaggagccaaagaggcctcagacaagcccctccgtctccacttcaggacgtctacaagattggtggtattggaactgtacctgttggccgtgtggagactggtgttatcaagcctggtatggttgtaacctttggcccaactggtttgacaactgaagtcaagtctgttgagatgcaccacgaggccctccaggaggctctccctggtgacaatgttggcttcaatgtcaagaatgttgccgtgaaggatctcaagcgtggttacgttgcctccaactccaaggatgaccctgccaagggtgctgccagcttcacttcccaggtcatcatcatgaaccaccctggtcagattggaaatggatatgcaccagtgctcgactgccacacatcccacattgctgttaagtttgccgagctgcagaccaagattgacaggcgttctggtaaggagctggagaaggagcccaagttcttgaagaacggtgatgctggtcttgttaagatgattcccaccaagcccatggttgtggagactttctccgagtacccacctcttggtcgttttgctgtcagagatatgcgccagacagttgctgtcggtgtcatcaagagtgtggacaagaaggatccatctggtgccaaggtcaccaaagctgctgctaagaagggtgccaagtgaagaaaattccggttggatgatatggtttttgttaatcaaattagttattttcaagacatcttttgcagtttttgattattatggtttaaacaggtgctctatctgtattgcctattttttcttttcttttaattattgcttgagatgagttgtaggcctatatgttccaacgaatattttattctgttt

SEQ ID NO: 1159 - DNA, 1570 bp, Zea mays
catcatggtcatcgataatattactatagaagcaaaacccaatatatatagtgtggtacgcaatcacgaacacaacagtccaaacctacacaatgaacccatgaaaattattcttttgttaactactactagcaccacccaacaaaatactccgaccagcaaagaaaccaggaaccatggattacatgcagaatcatcatcatttcttcttggcagccgccttggtcaccttggctcccgttgggtccttcttctccacgctctttatcacgccgaccgcaaccgtctgcctcatgtcgcgaaccgcgaagcgccccagtggaggatactcggagaaagtctccaccaccatgggcttcgtggggatcatcttgacgaagccggcgtcaccgttcttgaggaacttgggggcgctctccagctccttgcccgaccgccggtcaatcttggtgagcagctccgagaacttcacggcgatgtgggacgtgtggcagtccagcaccggggcgtagccgttgccgatctgccccgggtggttcatgatgatcacctgcgcggtgaagctggcagcctccttggcggggtcgtccttggagttggaggccacgtagccgcgcttcaggtccttgaccgccacgttcttgacgttgaagccgacgttgtcgccgggcagtgcctcctgcatcgtctcgtggtgcatctccaccgacttgacctccgtcgtcaggcccgtgggcgcaaaggtgaccaccatgccgggcttcaggagcccagtttccacgcggcccaccgggacggtgccgatgccgccgatcttgtacacgtcctgcagaggaagccgcaggggcttgtccgagggccgcttgggctcgttgatctggtccagcgcctcaaggagggtggggcccttgtaccagtccaggttcgtcgacctctcgatcatgttgtcaccctcgaacccagagatgggcacgaaggggatcttgtccgggttgtaccccaccttcttcaggtaggaacccacttccttgacgatctcgtcgtaccgagccttggagtacttgggggtagtggcatccatctgatttagcaatagttcatcatctgcctcacaccaagagtgaaagcaaggagcgcatgctcacgggtctggccgtccttggagataccagcctcgaagccaccagtggtggagtcaatgatgagcaccgcacaatcagcctgggaggtgccggtgatcatgttcttgatgaagtcacggtgcccaggggcatcaatcacggtgcagtagtacttggttgtctcaaacttccacagggcaatgtcaatggtgatgcccctctcgcgctcggccttgagcttgtcaaggacccaggcgtacttgaaggacctcttgttcatctcggcagcctccttctcaaacctctcgatgacacgcttgtcaatgcctccaagcttgtagatgaggtggccggtggttgtggacttgccggagtcgacatggccaatgaccacaatgttgatgtgaaccttctccttccccatggcaacgggagcagctgactagaaa

SEQ ID NO: 1160 - DNA, 1672 bp, Glycine max
tttaaaccataaacagtttataaaacttcgttataaattaaatgcaacttaaaacatccctcagcagcaaaggaaatggactaaaaccctatagctgcttgtgaaattcgaaatatctcagactcttcttaccatcaaaacaaaaaacagtactcatcaaaaacaaacagcaatgaaaattgaccaccgccgatcaagaacctagttttgaaagttacggctacatgaaatcggcagaaacttaaaaatataacttaaacaaaacacctaagactctgcaaggataaaactactataaaggagtaaccacgatgatgatcacatgtgctagcaaaattgcccaaatgcaatcacttcttcttggcagcggccttggtgaccttggctccggtggggtctttcttctcaacactcttgatgactccgacagccacagtttgacgcatgtccctcacagcaaaacgaccaaggggaggatactcagagaaagtttcaaccaccatgggcttggttggaatcatcttaaccatacctgcatcaccattcttcaaaaatttgggctccttctcaagctccttaccagatcgcctgtcaatcttggtcaagatttcagaaaacttgacagcaatgtgagaagtgtggcaatcaagcaccggtgcgtatccatttccaatctggccagggtggttcatgataatgacttgagatgtgaagttggcagcttccttggcagggtcatccttggagttggatgcaacaaaaccacgcttgagatccttgactgcaacattcttcacattaaagccaacattgtcacctggaagagcctctgtgagagcctcatggtgcatctcaacagacttaacctcagttgtcagcccagtgggaccaaaagtcaccaccataccgggcttcacgacaccagtctcaacacgtcccactggcacggtaccaataccaccaattttgtagacatcctgcaatggaagcctgagtggcttgtctgagggcctcttgggctcattgatttggtcaagagcctcaaggagagttggtcccttgtaccagtcaaggttggtggacctctcaatcatgttgtcaccctcgaaaccagagatgggcacaaatggaatcttgtctgggttgtaaccaaccttcttcaagtaggaagagacttccttcacaatttcatcatacctagccttagagtacttcggggtaatttattataccttgttacagcagcagatcatctgcttcacaccaagggtgaaagcaagaagagcatgctcacgagtctgtccatccttagaaataccagcttcaaaaccaccagtggtggagtcaatgataaggacagcacaatcagcctgggaggtaccagtaatcatgttcttgataaagtcacgatgtccggggcatcgatgactgtgcagtagtacttggtggtttcaaacttccacaaagcaatatcaatggtaattcctctttcgcgctcagccttgagcttgtcaagcacccaggcatacttgaatgacctcttgttcatctcagcagcctccttctcgaacctctcaatcacacgcttgtcaatacctccaagcttgtagatcaaatgaccagtggtagttgacttcccagagtcgacatgtccaatgacgacaatgttgat

SEQ ID NO: 1161 - DNA, 1681 bp, Glycine max
ttgaacactacaaatagaaagttgacatttaataaaccaaagcaacacaacgcagcaaagtcctgaaactcgctgcgcttaacaaaaatgtaatcaggggttccgacaaacacaacacattaaaacacagataaataaaagcaattttgccaccgtcgatcaagaacccagttctgggaacaacagttgcgagatgatggtggagacttcaaactttgtccgaaaaacaagctacctagaaaagaagacacaagagtacagaaaagaaaccaacatttattgtaaccaacatcccctgatgaaccagcccgcacgattcacttcttcttctgggcagccttggtgaccttggctccggtaggatccttcttctcaacgttcttgatgactcccacagcaacagtttgacgcatgtccctaacagcaaacctaccaagtggaggatactcggagaaagtttcaacaaccatgggtttggttggaatcatcttaacaaaaccagcatcaccgttcttcaaaaacttgggctccttctcaagctctttgccggatcgcctgtcaatcttggtcatgagttcagcaaacttgacagcaatgtgagaagtgtggcagtcgaggacaggggcatagccatttccaatctgaccagggtggttcatgatgatgacttgggctgtgaagttagcagcctcctttgcagggtcatcctttgagtttgaggcaacataaccacgcttcaaatccttaacagcaacattcttaacattgaatcccacattgtcaccaggatgtgcctctgtaagagattcatggtgcatctccacagacttgacttcagttgtcagtccagttggtgcaaaagtcaccaccattccaggcttcaagacaccggtctcaacacgtcccactggcacagttccaatacctccaatcttgtacacatcctgaaggggaagcctgaggggcttgtcagagggcctcttgggctcactaatctggtcaagtgcatcaagcagagttggacccttgtaccagtcaaggtttgtggacctctcaatcatgttgtctccctcaaaaccagagataggaacaaaaggaatcttgtcagggttgtatcctactttcttcaagtaggaagagacttccttcacaatttcatcatacctggccttggaatacttggtcgagacataatttactttgttacagcagcaaatcatctgtttcacaccaagggtgaatgaaagcagagcatgttcacgagtctgtccatccttggaaataccagcttcaaaaccaccagtggtcgaatcaatgataagaacagcacagtcagcttgggatgtcccagtaatcatattcttaatgaaatccctatgtccaggcgcatcaataactgtgcaataatactttgttgtttcaaacttccacaaagcaatatcaatggtgattcctctttcacgctcagccttaagtttgtccagcacccaggcatacttgaaagacctcttgttcatctcagcagcttccttctcaaacctctcaataacacgcttgtcaatgcctccaagcttgtaaatcaggtgaccagtggtagtggatttcccagagtcgacatggccaatgaccacaatactgatgtgaaccttttccttacccatcttccttaaatctgcaaaaa

SEQ ID NO: 1162 - DNA, 1925 bp, Taxus baccata
gtttctcctccatttttctgttccgccgcaccgaggataaccttcttcgatctgccaggcgcttctgcaacaagtttttaatctcaagcaaccatgggaaaagaaaaggttcatatcaacattgttgttattggccatgttgactctggaaagtcaactactactgggcatctgatttataagttgggtggtattgacaagcgtgtgattgagcgttttgagaaggaagctgctgaaatgaacaaaaggtcattcaagtatgcttgggtgcttgataagctaaaggctgagcgtgaacgtggtattaccattgatattgcactatggaagtttgagaccactagatactactgcactgtcattgatgctccaggacatcgtgatttcattaagaacatgattactggaacttctcaggctgattgtgcagtgctgattattgattcaacaactggaggttttgaagctggtatttccaaagatggtcagacccgagaacatgctcttctagctatttacactgggagtgaagcaaatgatttgctgctgtaacaagatggatgctactaccccaaaatactcgaaggctcggtatgaagaaattgtcaaggaagtgtcttcttatttgaagaaggttggatacaatccagacaagatcccttttgtgccaatctctggttttgagggtgataacatgattgagagatcaagtaaccttgattggtacaagggtccaacactgttggatgcccttgaccaggtttcagagcccaaacgtccatcagacaagccactcaggttgccacttcaggatgtttacaagattggtggtattggaactgtacctgtggggcgagttgagactggagtgataaagccaggtatggttgtaacctttggtccatctgggttgacaactgaagttaagtctgttgaaatgcatcatgaagctttgttagaggcattgcctggtgacaatgtcggattcaatgtcaagaatgttgctgtgaaagatctcaagcgagggtatgtagcctctgattcaaagaatgacccagcgaaagaggctgcgaacttcacttcccaggtcatcatcatgaaccatccaggacaaattggaaatggttatgcacctgtgctggattgccacacatgccacattgctgttaagtttgctgagatcttgactaaggttgacagacgatctggtaaggaacttgagaaggaaccaaagttcattaagaatggggatgctgcatttgtcaagatgattccaaccaagcccatggtcgtggaaacattctctgagtaccctccattgggtcgttttgctgtgagggatatgcgtcagactgttgctgttggagtcatcaaggctgttgagaagaaggaaccttctggtgctaaggttaccaaggctgctgctaaaaagaagtgaaagtttgtgcaatttgtgcaggaactggggcatgccagaagctttttgcctgcttgtatgctggatttttgcacatatggtacggtagtaggaatattagcttgtcatatgcaaaattgggttcttgatagacggtggcattgttcatttgtttccttttaaagcatttagtagtttaagaaaggtacttgatttctctgcggggaaattttttggtttgtctgcactgctaggaaatttatgcagtctgagcagaggaggatttaaataattttaatttctaatgactggtaaaaattctatacaatgcatataatttttaccagtcattagaaattaagatttttcaaatactaaccctcagcttcatcaacttggatatcgggacaaggcatggagtgtcaacaagcttgctcgtgttgcacgcaagcaagggctttttgatgtctgtgtagctgtgctcaacaaaatgtatggctacgcaacc

SEQ ID NO: 1163 - DNA, 1384 bp, Ricinus communis
ttttaggcatctataatgggtaaggagaaggttcacatcaacattgtggtcattggccatgtcgactctggaaagtcaactactactggccatctcatctataagttgggaggtattgacaagcgtgtcattgagagattcgagaaggaagctgctgagatgaacaagaggtcattcaagtatgcttgggtgcttgacaagcttaaggccgagcgtgagcgtggtatcaccattgatattgccttgtggaagtttgagaccaccaagtactactgcaccgtcattgatgcacctggacatcgtgactttatcaagaatatgattaccggtacttcacaggctgactgtgctgttctgattattgattccaccactggtggttttgaagctggtatttccaaggatggtcagacccgtgagcatgctctccttgctttcaccctcggtgtcaagcaaatgatttgctgttgcaacaaggtgaaataaaccatcttgttataattgtactcccaagtactccaaggccaggtatgatgaaattgtcaaggaggtttcctcttacctgaagaaggtcggatacaaccccgataaaattcctttcgttcccatctctggcttcgaaggtgacaacatgatcgagaggtccaccaaccttgactggtacaagggaccaaccctacttgaagctcttgaccagatcaatgagccaaagaggcccacagacaagcctcttcgtctcccacttcaagacgtttacaagattggtggtattggaacagttccagtgggtcgggtggagactggtgtcctcaagcctggtatggttgtgacctttggacccagtggactgacaactgaagttaagtcggttgaaatgcatcacgaggctctccaggaggccctccctggtgacaatgttggtttcaatgttaagaatgttgctgtcaaggatcttaagagaggttttgttgcttcaaactccaaggacgatccagcaaaggaggcagccaacttcacatcccaagtcatcatcatgaaccatcctggtcagattggaaatggatatgctccagtgttggactgtcacacctcccacattgctgtgaagtttgctgagatcctaaccaagattgatcgtcgatccggtaaggagcttgagaaggagcccaaattcttgaagaatggtgatgctggtttcgtgaagatgattccaaccaagcccatggttgttgagaccttctccgagtaccctccattgggtcggtttgctgttagggacatgcgccaaactgttgcagtgggtgttatcaagagtgttgagaagaaggacccaagcggagctaaggtcaccaagtctgctgccaagaagggaggaaaatgagag

SEQ ID NO: 1164 - DNA, 1886 bp, Mimulus guttatus
tgtttcttgttaagcttctcgtgtttgccaaccgcggctagggttttagtccgaccatttctcgtatctgtatcccgagttcgttaagcattcaccatgggcaaagaaaaggttcacatcaacattgtggtcatcggccatgttgactcgggaaagtcaaccaccaccggccatttgatctacaagcttggtggcattgataagcgagtgatcgaaaggttcgagaaagaagcagcggagatgaacaaaaggtcgttcaagtatgcgtgggtgcttgacaagctaaaggcagagcgagagcggggtatcaccattgatatagccttgtggaaattcgagaccacaaagtactactgcacggtcatcgatgcgccaggtcaccgtgacttcatcaagaacatgatcacaggtacctcacaggctgattgtgctgtcctgatcattgactcgactaccggtggttttgaagctggtatttccaaagatggtcagacgcgcgagcatgcgttgctcgctttcactcttggtgtcaagcaaatgatctgctgctgcaacaagatggacgccactactccgaaatactccaaggcaaggtacgacgaaatagtaaaggaagtctcctcctacctcaagaaagtcggttacaaccccgacaaaatcccctttgtacccatctccggtttcgagggagacaacatgattgagcgctccacaaacctcgactggtacaaagggcccacactcctagacgccctcgacatgatttccgagcccaagaggcccacagacaagcccctccgtctaccgctccaagacgtctacaaaatcggcggcatcggcacagtccccgtcggccgtgtggagacaggtgtcctaaagcccggcatgctcgtcacattcgggcccaccggtttgaccaccgaagtcaaatctgtagaaatgcaccacgagtcaatgcccgaagctctaccgggtgacaatgtaggtttcaacgtgaaaaatgttgcggttaaagatttaaaacgtggcttcgttgcttcgaattcgaaagatgatccggctagagaagctgcacattttacttcgcaggtgattataatgaaccatccgggtcaaatagggagtgggtatgcaccggttcttgattgccacacgtgtcacatcgcggtgagatttgcggagcttgtgactaagattgatagacggtctggtaaggagattgagagggagccgaagtttttaaagaacggtgacgcgggttttgtgaagatgtttccgacgaagccgatggtggtggagactttttcagagtacccgccgcttggtcggtttgcggttagagatatgaggcagacggtggctgttggtgtcatcaagagcgtggagaagaaggacccgaccggtgctaaggtgaccaaggcggcagccaagaaaggtgccaagtgagaactgtgctgctggttcattgtgtagaaactatgttctgctgcttccttgtgttcgttacattgtttcttttgctgtaaattattacgttatatgttgggtagttgtcagcattgggtgctggataggcggtggcggaggaactgagtactcagttgatttctggtttttttggatggtagcttaaactcgatttgtcgttgagggtaaaattgtaattgaacacccgatgcatcttaggctctgttggctttcgagtccattttccttttctttcactacatcgttgcccaatcttaaccaacccatatcccaaactcgtctatgtagtaaaatcaaatttagttcttgaattacatatctttgattcttgatatttcgatactctcagcactttataactattttatatactattgtttaggggtgttagattttaa

SEQ ID NO: 1165 - DNA, 1351 bp, Olea europaea
atgggtaaggagaaggttcacattaacattgtggtcattggccatgttgactctggaaagtcgaccaccactggtcacttgatctacaagctcggtggtattgacaagcgtgtcattgaaaggttcgagaaggaggctgctgagatgaacaagaggtctttcaagtatgcctgggtgcttgacaagctcaaagctgaacgtgagcgtggtattaccattgatattgccttgtggaagtttgagaccacaaaatactactgcactgtcattgatgctccaggacatcgggacttcatcaagaatatgattactggtacctcacaggctgactgtgctgtccttatcattgattccacgactggaggttttgaagctggtatttccaaggatggccagacccgtgagcatgctttgctcgccttcaccctcggtgtcaagcaaatgatttgctgttgcaacaagatggatgctaccacaccaaaatactccaaggcaaggtatgacgaaattataaaagaagtctcttcctatctcaagaaggtgggatacaacccagagaaaatcccatttgtccccatctctggttttgaaggtgacaacatgattgaaaggtccaccagccttgactggtacaagggcccgactctcctcgaggctcttgatatgctcctggagcccaagaggccttctgacaagccccttcgtctcccacttcaggatgtttacaagattggtggtattggtactgttcctgtgggtcgagtggagacaggtattatcaagcctggtatggttgtcacctttggtccttctggattgactactgaagttaagtcagttgaaatgcaccatgaagccctccaggaggctctccctggtgacaatgtggggttcaatgtcaagaatgttgctgtcaaggatctcaaacgtggttatgttgcctccaactccaaggatgatcctgccaagggggctgccaatttcacctcccaggtcattatcatgaaccaccctggacaaattggaaatgggtatgccccagttctcgattgccacacctcccatattgctgtgaagtttgcagagcttatcaccaagattgatagacgatctggtaaggagctcgagaaggaacccaagttcttgaagaatggtgatgcaggttttgttaagatgattccgaccaagcccatggtggttgagacattctctgaatacccacctcttggtcgttttgctgtgagggacatgcgtcaaactgtggctgttggtgtcatcaagagtgtagataagaaggatccaagtggtgctaaggtcactaaggctgctgcaaagaaaggtgccaagtgaa

SEQ ID NO: 1166 - DNA, 1445 bp, Brassica juncea
cgtcctcatttacttctctcactcagtttcgtagccgcatctcgcattctcacttgcagctatgggtaaagagaagtttcacatcaacatcgtggtcattggccatgtcgattctggaaaatcgaccacgactggtcacttgatctacaagctcggtggtattgacaagcgtgtcatcgagaggttcgagaaggaggctgctgagatgaacaagaggtccttcaagtacgcgtgggtgttggacaaacttaaggccgagcgtgagcgtggtatcaccattgatatcgctctctggaagttcgagaccaccaagtactactgcacggtcattgatgctcctggacatcgtgatttcatcaagaacatgattactggtacctcccaggctgattgtgctgtcctcatcattgactccaccactggtggttttgaagctggtatctccaaggatggtcagacccgtgagcatgctcttcttgctttcacccttggtgtcaagcaaatgatttgctgctgtaacaagatggatgccactacccccaagtactccaaggctaggtacgatgagatcatcaaggaggtgtcttcctacttgaagaaggttgggtacaaccctgacaaaatcccattcgtccccatctctggattcgagggtgacaacatgattgagaggtccaccaaccttgactggtacaagggaccaactctccttgaggctcttgaccagatcaacgagcccaagaggccctcggaaaagcccctccgtctcccacttcaggatgtctacaagatcggtggtattggaacggtgccagtgggacgtgttgagaccggtatgctcaagcccggtatggttgtgacctttgctccttcagggttgaccactgaggttaagtctgttgagatgcaccacgagtctcttgtggaggcacttccaggtgacaacgttgggttcaatgttaagaatgttgctgtgaaggatcttaagcgtgggtatgttgcatctaactccaaggatgacccagctaagggagctgccaacttcacatcccaggtcataatcatgaaccaccctggtcagatcggtaacggatacgccccagtcctcgattgccacacgtcccacattgcagtcaagttctctgagatcttgaccaagattgacaggcgatctggtaaggagatcgagaaggagcccaagtttttgaagaatggtgatgctggtatggttaagatgactccaaccaagcccatggttgtcgagactttctcagagtacccaccattgggtcgtttcgcagttagggacatgaggcagaccgtggctgttggtgttatcaagagcgttgacaagaaggacccaaccggtgccaaggtgaccaaggccgcagtgaagaagggagccaaatgatgagagacttctctcgtctttgtgttttctttgc

SEQ ID NO: 1167 - DNA, 1519 bp, Brassica juncea
catttacttctctcactcagtttcgtagccgcatctcgcattctcacttgcagctatgggtaaagagaagtttcacatcaacatcgtggtcattggccatgtcgattctggaaaatcgaccacgactggtcacttgatctacaagctcggtggtattgacaagcgtgtcatcgagaggttcgagaaggaggctgctgagatgaacaagaggtccttcaagtacgcgtgggtgttggacaaacttaaggccgagcgtgagcgtggtatcaccattgatatcgctctctggaagttcgagaccaccaagtactactgcacggtcattgatgctcccggacatcgtgatttcatcaagaacatgattactggtacctcccaggctgattgtgctgtcctcatcatcgactccaccactggtggttttgaagcgggtatctctaaggatggtcagacccgtgagcatgctcttcttgctttcacccttggtgtcaagcaaatgatttgctgttgtaacaagatggacgccactacccccaagtactccaaggctaggtacgatgaaatcatcaaggaggtgtcttcctacttgaagaaggtgggatacaaccctgacaaaatcccattcgttcccatctctgggttcgagggtgacaacatgattgagaggtccaccaaccttgactggtacaagggaccaactctccttgaggctcttgaccagatcaacgagcccaagagaccctcagacaagcccctccgtctcccacttcaggatgtctacaagatcggtggtattggaacggtgccagtgggacgtgttgagactggtatgctcaagcctggtatggttgtcaccttcgctccttcagggttgaccactgaggttaagtctgttgagatgcaccacgagtctcttgtggaggcacttccaggtgacaacgttggattcaatgttaagaatgttgctgtcaaggatcttaagcgtgggtatgttgcatccaactctagggatgaccctgctaagggagccgccaacttcacatcccaggtcatcatcatgaaccaccctggtcagattggtaacggatacgccccagttctcgattgccacacatcccacattgcagtcaagttctctgagatcttgaccaagattgacaggcgatctggtaaggagatcgagaaggagcccaagtttttgaagaatggtgatgctggtatggttaagatgactcccaccaagcctatggttgtcgagactttctcagagtacccaccattgggacgttttgctgtcagagacatgagacagaccgtggctgttggagttatcaagagtgttgacaagaaggacccaaccggtgccaaggtcaccaaggctgctgtcaagaagggtgccaaatgatgagactctctccttaaaaaaaactttgattgtgtttgagcctttttaatatttttctgcgactctctctgcctttttggatagctctgagacatggtttcaattatgcagttt

SEQ ID NO: 1168 - DNA, 1835 bp, Brassica rapa
gtagcaaatcattttaaaacattagaaaggctaaaatgcctaagggtaaactggtaaaaaactagtaccgcaaacgaaaatgcgaaagccctagagctcgtagctataaatactctgtgttgttcattgagctcactctcctttcgttctctcgcttagtttcgtagccgcaagactccctctcagattcttacttgcagctatgggtaaagagaagtttcacatcaacattgtggtcattggccatgtcgactctggcaaatcgactacaactggtcacttgatctacaagcttggtggtattgacaagcgtgtcatcgagaggttcgagaaggaggctgctgagatgaacaagaggtccttcaagtacgcgtgggtgttggacaaacttaaggctgagcgtgagcgtggtatcaccattgatattgctctctggaagttcgagaccaccaagtactactgcactgtcattgatgcccctggacatcgtgatttcatcaagaacatgattactggtacctcccaggctgattgtgctgttcttatcattgactctaccaccggaggttttgaggctggtatctccaaggatggtcagacccgtgagcatgctcttcttgccttcacccttggtgtcaagcaaatgatttgctgctgtaacaagatggatgccacaacccccaagtactccaaggctaggtacgatgagatcatcaaggaggtgtcttcctacttgaagaaggtcgggtacaaccctgacaaaatcccattcgtccccatctctggattcgagggtgacaacatgattgagaggtccaccaaccttgactggtacaagggaccaactctccttgaggctcttgaccagatcaacgagccaaagaggccttcagacaagcccctgcgtctaccacttcaggatgtctataagatcggtggtattggaacggtgccagtgggtcgtgtggagactggtatgctcaagcccggtatggttgtgacattcgctccttcagggttaaccactgaggtcaagtccgttgagatgcaccacgagtctcttgtggaagcgcttcctggtgacaatgtcggattcaatgtcaagaatgttgccgtcaaggatcttaagcgtgggtatgttgcatccaactccaaggatgaccctgccaagggagctgctaacttcacttcccaagtcatcatcatgaaccaccctggtcagatcggtaacggttacgccccagtgcttgattgccacacttcccacattgcagtcaagttctctgagatcctcaccaagattgacagacgttctggtaaggagatcgagaaggagcccaagtttttgaagaatggtgatgccggtatggtgaagatgactccgaccaagcccatggttgttgagactttctcagagtacccacctttgggacgtttcgctgttagggacatgaggcagaccgtggctgttggtgtcatcaagagtgttgacaagaagcacccaaccggtgccaaggtcaccaaggctgcagtcaagaagggtgccaaatgatgagacttctctcatgctttgttcactttgcttaaaaaaaactttgatgtgttttgaggctctttttgtttactacactcatctctctacttttttttttatatctctgttacttatggttttagttatgcagtttctggataattttgcctaatgctttctattgttcgtttaaagtttattcaaattgcatgttcttatcttaggctgttcaagatttcatgggaaagtaactgaaataacattaagaaattcattgttaaagtgttaataatgtttatgt

SEQ ID NO: 1169 - DNA, 1704 bp, Lactuca sativa
ctcttctactagcgattgatcattgcttcctctgaaactagggttttgatccattattcactacaagttttaagatttgatcatgggtaaggaaaagactcacgtcaacattgtggtcatcggacatgtcgactccggcaagtctacaaccaccggacatctgatatataagcttggaggaattgacaagcgtgtgattgaaaagttcgagaaagaagctgctgagatgaacaagcgttcattcaaatacgcatgggtgctcgataaactcaaggccgagcgtgagcgtggtatcaccatcgacattgctttgtggaagtttgagaccacaaagtactactgcactgtcatcgacgctcccggccaccgcgatttcatcaagaacatgatcaccggaacttctcaggccgactgtgccgtccttatcatcgactccaccaccggtggctttgaagctggtatctctaaagatggtcagactcgtgaacacgctctccttgctttcactcttggagtcaaacagatgatttgttgttgcaacaagatggatgcgactactcctaagtactcgaaggcgagatacgatgaaattgtgaaggaggtctcatcgtatttgaagaaggtcggatacaaccctgacaagatcccatttgttccgatctctggttttgaaggtgacaacatgatcgaaaggtccaccaacttagactggtacaaaggtccaactctcctcgacgctcttgacgccattaacgaacccaagagaccttccgacaagcccctccgtcttccacttcaggacgtgtacaagattggtggtatcggaactgttccagtcggtcgtgttgaaaccggcgtcatcaaaccgacgatgctcgtgactttcggtccatctggtttgacaactgaagttaagtctgttgagatgcaccatgaagctctccaggaagcactccccggcgacaacgtcgggttcaacgtgaagaatgtgtctgtgaaagatctgaagcgaggatacgttgcgtctaactcgaaagacgatccatgcaagggtgctgccaactttacttcgcaagttattatcatgaaccacccgggacagatcggaaacggctatgctccggtgctggactgtcacacgtcacatattgccgtgaagtttgctgaaattttgacaaagattgataggcgatcggggaaggagcttgagaaggagccgaagtttcttaaaaatggtgatgcaggtatgatcaagatgattccgacgaaacccatggtggtggagacgttctcggagtatccaccacttgggcggtttgcggtgagggatatgaggcagacggtggcggtgggtgtgatcaagagtgtggagaagaaggatccgactggagcaaaggtgacgaaagcagcagcgaagaagggtgggaaatgaatcgtgcaggttaggatgttgaagatgggtcgtttagttggttcgttgaatgattttttgataattttgttgccattgccgcaaacatggtcggagaactgggttctggatcggcggtggcgagtctaaacttgtgctgcatctggtagtttgggtcaataagcagctagaatgtttgagttagggtttttgattctttttttgttcttatggattcatattaattaattagggttttttttaaatggtttgttaatgttggattgttggct

SEQ ID NO: 1170 - DNA, 1693 bp, Medicago truncatula
agaactttttgtggttttaaacttttaaggacaatgggtaaggaaaaggttcacattaacattgttgtcattggccatgtcgactctgggaagtcaactaccactggtcacttgatctacaagcttggaggtattgacaagcgtgtgattgagaggtttgagaaagaagctgctgagatgaacaagcgttcattcaagtatgcttgggttcttgacaagctcaaggctgagcgtgaaagaggtatcacaattgacattgctctgtggaagtttgagaccactaagtactactgcactgtcattgatgcccctggacacagggatttcattaagaacatgattactggtacatcccaagctgattgtgctgttctcatcattgattccaccactggtggttttgaagctggtatttccaaggatggtcagacccgtgaacatgctctccttgctttcactcttggtgtgaagcaaatgatctgctgttgcaacaaggtatttaatattttcagccctcccaagtactccaagagcaggtatgatgaaattgtgaaggaagtatcatcctacatgaagaaggttggctataacccagataaaattccatttgttcccatctctggttttgagggagataacatgattgagcgctctacaaatcttgactggtacaagggtccaacacttcttgaggctcttgatcaaatcaatgagcctaagaggccatcagacaagcccctccgactacctcttcaggatgtctacaagattggaggaattggaactgttcctgtgggacgtgttgagactggtgtcataaaacctggaatggttgtcacttttgcccctactggactgacaactgaagtcaagtccgtggagatgcatcatgaagctctcacagaggcccttcctggtgacaatgtgggatttaatgtcaagaatgttgctgttaaggatctcaagcgtgggtatgttgcctcaaactccaaggatgacccagccaaggaggctgctaactttacatctcaagtgatcataatgaatcaccctggccagattggaaatggctatgcccctgttcttgactgccacacctcccacattgctgtcaagtttgctgagcttgttactaagattgataggcgttctggtaaggagattgagaaggagcccaaattcttgaagaatggagatgctggtattattaagatgattcccaccaagcccatggtggttgagactttctctgaatatcctccactcggccgttttgctgttagagacatgcgtcaaactgtggctgttggggttatcaagggtgtggagaagaaggatcccagtggaggacttaagcagaccaagtcagcagccaagaagaaatgaaccgtgcaggatggtctatctacttgggaagtttatagtcgttattacaataaatggtttgtggttcttagtatttctatttcgtgtcttgttaagttgttttttggattaagtgtgaagtctgcaccgtcatctcccagcttttgttcccagaactgggttctagatcgacggtggcatgactagtttatttttcttgtttctgctttaattgtcttgtcttgtgtgaacacctgaattttacaagcagcaagtttccggacctgctgtttgtttttaatatcaactctatatctgcgtgtttatt

SEQ ID NO: 1171 - DNA, 1817 bp, Mimulus guttatus
tcttgttaagcttctcgtgtttgccaaccgcggctagggttttagtccgaccatttctcgtatctgtatcccgagttcgttaagcattcaccatgggcaaagaaaaggttcacatcaacattgtggtcatcggccatgttgactcgggaaagtcaaccaccaccggccatttgatctacaagcttggtggcattgataagcgagtgatcgaaaggttcgagaaagaagcagcggagatgaacaaaaggtcgttcaagtatgcgtgggtgcttgacaagctaaaggcagagcgagagcggggtatcaccattgatatagccttgtggaaattcgagaccacaaagtactactgcacggtcatcgatgcgccaggtcaccgtgacttcatcaagaacatgatcacaggtacctcacaggctgattgtgctgtcctgatcattgactcgactaccggtggttttgaagctggtatttccaaagatggtcagacgcgcgagcatgcgttgctcgctttcactcttggtgtcaagcaaatgatctgctgctgcaacaagatggacgccactactccgaaatactccaaggcaaggtacgacgaaatagtaaaggaagtctcctcctacctcaagaaagtcggttacaaccccgacaaaatcccctttgtacccatctccggtttcgagggagacaacatgattgagcgctccacaaacctcgactggtacaaagggcccacactcctagacgccctcgacatgatttccgagcccaagaggcccacagacaagcccctccgtctaccgctccaagacgtctacaaaatcggcggcatcggcacagtccccgtcggccgtgtggagacaggtgtcctaaagcccggcatgctcgtcacattcgggcccaccggtttgaccaccgaagtcaaatctgtagaaatgcaccacgagtcaatgcccgaagctctaccgggtgacaatgtaggtttcaacgtgaaaaatgttgcggttaaagatttaaaacgtggcttcgttgcttcgaattcgaaagatgatccggctagagaagctgcacattttacttcgcaggtgattataatgaaccatccgggtcaaatagggagtgggtatgcaccggttcttgattgccacacgtgtcacatcgcggtgagatttgcggagcttgtgactaagattgatagacggtctggtaaggagattgagagggagccgaagtttttaaagaacggtgacgcgggttttgtgaagatgtttccgacgaagccgatggtggtggagactttttcagagtacccgccgcttggtcggtttgcggttagagatatgaggcagacggtggctgttggtgtcatcaagagcgtggagaagaaggacccgaccggtgctaaggtgaccaaggcggcagccaagaaaggtgccaagtgagaactgtgctgctggttcattgtgtagaaactatgttctgctgcttccttgtgttcgttacattgtttcttttgctgtaaattattacgttatatgttgggtagttgtcagcattgggtgctggataggcggtggcggaggaactgagtactcagttgatttctggtttttttggatggtagcttaaactcgatttgtcgttgagggtaaaattgtaattgaacacccgatgcatcttaggctctgttggctttcgagtccattttccttttctttcactacatcgttgcccaatcttaaccaacccatatcccaaactcgtctatgtagtaaaatcaaatttagttcttgaattacatatctttgattcttgat

SEQ ID NO: 1172 - DNA, 1920 bp, Pinus taeda
gagctgagcggtctattgtgttgtggagagcgaagcaggggaactctgcgattcttttttggtgggaagctgaagctgcttcctgtcttgcattattcgcgtttttgattcaggaatacttgttttttagaaaaccatgggtaaagagaagacccacatcaacattgtggtcataggacatgtcgactctggcaagtccaccactaccggtcatcttatttacaagcttggcggtatcgacaagcgtgtgatcgagcgttttgagaaggaagctgctgaaatgaacaaaaggtcattcaagtatgcctgggttcttgacaagcttaaggctgagcgcgagcgtggtattactattgacattgctctctggaagtttgagacaaccaagtattactgtaccgtcattgacgcaccaggccatcgtgactttatcaagaacatgattacgggtacatcacaggccgattgtgctgttttgattattgattctaccaccggaggttttgaagcgggtatttcgaaggatggacagaccagagaacatgctcttttggcattcactctgggagtgaagcagatgatttgttgttgtaataagatggatgctaccacccctaagtactccaaggcccgttatgatgaaattgtaaaagaagtgtcgtcatacctgaagaaagttgggtacaaccccgataaaattccttttgtccctatttctgggttcgaaggagataacatgattgaaagatccaccaacctggattggtacaagggcccaactctgttggatgcccttgaccagatatctgagccgaagagaccatctgacaaaccccttcgattgccactacaagatgtgtacaagattggtggtattggaactgtgccggtgggacgtgttgaaaccggtgtccttaagcccggtacggttgtaaccttcggtcccactgggttgacaactgaagtcaagtcagtagaaatgcatcatgaagctctgttagaggcattacccggtgacaatgttggcttcaatgtcaagaacgttgcagtcaaggatttgaaacgtgggtatgttgcatctgactccaagaacgacccagcaaaggaagcagctaactttacctctcaagtaatcataatgaaccaccctggccagatttcgaatggctatgcacctgtgttggactgccacacctgccacattgctgtcaaatttgctgaaattatgacaaaggtcgatagacgatctggtaaagaaattgagaaggagcccaaatttctgaagaatggagatgctgggtttattaagatgattccctccaagcccatggttgtggagacattctctgagtaccccccgctgggtcgttttgctgtgagagacatgcgtcaaacggttgctgttggagtcatcaagggtgttgagaaaaaggaacccactggtgccaagatcaccaaggctgcggtcaagaagggtaaatgaagtttgctgctaccaagtacttttgtgcagaggaagggagacggttatggatacaatacttatacgtgttgtagaagcttgtctgattctgatgcacgagatttggtagttaggggtttagtggctcggcgcatgcaaacatgggttcttgaccggcggtggcagcatattcgcaatgcaatttattgttcctagcattttagtaatttgggcgggtttagtacaacttcgtgggtgagggttagtactgcatcggattttcaaagaccattgcaacgtctatttaattgtggatttttatgtttgtgcattgtggaagactttttatgtgagttaagttatgagaatattgtgtcaaggttgtttacaatgtgatggtgtttttattgttcttggcgtttacatcgtgtcttctttaaattatgaagaaactgaac

SEQ ID NO: 1173 - DNA, 1775 bp, Pinus taeda
ttattcgcgtttttgattcaggaatacttgttttttagaaaaccatgggtaaagagaagacccacatcaatattgtggtcataggacatgtcgactctggcaagtccaccactaccggtcatcttatttacaagcttggcggtatcgacaagcgtgtgatcgagcgttttgagaaggaagctgctgaaatgaacaaaaggtcattcaagtatgcctgggttcttgacaagcttaaggctgagcgcgagcgtggtattactattgacattgctctctggaagtttgagacaaccaagtattactgtaccgtcattgatgcaccaggccatcgtgactttatcaagaacatgattacgggtacatcacaggccgattgtgctgttttgattattgattctaccaccggaggttttgaagcgggtatttcgaaggatggacagaccagagaacatgctcttttggcattcactctgggagtgaaacagatgatttgttgttgtaataagatggatgctaccacccccaagtactccaaggcccgttatgatgaaattgtaaaagaagtgtcatcatacctgaagaaagttgggtacaaccccgataaaattccttttgtccctatttctgggttcgaaggagataacatgattgaaagatccaccaacctggattggtacaagggcccaactctgttggatgcccttgaccagatatctgagccgaagagaccatctgacaaaccccttcgattgccactacaagatgtgtacaagattggtggtattggaactgtgccggtgggacgtgttgaaaccggtgtccttaagcccggtacggttgtaaccttcggtcccactgggttgacaactgaagtcaagtcagtagaaatgcatcatgaagctctgttagaggcattacccggtgacaatgttggcttcaatgtcaagaacgttgcagtcaaggatttgaaacgtgggtatgttgcatctgactccaagaacgacccagcaaaggaagcagctaactttacctctcaagtaatcataatgaaccaccctggccagatttcgaatggctatgcacctgtgttggactgccacacctgccacattgctgtcaaatttgctgaaattatgacaaaggtcgatagacgatctggtaaagaaattgagaaggagcccaaatttctgaagaatggagatgctgggtttattaagatgattccctccaagcccatggttgtggagacattctctgagtaccccccgctgggtcgttttgctgtgagagacatgcgtcaaacggttgctgttggagtcatcaagggtgttgagaaaaaggaacccactggtgccaagatcaccaaggctgcggtcaagaagggtaaatgaagtttgctgctaccaagtacttttgtgcagaggaagggagacggttatggatacaatacttatacgtgttgtagaagcttgtctgattctgatgcacgagatttggtagttaggggtttagtggctcggcgcatgcaaacatgggttcttgaccggcggtggcagcatattcgcaatgcaatttattgttcctagcattttagtaatttgggcgggtttagtacaacttcgtgggtgagggttagtactgcatcggattttcaaagaccattgcaacgtctatttaattgtggatttttatgtttgtgcattgtggaagactttttatgtgagttaagttatgagaatattgtgtcaaggttgtttacaatgtgatggtgtttt

SEQ ID NO: 1174 - DNA, 1634 bp, Plantago ovata
ctccctcattcgatattcagactctgcaacttcaggagatttattattaacttgtgatctaaagcaacatgggtaaggaaaaggttcacatcaacattgtggtcattggccatgtcgactctgggaagtcaaccaccactggacatctcatctacaagctaggaggtattgacaagcgtgtgattgaaagatttgagaaggaggctgctgagatgaacaagaggtccttcaagtatgcttgggtgctggacaagcttaaggctgagcgtgagcgtggtatcactattgatattgccctgtggaagtttgagacaaccaagtactactgcactgtcattgatgctcctggacatcgtgatttcattaagaacatgattaccggtacttctcaggctgattgtgctgttctgatcattgattccaccactggtggttttgaggctggtatatccaaggatggtcagactcgtgagcatgctctcttggctttcactcttggagtgagacagatgatttgctgctgcaataagatggatgctactactcccaagtactccaagtcaaggtatgatgaaattgttaaggaagtctcctcctacatgaagaaggtgggttacaatcctgataaaatcccatttgtgcccatctctggttttgagggtgacaacatgattgagaggtctaccaacctcgactggtacaagggcccaacactccttgaggctcttgacatgatccatgagcccaagaggccctcagacaagcctctgcgtctcccacttcaggatgtgtacaagattggtggcattggtactgtcccagtcggaagggttgaaactggtgtcatcaaacccggtatggttgttacctttggtccatctgggctgacaactgaagtcaagtccgtagagatgcaccacgaagccctcccagaagctcttcccggtgacaatgtgggattcaatgtgaagaatgttgctgtgaaggatctcaagcgtggttatgttgcgtccaactccaaggatgatcctgccaagggagctgcaaacttcacatctcaggtcatcatcatgaatcacccaggacagattggccagggttatgccccagttctcgattgccacacttctcacattgctgtcaagttcgctgagcttctgaccaagattgacaggcgttctggaaaggaactggagaaggaacccaagttcttgaagaacggtgatgctggtatggtgaagatgcttccaaccaagcctatggttgtggagactttctccgagtaccccccattgggacgttttgctgttagggacatgcgtcagacggttgctgttggtgtgatcaagagtgttgacaagaaggatccatctggagctaaggtcaccaaggccgcagccaagaagggtgccaagtgaaccggacagggttatgacgtcctactttcctattcctatttgcaatgcataataatgttttatgttggtcttttgaattttggacatctgttacttgtcgctgcacggttgttttctggctctcagtattgggtgctggatcgtcggtggcattttaagtttctgccatttatgtcttgactctattgtggattttatatcaatgccagtatggca

SEQ ID NO: 1175 - DNA, 1862 bp, Populus trichocarpa
tcctcgctctcacccctgcttctcctttttctatcctcttgccgctagggtttttgcatcttacttcagttaagcgctgagatttcattatgggtaaagagaagagtcacattaacattgtggtcattggccatgtcgactctggcaagtcaaccaccactggacacttgatctacaagcttggaggtattgacaagcgtgtcatcgagaggttcgagaaggaagctgctgagatgaacaagaggtcattcaagtatgcttgggtgcttgacaagctcaaggctgagcgcgaacgtggtattaccattgatattgctctgtggaagttcgagaccaccaggtactactgcactgtcatcgatgctcctggacatcgtgactttataaagaacatgattaccggaacctcccaggctgactgtgcagtcctcatcattgactctaccactggtggttttgaggctggtatctccaaggatggtcagacccgtgagcatgctcttcttgccttcacccttggtgtcaagcaaatgatctgctgctgtaacaagatggatgccaccacaccaaaatactccaaggctaggtatgatgaaattatcaaggaagtgtcatcctatttgaagaaagtcggttacaaccctgacaagattcccttcgtgcctatctctggttttgagggtgataacatgattgagaggtccaccaacctggactggtacaagggaccaactctcctcgatgccctcgaccagatccaggagcccaagaggccctcggacaagcccctccgtctcccacttcaggacgtgtacaagattggtggtatcggaacggtcccagtgggtcgtgtggaaactggtgtcatcaagcctggtacagttgtcactttcgggccaactggactaactactgaagttaagtctgttgagatgcaccacgaagcactccaagaggctcttcccggtgacaatgttggattcaacgttaagaatgttgccgtgaaggatctgaagcgtggttttgttgcctcaaactcgaaggatgatcccgccaaggaggctgcgaacttcacctcccaggtgatcatcatgaaccatcctgggcagattggaaatggttacgcccctgttcttgactgccacacctgtcacattgctgtcaaatttgctgagatcctcaccaagattgacaggcgatcagggaaggagttggagaaggaacccaaattcctgaagaacggtgatgcaggtatgattaagatgattcccacgaagcccatggtggtggagactttctcagagtatcccccacttggtcgttttgctgtgagggatatgcgccagactgttgctgtgggagtgatcaagaacgtggagaaaaaagatgcttccagtgctaaggtgacaaaatctgctgtcaagaagggtggcaagtgaaccgtgcaggttgattctactgaaatctatttgaaaaataatgacttggtgtccttttgttgtctatccgaaggatgcatttctgtgtatcatgagatttttagttttgtgtcttcaccatcatcacaaggcttttcacagaattgggttcttgatcggcggtggcctatacaagtcttgaggcagtttcttcatttttgtcgtgtcgctcaaattaagatggtggtgatatatttctagtttcataacagcttgtattttcaattaagtctagtattttgataatgagaaaccccccatatgaagttttgtcatctataggtttttttatcgttagtattttaaattaagtctatagtttttatgttcagtctatttttatcgttaattattatgttaattgcatgccatgttttcctttgc

SEQ ID NO: 1176 - DNA, 1849 bp, Populus trichocarpa
atccgtcattagctactctcctccttccatctctctcgcggccagggtttaatccattctctcgtaagttcagctctaatatatcatcatgggtaaggaaaagagtcacatcaacattgtggtcattggccatgtcgactctggaaaatcaaccaccactggccacttgatctacaagcttggaggtattgacaagcgtgtcatcgagaggttcgagaaggaagctgctgagatgaacaagaggtcattcaagtatgcctgggtgctcgacaagctcaaggctgagcgcgagcgtggtatcaccattgacattgccttgtggaagttcgagaccaccaagtactactgcactgtcattgatgcccctggacatcgtgactttatcaagaacatgattactgggacttcccaggctgactgtgccgtgcttatcattgattccaccactggtggttttgaagctggtatctccaaggatggccagactcgtgagcacgcactccttgccttcacccttggtgtgaggcaaatgatctgctgctgtaacaagatggatgccacaactccaaagtactccaaggcaaggtatgatgaaattgtcaaggaggtgtcatcctacttgaagaaggttggttacaaccctgacaagattccctttgtccccatctctggatttgagggtgacaacatgattgagagatctaccaaccttgactggtacaagggcccaactctcctggatgccctcgaccagatccaggagcccaagaggccctcagacaagcccctccgtctcccgcttcaggacgtgtacaagattggtggtatcggaactgtcccagtgggtcgtgttgaaactggtatcatcaagcccggcatggttgtcacattcggtccaactggactgagtactgaagtcaagtctgttgagatgcaccacgaggctctcctagaggcacttcccggtgacaatgtcgggttcaatgttaagaatgtagctgttaaggatctgaagcgtggttttgttgcctcgaactccaaggacgatcctgccaaggaggctgccaacttcaccgcccaagttatcatcatgaaccatcctgggcagatcggaaacggttacgcccctgttcttgactgccacacctgtcacattgctgtgaagtttgctgagatcctcaccaagattgacaggcggtctgggaaggaactggagaaggagcccaagttcctgaagaatggtgatgctggtatgattaagatgattcccaccaagcccatggtggtggagtctttctcagagtatcctccacttggtcgatttgctgtgagggacatgcgccagaccgttgctgtgggtgtgatcaagagcgtggagaagaaggaaccctctggtgccaaggtgaccaaatctgctgccaagaagggtggcaagtgaacggagcaggttgatgctactggaatctattttacaaataacgacttggttcttcttagttctcaatttcttggatgtttatccatgtgtcttgatctctgtagttttatgtcactactctcatcaagaggctgttcgcagaattgggttcttgatcggcggtggcgatgtatatctttagatatcttctgcgcttttttgtcttaaaagttaaaggttttgtcagacttttctattttcatgaactggtcgcgactggtaggtcttgttaccgaggattctacatcttctatattgtacttgaatagtgttgtgttttgtttggtctctgtcgttggcctgttaccggtaaccttcacagggttttctgcattttcttccttcttttccgcttcttgtaggtgaatttac

SEQ ID NO: 1177 - DNA, 2085 bp, Populus trichocarpa
ccctctctctcgctcactgcctgttcttgtattagcctgcttctcctctctcgcggctagggttttagcgcctctcttcagctcaactctattacataagtatgggcaaagagaagtcgcacatcaacatcgtggtcattggccatgtcgactctggaaagtcgaccaccactggtcacttgatctacaagcttggaggtattgacaagcgtgtcatcgagaggttcgagaaggaagctgctgagatgaacaagaggtcattcaagtatgcttgggtgcttgacaagctcaaggctgagcgtgaacgtggtattaccattgatattgctctgtggaagttcgagaccaccaggtactactgcactgtcatcgatgctcctggacatcgtgactttataaagaacatgattaccggaacctcccaggctgactgtgcagtcctcatcattgactctaccactggtggttttgaggctggtatctccaaggatggtcagacccgtgagcatgctcttcttgccttcacccttggtgtaaagcaaatgatctgctgctgtaacaagatggatgccaccactccaaaatactccaaggctaggtacgatgaaattatcaaggaagtgtcatcctatttgaagaaagtcggttacaacccagacaagattcccttcgtgcctatctctggatttgagggtgataacatgattgagaggtccaccaacctggactggtacaagggaccaactctcctcgatgccctcgaccagatccaggagcccaagaggccctcggacaagcccctccgtctcccccttcaggacgtgtacaagattggtggtattggaacggtcccagttggtcgtgtggaaactggtgtcatcaagcctggtacggttgtcactttcgggccaactggactaactactgaagttaagtctgttgagatgcaccacgaagcactccaagaggctcttcccggtgacaatgttggatttaacgttaagaatgtcgccgtgaaggatctgaagcgtggttttgttgcctcaaactcaaaggatgatcccgccaaggaggctgcgaacttcacctcccaggtgatcatcatgaaccatcctgggcagatcggaaatggttacgcccctgttcttgactgccacacctgtcacattgctgtcaaatttgctgagatcctcaccaagattgacaggcgatcagggaaggagttggagaaggaacctaaatttctgaagaacggtgatgcaggtatgattaagatgattcccacgaagcccatggtggtggagactttctcagagtatcccccacttggacgttttgctgtgagggatatgcgccagactgttgctgtgggagtgatcaagaacgtggagaaaaaggatgcttctagtgctaaggtgaccaaatctgctgccaagaagggtggcaagtgaactgtgcaggatgatgcaactagatgctataatataaatcaagagtgggttcttgtcactagtctattcattggttgtctagctgtttggtacgagaactatagtcttaagtcatcatcgtcattgcgtggctgtcgttcacagaactgggttcttgataggcggtggcgtgttgttttgatctagagtctatttctgtgtctttgttatgtctctcgggttgagcattttatcctctttttttttattttttgacaactggtcagaacttttaaatcttgtcacaacttttttttttttacttgctaattttgcttgtcaactttgatttctgttcgctcaattatctctctattctgacagcgtgtttagaatcattcccactataaattcatatccatgagtaaaatttttacaaatctcaagcaattacattcaataaaaaccttttttttttaatatttaacattaaatacaaaaccttattatattatacataaggccttcgacacactttgccttctctcttgttctctggaatctgatctactaaattggcgtttatttatttttgagttttcaattattcggtttcaaacgtctaaatggattaaatggaatcaatatatatata

SEQ ID NO: 1178 - DNA, 2085 bp, Populus trichocarpa
ccctctctctcgctcactgcctgttcttgtattagcctgcttctcctctctcgcggctagggttttagcgcctctcttcagctcaactctattacttaagtatgggcaaagagaagtcgcacatcaacatcgtggtcattggccatgtcgactctggaaagtcgaccaccactggtcacttgatctacaagcttggaggtattgacaagcgtgtcatcgagaggttcgagaaggaagctgctgagatgaacaagaggtcattcaagtatgcttgggtgcttgacaagctcaaggctgagcgtgaacgtggtattaccattgatattgctctgtggaagttcgagaccaccaggtactactgcactgtcatcgatgctcctggacatcgtgactttataaagaacatgattaccggaacctcccaggctgactgtgcagtcctcatcattgactctaccactggtggttttgaggctggtatctccaaggatggtcagacccgtgagcatgctcttcttgccttcacccttggtgtaaagcaaatgatctgctgctgtaacaagatggatgccaccactccaaaatactccaaggctaggtacgatgaaattatcaaggaagtgtcatcctatttgaagaaagtcggttacaaccctgacaagattcccttcgtgcctatctctggatttgagggtgataacatgattgagaggtccaccaacctggactggtacaagggaccaactctcctcgatgccctcgaccagatccaggagcccaagaggccctcagacaagcccctccgtctcccccttcaggacgtgtacaagattggtggtattggaacggtcccagttggtcgtgtggaaactggtgtcatcaagcctggtacggttgtcactttcgggccaactggactaactactgaagttaagtctgttgagatgcaccacgaagcactccaagaggctcttcccggtgacaatgttggatttaacgttaagaatgtcgccgtgaaggatctgaagcgtggttttgttgcctcaaactcaaaggatgatcccgccaaggaggctgcgaacttcacctcccaggtgatcatcatgaaccatcctgggcagatcggaaatggttacgcccctgttcttgactgccacacctgtcacattgctgtcaaatttgctgagatcctcaccaagattgacaggcgatcagggaaggagttggagaaggaacctaaatttctgaagaacggtgatgcaggtatgattaagatgattcccacgaagcccatggtggtggagactttctcagagtatcccccacttggtcgttttgctgtgagggatatgcgccagactgttgctgtgggagtgatcaagaacgtggagaaaaaggatgcttctagtgctaaggtgaccaaatctgctgccaagaagggtggcaagtgaactgtgcaggatgatgcaactagatgctataatataaatcaagagtgggttcttgtcactagtctattcattggttgtctagctgtttggtacgagaactatagtcttaagtcatcatcgtcattgcgtggctgtcgttcacagaactgggttcttgataggcggtggcgtgtggttttgatctagagtctatttctgtgtctttgttatgtctctcgggttgagcattttatcctctttttttttattttttgacaactggtcagaacttttaaatcttgtcacaacttttttttttttacttgctaattttgcttgtcaactttgatttctgttcgctcaattatctctctattctgacagcgtgtttagaatcattcccactataaattcatatccatgagtaaaatttttacaaatctcaagcaattacattcaataaaaaccttttttttttaatatttaacattaaatacaaaaccttattatattatacataaggccttcgacacactttgccttctctcttgttctctggaatctgatctactaaattggcgtttatttatttttgagttttcaattattcggtttcaaacgtctaaatggattaaatggaatcaatatatatata

SEQ ID NO: 1179 - DNA, 1630 bp, Helianthus annuus
aaagatccacatcagcattgtcgtcattggacatgtcgactccggcaagtcaaccacgaccggacacttgatctacaagcttggaggaatcgacaagagagttatcgagaggttcgagaaagaagccgctgaaatgaacaaaaggtcattcaagtacgcctgggttcttgacaaactcaaagctgaacgagaacgtggaatcacaatcgatattgcattgtggaagtttgagaccaccaagtactactgtaccgtcattgatgctcctggacatcgtgattttatcaagaacatgattactggtacttctcaggctgattgtgcggttctgattatcgactctaccactggtgggtttgaagctggtatttcgaaagacggtcagacccgtgaacatgctctacttgctttcactcttggtgtcaagcaaatgatctgctgttgtaacaagatggacgcaacaactcctaagtactcgaaggcaagatacgatgaaatcgtgaaggaagtttcttcttacttgaaaaaggtcggttacaaccctgacaaaatcccattcgttccaatctcgggtttcgagggcgacaacatgattgagaggtcgacaaacctcgactggtacaagggcccaactcttctcgaagctcttgaccagatcaacgagccaaaacgaccatcagacaaaccccttcgtctaccacttcaggacgtgtacaagatcggaggtattggaaccgtgcctgtcggtcgtgttgaaaccggtgtgatcaagcccggcatggttgtcaccttcggtccatctgggttgacaactgaagtcaagtctgtcgagatgcaccatgaagcactacaagaagctctccccggtgacaacgtcgggttcaacgttaaaaacgttgctgtcaaggatctgaaacgtgggtatgtcgcatccaactcgaaggacgaccccgctaagggcgccgccagtttcacctcacaagtcatcatcatgaaccacccgggtcagatagaaaacggttacgctccagttctcgattgccacacttcccacattgccgtcaagttctccgagctgttgaccaagattgaccgacggtccggtaaagagctcgagaaagagcccaagtttttgaagaacggagatgcgggtatggttaagatgcttccaaccaagccgatggtggtcgagactttcgcggagtacccgcctctcggtaggtttgcggttcgtgacatgaggcagacagttgcggttggtgtgatcaagagtgtcgataagaaggacccgactggcgctaaggtgaccaaggctgcagccaagaagggtgccaagtgaaggtggtggaccgatgaagaagtaattttattggtgtttttgaacaattttaattattatgtttattttggtgtttggtgttgtggcttgcattactgtactctagcctcacttgtgaggatgtgtggaggtattgagcaacttgttgcttgatgatggtggtgcaagtttacaaaaagccagattttgacttattattgtggtacaagttttatgttttttatggtgtcaagtatttgaacctctttatgtttgtcgaaatatgggttatttttatattttactaaactt

SEQ ID NO: 1180 - DNA, 1692 bp, Trigonella foenum-graecum
ttagcgcatccttcaaaagaactttttgtggttttaagcttttaaggacaaatgggtaaggaaaaggttcacattaacattgttgtcattggccatgtcgactctgggaagtcaactaccaccggtcacttgatctacaagcttggaggtattgacaagcgtgttatcgagaggtttgagaaagaagctgctgagatgaacaagcgttcattcaagtatgcctgggtgcttgacaagctcaaggctgagcgtgaaagaggtatcacaattgacattgctctgtggaagtttgagacaactaagtactactgcaccgtcattgatgcccccggacacagggatttcatcaagaacatgattaccgggacatcccaagctgattgtgctgttctcatcattgattccactactggtggttttgaagccggtatttccaaggatggtcagacccgtgaacatgctctccttgctttcactcttggtgtgaggcaaatgatctgctgctgcaacaagatggatgccactacacccaagtactccaagagtaggtatgatgaaattgtgaaggaggtttcatcctatatgaagaaggttggctataacccagataaaattccatttgttcccatctctggttttgagggagataacatgattgagcgctctacaaatcttgactggtacaagggcccaacacttcttgaggcccttgaccaaatcaatgagcctaagaggccatcagacaagcccctccgactaccacttcaggatgtctacaagattggaggaattggaactgtgcctgtgggacgtgttgagactggtaccatgaaacctggaatggtggtgacttttgcgccaactggactgcaaactgaagtcaagtctgtggagatgcaccatgagtctctcaccgaggcccttcccggtgacaatgtgggatttaatgttaagaatgttgctgtcaaggatctcaagcgtggttatgttgcctcaaacaccaaggatgacccagccaaggaggctgctaacttcacatctcaagtgattatcatgaatcaccctggtcagattggaaatggatatgcccctgttcttgactgccacacctcccacattgctgtcaagtttgctgagcttgttactaagattgacaggcgttctggtaaggagatcgagaaggagcccaaattcctgaagaatggtgatgctggtattatcaagatgattcccaccaagcccatggtggttgagactttctctgaatatcctccactcggtcgttttgctgtcagagacatgcgtcaaactgtggctgttggagtcatcaaggctgtggagaagaaggaggctggtgcagcagcaaagttcactaagtcagcattgaagaagaagtgaaccgtgcaggatgatctatctacaagggaagtctatcgtcattattacaataaatggtctttggaccttagtttgtctgtttctcgtctagtaaacttgtttttaagattaaatctgaagtccgcaccgtcatctcgcagcttttgttcacaaaactgggttctagatcgacggtggcagggcttttttcttcttcttccagtttatgctttaattactgtgttctgtgataactttttatattgtgtaagcagctatgttgctgatttggtttagtaatatcaactctatttt

SEQ ID NO: 1181 - DNA, 1528 bp, Ambrosia trifida
acatcaatcacaaagaaatctaaaaatggtaaggaaaagattcatatcagcattgtcgtcattggtcatgtcgactccggtaagtcgaccacaactggtcatctcatctacaagttgggtgggattgataagagggtgatcgagaggtttgagaaagaagctgctgagatgaacaagaggtccttcaagtacgcatgggttcttgacaaactgaaggctgagcgtgaacgtggtatcaccattgatatcgctctgtggaagtttgagaccaccaagtattactgcactgttattgatgctcccggacatcgtgatttcattaagaacatgattaccggtacttcacaggctgatgcctgattgttctgttctgattattgactccaccactggtggttttgaagctggtatttccaaggatggtcagacccgtgaacatgctctgcttgccttcactcttggtgtgaagcaaatgatctgctgttgtaacaagatggatgcaaccactcccaagtactcaaaggcaagatatgatgaaattgtgaaggaagtgtcatcctacctgaagaaggtcggttacaacccagacaaaattccattcgtgcccatctctggatttgagggtgacaacatgattgagaggtctaccaaccttgactggtacaagggtccaacccttcttgaagctcttgaccagatcaacgagcccaagagaccctcagacaagccccttcgtctcccacttcaggacgtgtacaagatcggtggtattggaactgtgccagtgggacgtgttgagactggtgtgatcaagcctggtatggttgttaccttcggaccatctgggttgaccactgaagttaagtctgttgagatgcaccatgaagctttacaagaggctctccctggtgacaacgttgggttcaatgtcaagaacgttgctgtcaaggatctgaaacgtggttacgttgcatccaactcaaaggatgaccctgctaagggtgctgccagtttcacctcccaagtcatcatcatgaaccaccctggtcaaattggaaacggttatgctccggttttggattgccacacatctcacattgccgtcaagtttctgagctgttgaccaagatcgacagacggtctggaaaagagctggagaaggagcccaaattttgaagaatggtgatgctggtatggttaagatgcttccgcaaagcccatggttgttgagacctttgctgagtacccaccactcggcggtttgctgttcgtgacatgcgtcagactgttgctgttggtgttatcaagagcgttgacaagaaggacccaactggagctaaggtgaccaaggctgcagtgaagaagggagctaaatgaaacggttggagtggttttatattttatgaagttttatcgtattttggaactattttcatatttggttaagaatttttggtaaatggtctttttggtgcttgcactgctgtactctagcctcacttgtgaggatgggtggaggtattgagca

SEQ ID NO: 1182 - DNA, 1689 bp, Brassica juncea
cttcattctacatccgagccgctactactatcttcttctctgtgacattactgtgatttcacttgacaagcagccatgggtaaagagaagtttcacatcaacattgtggtcatcggccacgtcgattccgggaagtctaccaccactggtcacttgatctacaagcttggtggtattgacaagcgtgtcatcgagaggttcgagaaggaggctgctgagatgaacaagaggtccttcaagtacgcgtgggtgttggacaaacttaaggctgagcgtgagcgtggtatcaccattgacattgctctctggaagtttgagaccaccaagtactactgcacagtcattgacgctcctggacatcgtgatttcatcaagaacatgattactggtactcccacggctgatgtgctgttttgatcattgactccaccactggggggtttgaagctggtatctctaaggatggtcagacccgtgagcatgctcttcttgctttcacccttggtgtcaagcagatgatttgctgctgtaacaagatggatgccactacccctaagtactccaaggctaggtacgatgagatcatcaaggaagtgtcttcctacttgaagaaggttgggtacaaccctgacaaaatcccattcgtccccatctctgggttcgagggtgacaacatgattgagaggtccactaaccttgactggtacaagggaccaaccctccttgaagctcttgaccagatcaacgagcccaagaggccctctgacaagccccttcgtctcccacttcaggatgtctacaagattggtggtattggaacggtgccagttggtcgtgttgagactggtatgctcaagcctggtatggttgtcacctttgctccttcaggtttgaccactgaggttaagtctgttgagatgcaccacgagtctcttgtggaggcgcttccaggtgacaatgtcggattcaacgttaagaatgttgctgtcaaggatcttaagcgtgggtatgttgcatccaactccaaggatgaccctgccaagggtgctgctaacttcacttcccaggttatcatcatgaaccaccctggtcagattggtaacggttacgccccggttcttgattgccacacctcccacattgccgtgaagttctctgagatcctcaccaagattgacaggcgttctggtaaggagattgagaaggagcccaagtttttgaagaatggtgatgctggtatggtgaagatgactccgaccaagcccatggttgttgagaccttctctgagtacccaccccttggacgtttcgctgttagggacatgaggcagactgttgcagtcggtgtcatcaagagcgttgacaagaaggacccaacgggagccaaggtgaccaaggctgccgtcaagaagggtgccaagtgaattactactactatcatcaaatctctatcatccgcagatgaatcaaagtgctattttagtttcctttctctagttttgttttctgtcgcttgtttgtgtaacagctttcgttcgtctccgtctgaactctcttgtcctaattgggttcttgatcggaggtggcggagcttcttatccctcaagcttcctgttttttgtttctcttttgcttttggattatgaactgttttgaatattctgttgttatgaaaatgatgacattcct

SEQ ID NO: 1183 - DNA, 1742 bp, Elaeis guineensis
tacgcggggctcttcgcttctctctcggttctcgcggccccaattccgttcttgagtgggggttctatcgctctgccgcggacgaccgagcaatcatgggtaaggaaaaggtgcacattaacattgtggttattggccatgtcgactctgggaagtcaaccactactggacaccttatctacaagcttggtggcattgacaagcgtgtgattgagagattcgaaaaggaagcagctgaaatgaacaagaggtcattcaagtatgcttgggttcttgacaagctgaaggctgagcgagagcgtggtatcacaattgatattgctctctggaagtttgagaccacaaagtactactgcaccgtcattgatgcccctgggcatcgcgacttcatcaagaacatgataacgggcacctctcaagctgattgtgcagtccttattatagactctacaactggtggttttgaggcaggtatctcaaaggatggacagacacgtgaacatgcattgcttgcctttactcttggtgtgaagcagatgatctgctgttgcaacaagatggacgccacaactccaaagtactcaaaggctaggtatgatgaaatcgtgaaggaagtttcttcttacctcaagaaggtgggttacaacccagagaagattccttttgttcccatctctggatttgagggtgacaatatgattgagaggtccaccaacctggagtggtacaagggtccacccttcttgaggccctcgacatgatccaggagcccaagaggccctcagacaagcctctccgcctgccacttcaggacgtgtacagattgtggcattggtactgtcccagtcggacgtgttgaaactggcattctcagacctggcatggtggttactttcggtcccagcggtctgacaactgaagtcaagtctgtggagatgcaccatgaggccctgcaggaggcccttcctggtgataatgttggtttcaatgtcaagaatgttgctgtcaaggatctcaagcgtggttttgtggcctctaactcgaaggatgatcctgcgaaggaggcagccagcttcacttctcaggtcattatcatgaatcatcctggtcagattggcaatggctatgctcctgtgcttgactgtcacacctcccacattgctgttaagtttgctgagatccttaccaagattgacagacggtctggtaaggaacttgagaaggaacccaaatttttgaagaatggtgatgctggttttgttaagatgattcccaccaagcccatggtcgttgagaccttctcagcgtacccaccacttggtcgtttcgctgtgagggacatgcgccagacggtggctgttggtgtcatcaagagtgttgagaagaaggacccaactggtgccaagatcaccaaggctgctgccaagaagaagtgaacaatgtcatcaagtgcctggtagtggtaagtattagatggctttgtagccagtttttagtgttagtagagggggcatcggtctttcggttttctgctgcccatttttctggatggaggcggctggattctcagctggaggcggtggttctttttgcaagttcttttccctgtttatttttccgtttgtagtttggattaaatccacaaacagcttaaaatcagaagttcctttttgttttttgttggattgacgtaaagtttggacatctgattaggtaaaattttgaagtaacagactaagttt

SEQ ID NO: 1184 - DNA, 1368 bp, Papaver somniferum
ctgtgctgcggagcttaacttttcggcgattcagttaatttctaagaattcaatatgggtaaagagaaggttcacatcaacattgtcgtcattggacatgtcgactctggtaaatcgaccaccactggtcacttgatctacaagcttggaggtattgacaagcgtgttattgaaagattcgagaaggaggctgctgagatgaacaagaggtcattcaagtacgcatgggttcttgacaagcttaaggctgaacgtgagcgtggtattaccattgatattgcactgtggaagtttgagaccaccaagtactactgcacagttattgatgctcctggacatcgtgactttatcaaaaacatgattactggtacttctcaggctgattgtgccgtcctcattatcgattccaccactggaggttttgaggctggtatctcaaaggatggtcagactcgtgagcatgctcttcttgctttcacccttggtgtcaagcagatgatctgttgttgtaacaagatggatgccaccacccccaagtactcaaaggctaggtacgatgaaattgtcaaggaggtctcatcttacttgaagaaggttggatacaacccagaaaaaattgcctttgttcctatctctggattcgagggagacaacatgattgaaaggtccaccaaccttgactggtacaagggaccaactctccttgaggctcttgacaacatctctgagccaaagagaccctcagacaagccccttcgtcttccccttcaagatgtttacaagattggaggtattggaactgtgccagttggacgtgttgaaactggagtcatcaagcctggtatggttgttaccttttggacccaccggtttgaccactgaagttaagtctgtggagatgcaccacgaagcccttctagaagctcttccaggagacaatgttgggttcaatgtcaagaatgttgcagtgaaggatctcaagcgtggtttcgtcgcctccaactccaaggatgaccctgccagggaagctgccaacttcacctcccaggtcatcatcatgaaccatcctggtcagatcggtaatggttatgctccagttcttgactgtcacacatctcacattgctgtgaagttcgctgagatccaaaccaagatcgataggcgatctggaaaggagcttgagaaggagcccaagttcttgaagaacggtgatgcgggtattattaagatgattccaaccaagcccatggttgtagagacctttgctcagtacccacctcttggacgttttgctgttagggacatgaggcagacagttgctgttggtgtcatcaagggagttgagaagaaggaccccaacagggagcc

SEQ ID NO: 1185 - DNA, 1731 bp, Vinca minor
aattctcactcatacaatctatctgcgagtgagatagctctcagtccttcagattcatcttcccaagttttttctgaaatttcagtatgggcaaggaaaagattcacatcagcattgtggtcattggacatgtcgactctggcaagtctactaccactggtcacttgatttacaagcttggtggtattgacaagcgtgtgattgaaaggttcgagaaggaggctgctgaaatgaacaagaggtcattcaagtacgcctgggtgcttgacaagctcaaggctgagcgtgagcgtggtattaccattgatattgccttgtggaagttcgagaccaccaagtactactgcacagtcattgatgcccctggacatcgtgatttcatcaagaacatgattactggtacctcacaggctgactgtgctgtccttatcattgactccaccactggtggtttgaagctggtatctctaaggatggtcagactcgtgagcacgccttacttgccttcactcttggtgtcaagcagatgatctgctgctgtaacaagatggatcgccaccaccccaagtactcgaaggccaggtacgaagaaatcgtcaaggaagtgtcatcttacctcaagaaggtcggatacaaccccgacaaaatccccttcgtccccatctcaggttttgagggagacaacatgattgagaggtcttccaaccttgactggtacaagggccctacccttcttgatgctcttgaccaaatctcagagcccaagaggccatcagacaagccactccgtctgcctcttcaggatgtttacaagattggtggtattggtaccgtccctgtgggtcgtgtggaaactggtgtcatcaagcctggtattcttgtgacctttgggccaactggtctgactactgaagttaagtctgttgagatgcaccatgaagctcttacggaggcacttcccggtgacaacgttgggttcaatgtcaagaatgttgccgttaaggatctaaagcgtggttatgttgcatccaactccaaggatgacccagccaagggggctgccagcttcacctcgcaggtcatcatcatgaatcaccctgggcagattggaaatgggtatgccccagtgctggactgccacacctctcacattgctgtcaagtttgctgagatcttgaccaagattgacagacgatctggtaaagagattgagaaggagcccaagttcttgaagaacggtgatgctggtatggttaagatgattcccaccaagcccatggttgttgaaacgtttgccgagtaccctccccttggtcgttttgctgtgagagacatgcgtcaaacagtggctgttggtgttatcaagaatgtggacaagaaggacccaactggtgccaaggtcaccaaggcagctgtcaagaaaggtgccaaatgaactgtgctgcgtactggtactgctggtgaagatgttttctattacaataaggcatttcgtgagaactggaacttttatagaactgctattgtagtttgttttttgtgtcatttgttgtgtcgtaggtgtctgccctgtaagttcagtatcctttctcagaattgggtactcgacaggcggtggcagatcctacaatcttagtctttgttatgttttgttggagtcttccttacatttgagttgctttggtttcccgagcgactcagatattgtgtgttttattattatgcggatgc

SEQ ID NO: 1186 - DNA, 1620 bp, Cicer arietinum
ctctttctctttctggggttttaactcagccttctccttcaagttattttgtgattttaagctcaaggactaatgggtaaagagaaagttcacatcaacattgtggtcattggccatgtggactctgggaagtcaaccaccacaggtcacttgatctacaagcttggaggtattgacaagcgtgtcattgagaggtttgagaaggaagctgctgagatgaacaagcgttcatttaagtatgcctgggttcttgacaagctcaaggctgagcgtgaaagaggtatcacaattgacattgctctgtggaagtttgagacaactaagtattactgcaccgtcattgatgcccccggacacagagatttcattaagaacatgattactggaacatcccaagctgattgtgctgtccttatcattgattccactactggtggttttgaagctggtatttctaaggacggtcagacccgtgaacatgctctccttgctttcactcttggtgtgaagcaaatgatttgctgctgtaacaagatggatgccactactcccaagtactctaaggctaggtatgatgaaattgtgaaggaagtttcatcctatttgaagaaggttggctacaacccagacaaaattccatttgttcccatctctggttttgagggagataacatgattgagcgctctacaaaccttgactggtacaagggtccaacccttcttgaggcccttgaccaaatcaatgagcctaagaggccatcagacaagcccctccgattaccacttcaggatgtctacaagattggaggaattggtactgtgcctgtggggcgtgtcgagactggtgtcttgaaacctggatttgtcgtgacttttgcgcccactggactgtcaactgaagtcaagtctgttgagatgcatcatgaagctctcactgaggcccttcctggtgacaatgttggatttaatgttaagaatgttgctgtcaaggatctcaagcgtggttacgttgcctcaaactccaaggatgaccccgccaaggaggctgctaactttacatcccaagttatcatcatgaatcaccctggccagattggtaatggttatgcccctgttcttgactgccacacctctcacatcgccgtcaagtttgctgagcttattaccaagattgacaggcgttctggtaaggagattgagaaggagccgaaattcctgaagaatggtgatgctggtcttgtgaagatgattccaaccaagcccatggtggttgagacttttgctgagtatcctcctcttgggcgttttgctgtcagagacatgcgtcaaactgtggctgtgggagtcatcaagagtgtggagaagaaggaacctagtggagttaagccaaagaagaagtgaaccgtgcaggatcatccatctagggtagtctattggcttgactacaatagatggtttgttcttagtagttcttatatttctcatttacttactttgtataagtctgcaccgtcgtctcgcaacatttgttctcaaaactgggttctagatcgacggtggcatgactatttggtatttctgtttatgtttatgctttgattattatgtttctgtgagaat

SEQ ID NO: 1187 - DNA, 1635 bp, Zostera marina
tatagtccaccaagtgagcttctcccatcgccgattttgttcttcttatctgttttctgattccgattgtttcgtccttcaaacgagtttctagccatgggtaaagagaagattcatatcagtattgtggttatcggtcatgtcgattctggtaaatcaacgacaaccggtcatcttatctacaagcttggaggtattgacaagcgtgtgatcgaaaggtttgagaaagaagcagctgaaatgaacaaacgttctttcaaatacgcatgggttcttgacaagctaaaggctgaacgtgaacgtggtatcaccattgatatcgctttgtggaagtttgagaccaccaagtattactgcactgttattgatgctccaggacacagagatttcattaagaatatgattaccgggacatctcaagctgattgtgctgttcttatcattgattctacaactggaggtttcgaagctggtatttccaaggatggtcagacccgtgagcacgctcttctggctttcaccctcggtgtgaagcaaatgatctgctgttgtaataagatggatgctacaactcccaagtactccaaggctcgttacgatgagattatcaaggaggtcagttcttacctcaagaaggttggatacaatcctgacaaaattccttttgttcccatctctggttttgagggagacaatatgattgaaagatcgaccaacctcgattggtacaagggtcctactcttcttgaggctcttgatcaaatctctgagccaaagaggccctcagacaagcctctccgtctaccccttcaggatgtctataagatcggaggtattggaactgtgcctgttgggcgtgttgagactggtattattaagccaggtatggtttgtacttttggtccatctgggttgaccactgaggttaagtccgtcgagatgcatcacgaatctatgctacaagctcttcccggagacaatgttgggttcaatgttaagaatgttgctgtcaaggatctaaagcgtgggtacgttgcctccgactctaagaacgatcctgcaaagggagctgccaattttacatcccaggttattatcatgaaccatcctggacagattggaaacggatatgccccagtgttggattgtcacacttctcacattgccgtcaagtttgctgagatcctcaccaagattgacagacggtctggaaaggagattgagaaggaacccaagtttttgaagaatggtgatgccggtttcgtaaagatgcttccaaccaaacccatggtcgttgagactttctctcagtatcctccccttggccgttttgctgttagggacatgaggcaaactgttgctgttggtgtcatcaagagtgtggaaaagaaggagcccaccagtgccaaggttaccaaatccgccattaagaagaagtgagattttaatgattatcatttgaagcttgctgctccatcgagacttttgttgcattttctagttttattatcatcgtcattattattttgtctgttttgtttattaccagtacttagaactaagctgcatttttaaattgttattgtttgctgttgtttagaacatctttacctgaaatgattccatgattttttc

SEQ ID NO: 1188 - DNA, 1868 bp, Cephalotaxus harringtonia
gtttctctggagttgttgcgtctggagttgcagcggctgttggagcttcggtataatttactaaagcaaacatgggaaaagagaagacccatatcaacattgtggtcattggacatgtcgactctggcaagtccaccaccactggtcatctgatctacaagcttggaggtattgacaagcgtgtgattgagcgttttgagaaggaagccgctgagatgaataaaaggtcattcaagtatgcctgggtgctggacaagctcaaggcagagcgagaacgtggtattactattgatattgctttgtggaagttcgaaaccacaaggtactactgcactgttattgatgcccccggacacagggatttcatcaagaacatgattactggtacatcacaggctgactgtgcggttctgattattgactccaccactggaggttttgaagctggtatctccaaagatggacagaccagagagcatgctcttctggccttcactttgggagtgaagcagatgatttgctgttgtaataagatggatgccaccacccctaaatactccaaggcccgttatgacgaaattgttaaggaggtttcttcatacctgaagaaggtgggttataatcctgataaaatcccttttgtacccatctccggatttgagggggataatatgattgagcgctcaagtaacctggactggtacaagggacccacactgctggatgccctggaccagatctccgagccaaaaaggcctacagataagcctcttcgtctgccccttcaggatgtttacaagattggtggtattgggactgtgccagtgggccgtgttgaaactggtgttctcaagcccggtatgttggtaaccttcggcccatctgggctgacaactgaagtgaagtctgttgagatgcaccacgaagccctccaggaagcactgccgggtgataatgttggctttaacgtgaaaaatgttgcagtcaaggatcttaagcgtggttatgttgcttctgactcaaagaacgaccctgccaaggaggctgccaacttcacttcccaggtgatcatcatgaaccaccctggacagattggtaatgggtatgcccctgtgctggactgccacacctgccacattgcggtcaagtttgcagaaatattgaccaaggtggacaggcggtctggtaaagagctggagaaggagcccaagtttatcaagaatggagatgctggatttgtgaagatggtacccaccaaacccatggtggtggaaaccttttcagattaccctcccctggggcgttttgctgtgagggacatgcgacagactgttgctgtgggtgttatcaagagtgttgagaagaaggatcccaccggtgccaaggtcaccaaggctgctgctaagaagaaatgaatggtgcttgagcgtgcaatggaggggtcatggcatggttgtcatatgtgcctgtctctatcctctgcacgggatatggtagtgaggtgttctgtagctcggcgaatgcaaacttgggttcttgatagacggtggcataataatacacaattaaaatgtttgctgttcttaggttagtactatatttttgatgtttttaggttagtagtatatttttggaagggaagagggattatgtttacgactttttgagtcactgccgctgcaaattagaatttgcagcatgtttgatgtttgtgattttgttgaagacttttgtgtgtggtagttatttgataccgtattttatttaaaatgtcaatgccttgcttttcagttttgtctcattttacttccagtttcatctcccaaaactatttcgaggcatgatttataacaaacctagtataaaat

SEQ ID NO: 1189 - DNA, 1681 bp, Euonymus alatus
aggagaagactcacatcaacattgtggtcattggccacgtcgactctggaaagtcaacaaccactggacacttgatttataagcttggtggcattgacaagcgtgtcattgagaggtttgagaaggaagctgctgagatgaacaagagatcattcaagtatgcctgggtgttggacaaactcaaggctgagcgtgaacgtggtattaccattgatattgctctgtggaagtttgagacaacaaagtactactgcactgtcattgatgctcccggacatcgtgactttatcaagaatatgattactggtacctcacaggctgactgtgctgtcctcatcattgactccaccactggtggttttgaagctggtatttccaaggatgggcagacccgtgagcatgcgttgcttgcttttacccttggtgtgaagcaaatgatttgttgttgcaacaagatggacgccactacccccaagtactcgaaggctaggtatgaggaaattgtgaaggaagtttcttcctacttgaagaaggttggttacaaccctgacaagatcccatttgttcctatctctggttttgagggtgacaacatgatcgagagatctaccaaccttgactggtacaagggcccaaccctccttgatgctcttgaccagatctcagaacccaagaggccctcagacaagcccctccgtctcccccttcaggatgtttacaagattggtggtattggaactgtcccagtcggacgtgttgagactggtgtcctgaagcctggtacagttgtgacctttggtcctactggactgaccactgaagttaagtctgttgagatgcaccacgaggctctccaggaggccctgccaggtgacaatgttggcttcaatgtcaagaacgttgctgtgaaggatctgaagcgtggttttgttgcttccgactctaaaaatgatcctgctaaggaggctgccagcttcacctctcaggtcattatcatgaaccaccctgggcagattggaaatggctatgctccggtcctcgattgtcacacatctcatattgctgttaagtttgctgagatcttgactaagattgacaggcgatctggtaaggagcttgagaaggagccaaagtttttgaagaatggtgatgctggaatggtaaagatgattccaaccaagcctatggtagtggagaccttctctgcataccctcctcttggtcgtttcgctgttcgggacatgcgccagaccgtggctgtgggagtcataaagagtgttgataagaaggaagcatctgctgccaaggtcaccaagtctgctgctaagaagaaatgaatcacgggagttcgcagtggattgcattcagctgaagtctactttcatatgaataattgtctttcatacacattttatgttggtactgtcatctttggtttattttgttttatatgttatagttttgtgccgtcgttgggttgccagtctgagaaccgggtacttgacaggcggtggcggcacagtttatagcatagagccctcttgtttttggaggttttagtgtcaattttctgtcgagattactgtgtctgagggttggttttctacttttcttccaaacggctcagaagttttgtcgttgtggttatcaagtaatgcaaattgtcgtatctttagtttac

SEQ ID NO: 1190 - DNA, 2256 bp, Gnetum gnemon
tgctgttgcagacgctctgtgttccgtgcgagggaagctcggatctatcgctttggatttctctctgcgtttgattttcgcgttaacagggagccatgggtaaggagaagacgcacatcaacattgtggtcattggccacgtcgattctggaaaatcgacaaccactggtcacttgatctacaagcttggaggtattgacaagcgtgtgatcgagcgtttcgagaaggaagccgctgaaatgaacaagaggtcattcaagtatgcttgggtgcttgacaagctcaaggctgagcgtgaacgtggtattaccatcgacattgctctttggaaattcgaaaccaacaagtactactgcaccgttattgatgctcctggacaccgtgactttattaagaacatgattaccggaacctctcaggctgactgtgctgttctgatcattgattctaccactggaggtttcgaggctggtatttccaaggatgggcagaccagagagcacgctttgttggcttttaccctgggtgttaggcagatgatttgctgttgcaacaagatggatgccactacacccaagtattccaaggcccgttacgatgaaattgttaaggaagtctcgtcctacctgaagaaggttggatacaaccctgacaaaattcccttcgttcccatctctggtttcgaaggtgacaacatgattgagagatccacgaacctggactggtacaaggggccaactctccttgaagctctggatcaggttcacgaaccgaagaggccctcggacaagccactgcgtctgccacttcaggatgtttacaagattggaggcattggaactgtcccggtcggtcgtgttgaaactggtattctgaagcctggtgcggtggtgacctttggaccaacgggactgacaactgaagttaagtctgttgagatgcaccatgaagctctgcaggaggccctgccaggagacaacgttggtttcaacgttaagaacgttgctgttaaggatctgaagcgtggttttgttgcctctgactccaagaacgaccctgcaaaggaagccgcaagctttacatctcaggtcattatcatgaaccaccctggccagatcagcaatggttacgcccctgtgctggactgccacacttcccacattgctgtgaagttcgctgaaattacgaccaaggtggacaggcgttctggtaaggagctcgagaaggagcccaagttcctgaagaatggtgacgcaggttttatcaagatgattccctccaagcccatggtggtggagaccttctctgagtatcctcctctgggtcgttttgctgtgagggacatgcgtcagaccgtggctgtcggagttattaaggctgttgagaagaaggagcccactggagccaaggttaccaaggctgctgccaagaaaaaatgaaagttagtggaggatgagggatttggcatctcggtgcacatctctcatagatgttcccgtgctctgtttgtccggtgtttggtttctaggcgtatgcaaacgtgggtccttgatagacggtggcatgcgacatattttgttgtttggaactcgctcagtgtttggggttagggatttcgttcatgtcgagtctttccgtcgtaagtctctgggaagggttgtttttataatttcatcagaaacatactattttggtaagttctgaggtgtcggatttgcaagttcattgcgcaattcgaagaatattggtctttcatttactatgcataacaatgagattcagtatacgtttttcaatgtttacggggttttgtttcacgatgcatgtgtttgaggatcggagaattcgaaaattgagatgatgctgctgcacagatctgaaataggtacatctgtgctcgttcccatcttctgcgatgttgaacccacggatgttctggacatttaagatgagaggagctttcgggtagggttttcaagttgcaacacctgcgtacaaggtacaaatggctaagttttcgcttatacacggatgttcccaagacgcatctttgttctcataatcaaatacaaaaagagtaagttagaagatagaaatggaaaggtggaaagatgccctacgcatgattgccaacgtgactggtgtctacggcaggaggtgcagctgttatcatttatcaaaagtatgagattaaatacttcaaacacgcatggtggattgaattttcatcaagcatcagctatgaagatttcaggt

SEQ ID NO: 1191 - DNA, 1755 bp, Elaeis guineensis
cgacccatctatcagaggagtggaagcggctgccgatcccctctacctctctcccttgccacactcgaattcccttggatcgtagattcaccagaaagtagcaatgggaaaggcgaaggttcacattaacattgtgatcattggccatgtcgattctgggaaatcaactacaactggacaccttatctacaagcttggtggtattgacaagcgtgtgatcgagaggtttgagaaagaagctgctgagatgaacaaaaggtctttcaagtatgcctgggtgcttgacaagttgaaagccgagcgtgagcgtggtatcaccatcgatattgctctctggaagttcgagaccacaaaatactactgcactgtgattgatgctcctggccatcgtgatttcattaagaacatgataacgggaacttctcaggctgactgtgctgtcctcattattgattccaccactggtggttttgaagcaggaatttcaaaggatggccagactcgtgagcatgctcttcttgccttcactcttggagtcaggcagatgatctgttgctgtaacaagatggatgccacgacacccaaatactcaaaagcaaggtatgatgagattgtgaaggaggtctcgtcttatctgaagaaggttggttacaatcccgataagatccccttcgtgccaatctctggttttgaaggagataacatgatcgagaggtccaccaaccttgactggtacaagggccccactctcctggaagcacttgatatgatccaggagcccaagcgtccatcagacaagcccctccgtcttccgctgcaggatgtctacaagattggaggcattggcactgtccctgttggtcgtgtggagaccggaatccttaggcctggtatggttgtgacttttggaccctcaggactgacaactgaagtaaaatctgtggagatgcatcatgaggctctccaggaggctcttcctggagacaatgttggcttcaacgttaagaatgttgctgtcaaggatctgaagcgtggttatgttgcttcaaactccaaggatgacccagcaaaggaggctgctagcttcacctctcaggtcattatcatgaaccacccaggccagattggtaatggttatgccccagttttagactgtcacacttctcacattgctgtcaagttttcggagcttttgagcaagattgatcgtcggtctggtaaggagctggaaaaggagcccaaattcttgaagaatggagatgcagggtttgttaagatgattccgaccaagccaatggtggtggagaccttctctgagtactctcctctgggtaggtttgctgtcagagacatgaggcagacggtcgctgtgggtgtcatcaagagtgtggagaaaaaggatcctactggagccaagataaccaaagcggcacaaaagaagaaatgaaccgaggagttctccgaattgttgtgggttggagtccgtagcagttgtagcgtggtatgcccttgccgtcacatttccacagtatctggagtctggatgcaaaattgggtgcttgaccggcggtggcagtgtttaaggtcaattttcttctactatttaagttaaaactgtcgagggtgttaattttttctttttaaatgctactttgagtttgtgttttgcgtgtagggctgggatgtttgctgccatttgacgcaccctttgttattttggatgctttttagtattaaaataaagtagtattttgg

SEQ ID NO: 1192 - DNA, 1845 bp, Sciadopitys verticillata
gggcattgaggagggtctcttattgcgagcgctcgttcgtttcttcctatttgcgcctctgcctctgtagaaagatttttgctggtgttgctgcagctgagggatcagacgcgtttctaacaagttctaggtaaaatcatgggaaaagagaagacccatatcaatattgtggtcattggccatgttgactctggaaagtcaactaccactggccatttgatctacaagttgggtggtattgacaagcgtgtcattgaacgttttgagaaagaagctgctgagatgaacaagaggtcattcaagtatgcttgggtccttgacaagctgaaggctgagcgtgaacgtggtattaccattgatattgcactatggaagtttgagactaccagatactactgcactgtgattgatgctcctggtcaccgtgatttcattaagaacatgattactggtacctctcaggctgattgtgcagtgctcatcattgattcaacaactggaggttttgaggctggtatttccaaggatggtcaaacccgagagcatgctttgctggcatttacattgggagtgaggcaaatgatttgctgctgtaacaagatggatgcaactacccctaagtactcaaaggcccgatatgaagaaattgtcaaggaagtttcttcatacatgaagaaggttggatataaccctgataaaattccatttgtgcctatctctggttttgagggtgacaatatgattgagcgatcaacaaatcttgattggtacaagggtccaacactgttggatgcccttgaccagattagtgagcccaagcgtcctacagacaagcctcttaggttgccacttcaggatgtttacaagattggcggtattggaactgtgcctgtgggacgagttgaaactggagttctgaagcctggcatgcttgtaacctttggtccaactgggctgactactgaagttaagtctgttgagatgcaccatgaagctcttctagaggcattgccaggtgataatgtgggattcaatgtgaagaatgtagctgtgaaggatctcaagagaggatatgtggcatctgattctaagaatgacccagctaaggaggctgcaaacttcacatctcaggtgattatcatgaaccatccaggacagattggaaatggttatgccccggtgctggattgccacacatgccacattgctgtgaagtttgctgagatcctgaccaaggttgacaggcgatctggtaaggagctggagaaggaaccaaaattcattaagaacggagatgctggatttgttaagatggttccaaccaagcccatggttgtggaaacgttttctgaatatcctccattgggtcgttttgctgtgagggacatgcgacagactgttgctgtcggagtcatcaaggctgttgagaagaaggaaccttctggtgctaaggtcaccaaggctgctgctaagaagaagtgaaagttcatccggattgtgcagtggttgaagcatgcaagcagcattttgcatgcttgtatactcaatttttgcacatttagtatggtattaggaattttattagcacgtcatatgcaaaactgggttcttgatagacggtggcatagcttatttattttctgttaaaacattttagtgatttaaggttgagatttctcagttgcggggaaatcttgatttgtctgcactgctaggaaatctatgcagtctgagctgaggaggattttaataattttagtttacactgatttttcagacaaactcttttgtcatactactgatattccagattttgttgtatgttacctatgattctgaaattag

SEQ ID NO: 1193 - DNA, 1841 bp, Picea glauca
ctcttcatcttgtgcgagtctctcttctccctgcgctgctgcgaagctgttcttgggttctctgattctccacactcagctcggcgtttttgttagaggctttaattcaccatgggaaaggaaaaaacccatatcaacattgtggtcattggccatgtcgactccggcaagtcaacaaccactgggcatttgatctacaagcttggaggaattgacaagcgtgtgattgaacgttttgagaaagaagctgctgagatgaacaagagatcattcaagtatgcttgggtgcttgacaagctcaaggctgaacgtgaacgtggtatcacaattgatattgcattgtggaagtttgagacaaacaaatactactgtactgtgattgatgcccctggccatcgtgatttcatcaagaacatgattactggaacctctcaggctgattgtgcagttttgatcattgattctacaactggaggttttgaagctggtatctcgaaggacggtcagactagagaacatgccctattggcgttcaccttgggagtgaagcaaatgatttgctgctgtaacaagatggatgccactactcccaagtactcaaaggctcgttacgatgaaattgtcaaggaagtatcttcttatttgaagagggttggatacaacccagacaagattccttttgtgcctatctctggttttgagggtgacaacatgattgagcgctcgaccaaccttgattggtacaagggcccaacactcttggaagcccttgaccaggtttcggagcctaagcgtcctacagacaagcctctgaggttgccccttcaggatgtttacaaaattggtggtattgggactgtgcctgttggtcgggtggaaactggaatcataaagccaggtacgattgttacctttggtcccactgggctgaccactgaagttaagtctgttgagatgcatcatgaagctctgcaggaggcatatcctggtgacaatgtgggattcaacgttaagaatgttgctgttaaggatctcaaacgtggttatgtggcatctgactccaagaacgatccagccaaggaagctgccaactttaccgctcaagttattataatgaatcatccaggacagattggaaatggttatgcccctgtgttggattgccacacttgccacattgccgtcaagttttctgagatcatgaccaaggttgacaggcgttctggcaaggaactggagaaggaacccaagtttcttaagaatggagatgccgggtttgttaagatgataccaaccaaacccatggttgtggaaaccttcgctgagtatcctccattgggtcgttttgctgtgagggacatgcgtcagacggttgctgtaggagtcatcaaagctgttgaaaagaaggaccctactggtgcaaaggtcaccaaggcagctgccaaaaagaagtgaatgttcaagcaaagtgatcgggaatggagaaatgcttgctgcattttgtgtgcttgcatgcttctctattttcctgatggtatgttagtagagttagattatcaaatacagaattgggtgcttgatcggcggtggcagagtttacattattttctagtaaatactctttagtggtttagggcaaattgattgagatttcgtagttgtggggaaatcatcagtttgtctgcactgctaggaaatctatgcagttggagtgaggaagggtattaataatttctgttactctgttttattttaaagcttgtattgccttacatacatggcaattttttccatattgagaagacttggaatttatgttaaagcacagttttgagaaaaaa

SEQ ID NO: 1194 - DNA, 1630 bp, Tripterygium wilfordii
actcacattaacatcgtggtcattggccatgtcgattctggtaagtcaaccaccacggggcacttgatttacaagcttggtggaattgacaagcgtgttattgagaggtttgagaaggaagctgctgagatgaacaagaggtcattcaagtatgcctgggtgttggacaaactcaaggctgagcgcgaacgtggtatcaccattgatattgctctgtggaagtttgagaccacaaagtactactgcactgtcattgatgctcctggacatcgtgactttattaagaatatgatcactggtacctcacaggctgactgtgctgtcctcattattgactcaaccactggtggttttgaagctggtatttccaaggatggccagacccgtgagcatgcattgcttgctttcacccttggtgtgaaacaaatgatctgttgctgcaacaagatggatgccacaacccccaaatactcgaaggctaggtatgatgaaattgtgaaggaagtttcttcctacttgaagaaggttggttacaaccctgacaagataccatttgttcccatctctggttttgagggtgataacatgatcgagagatctaccaaccttgactggtacaagggcccaaccctccttgatgctcttgacatgatcaatgaacccaagaggccctcagacaagcccctccgtcttcctcttcaggatgtttacaagattggtggtattggaactgtcccagttggacgtgttgagactggtgtcgtgaagcctggtatggttgtgacctttggtcctactggactcacaactgaagttaagtctgttgagatgcaccatgaggctctgctggaggccttgcctggtgacaatgttggtttcaatgtcaagaacgttgctgtgaaggatctgaagcgtggttttgttgcttctgactccaaaaatgatcctgctaagggggctgccagcttcacctctcaggtcatcatcatgaaccaccctgggcagattggaaatggctatgccccggtccttgattgccacacatcccacattgctgttaagtttgccgagatcttgactaagattgacaggcgatccggtaaggagcttgagaaggagccaaaatttttgaagaatggtgatgcaggaatggtgaagatgattccaaccaagcctatggtggtggagaccttctccgagtaccctcctcttggtcgttttgctgtgagggacatgcgccagactgtggccgtgggtgtcatcaagagtgttgataagaaggatgcatctggtgccaaggtcaccaagtctgctgccaagaagaagtgagatgtcttttagttgatttctattacctagtgtagtggttatatttgcatttagtctgcgattttgtaacctttttcgtggaatttttatcatttgtggacatcttgggtctttatttcttggttttgttatcagtcattagacttgtacggtcgttcatgaacatgcagagtttcgtcgtggtaaaatttatgttttcaattaccctcttggtttcttgttttgaattgatttaattctgtcccatttttttttttttatatagaattcgttgtttttgtatatggctgacgaccagatt

SEQ ID NO: 1195 - DNA, 1705 bp, Zostera marina
gccgattttgttcttcttatctgttttctgattccgattgtttcgtccttcaaacgagtttctagccatgggtaaagagaagattcatatcagtattgtggttatcggtcatgtcgattctggtaaatcaacgacaaccggtcatcttatctacaagcttggaggtattgacaagcgtgtgatcgaaaggtttgagaaagaagcagctgaaatgaacaaacgttctttcaaatacgcatgggttcttgacaagctaaaggctgaacgtgaacgtggtatcaccattgatatcgctttgtggaagtttgagaccaccaagtattactgcactgttattgatgctccaggacacagagatttcattaagaatatgattaccgggacatctcaagctgattgtgctgttcttatcattgattctacaactggaggtttcgaagctggtatttccaaggatggtcagacccgtgagcacgctcttctggctttcaccctcggtgtgaagcaaatgatctgctgttgtaataagatggatgctacaactcccaagtactccaaggctcgttacgatgagattatcaaggaggtcagttcttacctcaagaaggttggatacaatcctgacaaaattccttttgttcccatctctggttttgagggagacaatatgattgaaagatcgaccaacctcgattggtacaagggtcctactcttcttgaggctcttgatcaaatctctgagccaaagaggccctcagacaagcctctccgtctaccccttcaggatgtctataagatcggaggtattggaactgtgcctgttgggcgtgttgagactggtattattaagccaggtatggtttgtacttttggtccatctgggttgaccactgaggttaagtccgtcgagatgcatcacgaatctatgctacaagctcttcccggagacaatgttgggttcaatgttaagaatgttgctgtcaaggatctaaagcgtgggtacgttgcctccgactctaagaacgatcctgcaaagggagctgccaattttacatcccaggttattatcatgaaccatcctggacagattggaaacggatatgccccagtgttggattgtcacacttctcacattgccgtcaagtttgctgagatcctcaccaagattgacagacggtctggaaaggagattgagaaggaacccaagtttttgaagaatggtgatgccggtttcgtaaagatgcttccaaccaaacccatggtcgttgagactttctctcagtatcctccccttggccgttttgctgttagggacatgaggcaaactgttgctgttggtgtcatcaagagtgtggaaaagaaggagcccaccagtgccaaggttaccaaatccgccattaagaagaagtgagattttaatgattatcatttgaagcttgctgctccatcgagacttttgttgcattttctagttttattatcatcgtcattattattttgtctgttttgttttattaccagtacttagaactaagctgcatttttaaattgttattgtttgctgttgtttagaacatctttacctgaaatgattccatgattttttcatggtatttattttaattttctttcttctcttgatttttttgatatttaaaaacttcttttgtcatattaattttttttttaatgttatcttattgaa

SEQ ID NO: 1196 - DNA, 1408 bp, Eucalyptus grandis
ttaaaatgatagagctccgcaatcctgcaatcggcagcagcctcacttcttcttgacagcggactttgtgaccttggcaccggttgggtccttcttctccacactcttgatgacaccgacggccacggtctgacgcatgtccctgacagcaaaacgaccaagaggagggtactccgagaaagtctcgacgaccataggcttggtggggatcatcttcaccattccagcatcaccgttcttcaagaacttgggctccttctcaagctccttaccagaccgtctgtcaatcttggtcagcaactcagaaaacttcacagcaatgtgggaagtgtgacaatcaaggacaggagcatagccgttgccaatctgcccggggtggttcatgatgatgacctgggaagcgaagctagcagcctccctggcaggatcatccttggagttggaagcaacaaaaccacgcttgagatccttcacggcaacgttcttgacattgaacccaacattgtcaccagggagggcctcctggagagcctcgtgatgcatctcaacagacttaacttcagtggtcaatccagtgggtccaaaagtgacaaccatacccggcttcaagacaccagtctcaacacgaccgacagggacagttccaataccaccaatcttgtacacatcctgaagtgggagacggagaggcttgtctgtaggcctctttggctccgagatctggtcgagagcgtcgaggagggtggggcccttgtaccagtcaaggttggtggacctctcaatcatgttgtcaccctcaaaaccagagatggggacaaaaggaatcttgtcaggattgtacccaactttcttcaagtatgaagagacttccttcacaatttcatcataacgggccttggagtacttgggtgacatataaataaaatgtaccttgttgcagcagcaaatcatctgcttcacaccaagagtgaaggcaagaagagcatgctcacgggtctggccatccttggaaataccagcctcaaaaccaccagtggtggagtcgatgatgaggacagcacagtcagcctgggaagttccagtaatcatgttcttgatgaagtcacgatgtccaggagcatcaatgactgtgcagtaatacttggtggtctcaaacttccacaaggcaatatcaatggtgataccacgctcacgctccgccttgagcttgtcaaggacccaggcatacttgaatgacctcttgttcatttcagctgcctccttctcgaacctctcaatgacacgcttgtcaatacctcctagcttgtagatcaagtgaccagttgtagtcgatttcccagagtcgacatggccaatgaccacaatgttgatgtgaaccttctccttacccatgatgagatatctgaaa

SEQ ID NO: 1197 - DNA, 2381 bp, Eutrema halophilum
cctccttaatcctttcccaattcaagatcctgtcttttctccctttctttagatttctttaaaacaagatctcaaattctgaatttacagagagaagaatgctctcgacaactctaagtggaaactatggcttccctctctgcatctctgggatcgctcagaaattctctgtctccaaagaaatggcagatcatgacaagagaaggaaggggatgaagaagagaatgagatcagaaggcaaagatgagtcgaggagtcacggtgaagaagaaatgggtgtggagagatttgatgagctatggcttcgagagaacgaagatgttagagatctagttgctttattccaagatctagggttctggagcgtttcttctcatacagctaaagctgcttagtgttacagaaatccaaacctttttttaagatctcagtgtgttatgtttcttgtaaaactgcagatcaacaatttcttgtagctggaaaaatcgttaaaaaaatattcctggttgttttcacagtcgtttgtttacacgtttatttgtcgttggtgtgatgatttgctgcctcttttggccttatcctcttcttttggtttttagttctgagcttatttgttggataactgctccataagctttgatttgttgtattaaaggtttctaacagttggactaccatgtaactcttcttcttacttcaaaacacaacagatctaaagagcatgatatggatgcgtttgaactgtgagcagtaaaaacgcaccttaatggacattcaatgaaaataaattttgtagcacaacgaaatactaacaaactttaggcaaaattatccaaaaaactgcataattgaaaaccataatagtctcagcgatatccaaaaaggaggtagagagaagagagtcgcagaaaataagagagaaaaaaaaagaaaaggctcaaacgccatcaaagttttttttaaaagcagagaaaaccaaaagccgagagaagactcatcatttggctcccttcttgactgcagccttggtgaccttggcaccggttgggtccttcttgtcgacgctcttgataacaccaacagccacggtttgcctcatgtccctgacagcgaaacgtcccaatggtggatactcggagaaagtctcaacaaccatgggcttggtcggagtcatcttaaccataccagcatcaccattcttcaaaaacttgggctccttctcgagctccttaccagaacgcctgtcaatcttggtcaagatctcagagaacttgactgcaatgtgagaggtgtggcaatcgagcactggggcgtaaccgttaccgatctgaccagggtggttcatgatgatgacctgggaagtgaagttagcagcacccttggcaggatcatccttggagttggatgcaacgtacccacgcttaagatccttgacagcaacattcttaacattgaacccaacattgtcacctggaagcgcctcaaggagggactcgtggtgcatctcaacggacttaacctcagtggtcaaacctgaaggagcaaaagtcacaaccataccgggcttgagcataccagtctccacacgacccactggcaccgttccaataccaccgatcttgtagacatcctgaagtgggagacggaggggtttgtctgatggcctctttggctcgttgatctggtcaagagcctcaaggagagttggtcccttgtaccagtcaaggttcgtggacctctcaatcatgttgtctccctcgaacccagagatggggacgaatgggattttgtcagggttgtatccaaccttcttcaggtaggaagacacctccttgacaatttcctcgtacctacccttggagtatttgggggaaattgaaacgttagctcaccttgttacagcagcaaatcatctgcttgacaccaagggtgaaagcaagaagagcgtgctcacgggtctgaccatccttagagataccagcttcgaaaccaccagtggtggagtcaatgatcaagacggcacaatcagcctgggaggtaccagtaatcatgttcttgatgaaatcacgatgtccaggtgcgtcaatgactgtgcagtagtacttggtggtctcgaacttccagagagcaatatcgatggtgataccacgctcacgctcggccttaagtttgtccaacacccatgcgtacttgaatgacctcttgttcatttcagcagcttccttctcgaacctctcgatcacacgcttgtcaataccaccgagcttgtagatcaagtgaccagtagtggtcgactttccggagtcgacatggccaatgaccacgatgttgatgtgaaacttctctttacccatagctgcatatcaacaaacgatatcaaa

SEQ ID NO: 1198 - DNA, 1392 bp, Aquilegia formosa
cacaatctctctcagttcacttcttttttgcagcggcctttgtaaccttggcaccagtgggctccttcttctccacagctttgataacaccaacagcaacagtctgcctcatgtcacgaacagcaaaacgaccaagaggaggatactcagagaatgtctccaccaccattggctttgtagggatcatcttaacatatccagcatcaccattcttcaaaaacttaggctctttctcaagttcttttccagaacgcctatcaatcttggttgtaatctctgcgaactttactgcaatgtgagaagtgtgacaatcaaggacaggtgcatatccattaccaatctggcctgggtgattcatgatgataacttgcgaggtgaagttagcagcctccttagcagggtcatcctttgaattagaagcaacataaccacgcttcagatccttaacagcaacattcttcacattaaagccaacattgtcaccaggcagagcctctgtaagagcctcatgatgcatctccacagacttgacttcagtagtaagaccagatggaccaaaagtaaccagaattcctggcttgatgactccagtctcaacacgaccaacaggtacagttccaataccaccaatcttgtaaacatcctgcagaggaagacgaaggggcttgtcggagggacgcttgggctcagaaacattatccaaggcatcaagaagggttgggcccttgtaccaatcaaggttggtagatctttcaatcatattgtcaccctcaaagccagaaattgggacaaaggggatcttgtcagggttgtagccaactttcttcaagtatgaagagacttccttcacaatttcatcatacctagctttcgagtactttgatcaataagataccttgttacaacagcagatcatctgcttcactcccagtgtgaatgcaagcaatgcatgctcacgagtctgcccatccttggagattccagcttcaaatccaccagtagttgagtcaatgatcaagacagcacagtcagcctgagaagttccagtgatcatgttcttaataaagtcacgatgaccaggagcatcaatgactgtgcagtagtacttggtagtctcaaacttccacaaggcaatgtctatagtgataccacgttcacgctcggccttaagtttgtcaagcacccaagcatacttgaaggatcgcttgttcatttcagcggcttccttttcaaaacgttctatcacacgcttgtcaataccaccaagcttgtagatcaaatgaccagttgttgttgatttcccagaatcaacatgaccaataactacaatgttaatgtgaaccttctctttacccatagctgcacttgtacaaactgcaaaaaaaaattgga

SEQ ID NO: 1199 - DNA, 1546 bp, Brassica rapa
agctatgggtaaagagaagtttcacatcaacatcgtggtcattggccatgtcgactctgggaaatcgaccaccactggtcacttgatctacaagcttggtggtattgacaagcgtgtcattgagaggttcgagaaggaagctgctgagatgaacaagaggtctttcaagtacgcgtgggtgttggacaaacttaaggccgagcgtgagcgtggtatcaccattgatattgctctctggaagttcgagaccaccaagtactactgcacggtcattgatgcccctggtcatcgtgatttcatcaagaacatgattactggtacctcccaggctgattgtgctgtcctcatcattgactccaccactggtggttttgaagctggtatctccaaggatggtcagacccgtgagcatgctcttcttgctttcacccttggtgtcaagcaaatgatttgctgctgtaacaaggtgagctaactttacccccaagtactccaaggctaggtacgatgagatcatcaaggaggtgtcttcctacttgaagaaggtcgggtacaaccctgacaaaatcccattcgtccccatctctggattcgagggtgacaacatgattgagaggtccaccaaccttgactggtacaagggaccaactctccttgaggctcttgaccagatcaacgagccaaagaggccctcagacaagcccctccgtctcccacttcaggatgtctacaagatcggtggtattggaacggtgccagtgggtcgtgtggagactggtatgctcaagcccggtatggttgtgacattcgctccttcagggttaaccactgaggtcaagtccgttgagatgcaccacgagtctcttgtggaggcacttccaggtgacaacgttgggttcaatgttaagaatgttgctgtgaaggatcttaagcgtgggtatgttgcatctaactccaaggatgacccagctaagggagctgccaacttcacatcccaggtcataatcatgaaccaccctggtcagatcggtaacggatacgccccagtcctcgattgccacacgtcccacattgcagtcaagttctctgagatcttgaccaagattgacaggcgatctggtaaggagatcgagaaggagcccaagtttttgaagaatggtgatgctggtatggttaagatgactccaaccaagcccatggttgtcgagactttctcagagtacccaccgttgggacgtttcgctgtcagggacatgaggcagaccgttgctgttggtgtcatcaagagtgttgacaagaaggacccaaccggtgccaaggtgaccaaggccgcagtgaagaagggagccaaatgatgagacttctctcgtctttgtgttttctttgcttttaaaaaaactttgatggcgtttgagcctttgttcttttattttctgtgactttctcatctctacctcctttttttttcatatctctgagacttatgggttacaattatgcagtttctggataattttgcgtagtgtgttttagtgttttgttttgc

SEQ ID NO: 1200 - DNA, 1532 bp, Brassica rapa
agcattaggcaaaattatccagaaactgcataactaaaaccataagtaacagagatataaaaaaaaaagtagagagatgagtgtagtaaacaaaaagagcctcaaaacacatcaaagttttttttaagcaaagtgaacaaagcatgagagaagtctcatcatttggcacccttcttgactgcagccttggtgaccttggcaccggttgggtccttcttgtcaacactcttgatgacaccaacagccacggtctgcctcatgtccctaacagcgaaacgtcccaaaggtgggtactctgagaaagtctcaacaaccatgggcttggtcggagtcatcttcaccataccggcatcaccattcttcaaaaacttgggctccttctcgatctccttaccagaacgtctgtcaatcttggtgaggatctcagagaacttgactgcaatgtgggaagtgtggcaatcaagcactggggcgtaaccgttaccgatctgaccagggtggttcatgatgatgacttgggaagtgaagttagcagctcccttggcagggtcatccttggagttggatgcaacatacccacgcttaagatccttgacggcaacattcttgacattgaatccgacattgtcaccaggaagcgcttccacaagagactcgtggtgcatctcaacggacttgacctcagtggttaaccctgaaggagcgaatgtcacaaccataccgggcttgagcataccagtctccacacgacccactggcaccgttccaataccaccgatcttatagacatcctgaagtggtagacgcaggggcttgtctgaaggcctctttggctcgttgatctggtcaagagcctcaaggagagttggtcccttgtaccagtcaaggttggtggacctctcaatcatgttgtcaccctcgaagccagagatggggacgaatgggattttgtcagggttgtacccgaccttcttcaagtaggaagacacctccttgatgatctcatcgtacctagccttggagtacttgggggttaagttagctaaccttgttacagcagcaaatcatttgcttgacaccaagggtgaaggcaagaagagcatgctcacgggtctgaccatccttggagataccagcctcaaaacctccggtggtagagtcaatgataagaacagcacaatcagcctgggaggtaccagtaatcatgttcttgatgaaatcacgatgtccaggggcatcaatgacagtgcagtagtacttggtggtctcgaacttccagagagcaatatcaatggtgataccacgctcacgctcagccttaagtttgtccaacacccacgcgtacttgaaggacctcttgttcatctcagcagcctccttctcgaacctctcgatgacacgcttgtcaataccaccaagcttgtagatcaagtgaccagttgtagtcgatttgccagagtcgacatggccaatgaccacaatgttgatgtgaaacttctctttacccatagctgcaaatcaaagaagtcaaa

SEQ ID NO: 1201 - DNA, 1586 bp, Brassica rapa
tgcagatttttacttaagccatgggtaaagagaagtttcacatcaacattgtggtcattggtcatgtcgactctggaaagtcaaccaccactggtcatttgatctacaagcttggtggtattgacaagcgtgtgattgagagattcgagaaggaggctgctgagatgaacaagaggtctttcaagtatgcgtgggtgttggacaaacttaaggctgagcgtgagcgtggtatcaccattgacattgctctttggaagtttgagaccaccaagtactactgcacagtcattgatgctcctggacatcgtgatttcatcaagaacatgattactggtacctcccaggctgattgtgctgtcctcatcattgactccaccaccggtgggtttgaagctggtatctccaaggatggtcagacccgtgagcatgctcttcttgctttcacccttggtgtcaagcagatgatttgctgctgtaacaaggtgaactaactaccctaagtactccaaggctaggtacgatgagattatcaaggaggtgtcttcatacctgaagaaggttggatacaaccctgacaaaatcccattcgtccccatctctgggttcgaaggtgacaacatgattgagaggtccaccaaccttgactggtacaagggaccaactctccttgaagcacttgaccagatcaacgagcccaagaggccatcagacaagcccctccgtctaccacttcaggacgtctacaagatcggtggtattggaacggtgccagtgggtcgtgttgagaccggtatgctcaagcctggtatggttgtgacctttgctccttcagggttgaccactgaggttaagtccgttgagatgcaccacgagtctcttgtggaggcacttccaggtgacaacgtcggattcaacgtcaagaatgttgctgtgaaggatctcaagcgtgggtatgttgcatccaactctaaggatgaccctgccaagggtgctgccaacttcacctcccaggtcatcatcatgaaccaccctggtcagatcggtaacggatacgccccagtcctcgattgccacacgtcccacattgcagtcaagttctctgagatcttgaccaagattgacaggcgatctggtaaggagatcgagaaggagcccaagtttttgaagaatggtgatgctggtatggttaagatgactccaaccaagcccatggttgtcgagactttctcagagtacccaccgttgggacgtttcgctgtcagggacatgaggcagaccgttgctgttggtgtcatcaagagtgttgacaagaaggacccaaccggtgccaaggtgaccaaggccgcagtgaagaagggagccaaatgatgagacttctctcgtctttgtgttttctttgcttttaaaaaaactttgatggcgtttgagcctttgttcttttattttctgtgactttctcatctctacctcctttttttttcatatctctgagacttatgggttacaattatgcagtttctggataattttgcgtagtgtgttttagtgttttgttttgctacaaattaattttctttgttcttgaa

SEQ ID NO: 1202 - DNA, 1380 bp, Theobroma cacao
ttcactttccacccttcttagctgcagacttggtgaccttggcacctgttggatccttcttctcaacattcttaataacaccaacagccacagtctgccgcatgtccctcacagcaaaacgtcccaatggtgggtactcagagaacgtctccacaaccatgggcttggtgggaaccatcttcaccataccagcatcaccattcttcaaaaacttgggttccttctcaagctccttgccagatcgcctgtcaatcttggtcaacaactcagcgaacttgacagcaatgtgggaggtgtgacagtcaaggactggggcatatccatttccaatttggccagggtggttcatgatgatgacctgagaagtgaagctggcagcctccttggcaggatcatccttggagttagaagcaacaaaaccacgcttgagatccttaacagcaacattcttcacattgaagccaacattgtcaccgggaagagcctcttgaagagcttcatgatgcatctcaacagacttaacttcagtggtcaggccagacgggccaaaggtcacaaccataccaggcttcaagataccagtctcaacacgaccaactgggacagttccaataccaccaatcttgtacacgtcctgaagtgggagacggaggggcttgtcggagggcctcttgggctcattgatctgatcaagagcctcaagaagagtagggcccttgtaccagtcaaggtttgtagacctttcaatcatgttgtcaccctcgaaaccggaaataggaacaaatggaattttatcggggttgtaacccaccttcttcaagtaagaagagacttccttcacaatttcatcataccgagccttggagcttgctataaatccaaccttgttgcagcagcaaatcatttgcttgacaccaagggtaaaggcaagcaaagcgtgctcacgagtctgaccgtccttggaaataccagcctcgaaaccaccagtggtggaatcaataatcaaaacagcacagtcagcctgtgaggtaccagtgatcatgttcttgataaagtcacgatgtccaggagcatcgatcacagtgcagtagtacttggtggtctcgaacttccacaaggcgatatcgatggtaataccacgctcacgctcggccttgagcttgtcaagcacccaagcatacttgaacgacctcttgttcatctcagcagcttccttctcgaacctctcaatcacacgcttgtcgataccaccgagcttgtagatcaagtgaccggtggtggtcgacttaccagaatcgacgtggccgatgaccacgatgctaatgtgaaccttttccttacccattctgattcactgcagaaaataacaatggcagacaa

SEQ ID NO: 1203 - DNA, 1596 bp, Ceratodon purpureus
cgcccccctccgcccccgccctctcttcctgcttcgccaggaccccagctcagactattcaagatgggtaaggagaaggtacatatcaacattgtggtcatcggccatgtcgactccggaaagtcgacgaccaccggacacttgatctataagttgggtggtattgacaagcgtgtgatcgagcgtttcgagaaggaggcggctgagatgaacaagcgttccttcaagtacgcgtgggtgttggacaagctgaaggctgagcgtgagcgtggtattaccatcgatatcgcgttgtggaagttcgagacggtgaagtactactgcaccgtcattgatgcccccggacatcgtgatttcatcaagaacatgattacgggaacttctcaggccgattgcgccgtgctgatcatcgactcgacgaccggaggttttgaggccggtatctcgaaggatgggcagacccgtgagcacgctttgttggctttcactttgggagtgaagcagatgatctgctgctgcaacaagatggacgcgaccaccccgaagtacagcaaggcccgttttcgaggagatcacgaaggaggtgtcctcctacctgaagaaggtgggatacaaccccgacaagatcccgtttgtgcccatctctgggttcgagggtgacaacatgattgagaggtcgtcgaacctggactggtacaagggccctactctgttggaggctttggacgccgttacggagcccaagaggccgtccgacaagcccctccggttgccccttcaggacgtatacaagattggaggcattggaactgtgcctgtgggacgtgtggagactggtgtgatcaagcccggtatgttagtgtgcttcgcccccactggactgaccacggaggtgaagtctgtggagatgcaccacgagtccatgcccgaggcccaccccggtgacaacgtgggattcaacgttaagaacgtggcggtgaaggacctgaagagagggttcgttgcttctgactctaagaacgatcccgcgaaggaggccgccaacttcaccgctcaggttatcatcatgaaccaccccggacagatcggtaacgggtacgccccggtgctggactgccacacttctcacatcgccgtgaagtttgccgagatcttgaccaaggttgacaggcgatcgggtaaggagctggagaaggagcccaagttcttgaagaacggtgacgctggtttcgtgaagatgattccgacgaagccgatgacggtggagactttcgctgagtacccacctttgggtcgtttcgccgtgcgcgacatgaggcagacggtggctgtgggagtgatcaaggctgtggagaagaaggacgcgactggtgccaaggtgaccaaggccgctgccaagaagaagtgaataggtcaggatgagccgcagcagcagtttgtttgtgttctgtagttgttttggcggctctagatttgttcgcactatgtgcgtgttcgatatacttgctgcaggcgcggcagagacagacctgggtacttgaccggagatggcagggcctggcgtgatctgattgttatcattcttctctattataa

SEQ ID NO: 1204 - DNA, 1635 bp, Avena sativa
ggatcctcctcccaccctcgcccgccgccgctgctctgtcttcgtcctgttcgtcttctcggagctcaagccagttagctaagagctccatcagccatgggtaaggagaagattcacatcagcattgtggtcattggccatgtcgactctggaaagtcgacaaccactggccacctcatctacaagcttggaggcatcgacaagcgtgtgatcgagaggttcgagaaggaagctgctgagatgaacaagaggtccttcaagtacgcgtgggtgctggacaagctcaaggctgagcgtgagaggggtatcaccatcgatattgccctctggaagttcgagactaccaagtactcctgcactgtcatcgatgctcctggacaccgtgacttcatcaagaacatgatcaccggtacctcccaggctgattgtgctgtgcttatcattgactccaccactggtggtttcgaggctggtatctccaaggatggccagacccgtgagcacgctctccttgctttcactcttggagtgaagcagatgatctgctgttgcaacaagatggatgccaccacccccaagtactccaagggccgttttgaggaaattgtcaaggaagttggctcctacttgaagaaggtgggctacaaccctgacaaggtcccatttgtccccatctctggatttgagggtgacaacatgattgagaggtccagcaaccttgactggtacaagggccccacccttcttgaggcgcttgaccagatcaacgagcccaagagaccctcagacaagcccctcgccttcccttcaggatgtctacaagattggtggcattggaactgtgccagtggggcgtgttgagactggagtgatcaagcctggtatgcttgtcacctttggcccaactgggctgaccactgaggtgaagtctgtggagatgcaccacgagtccatgctggaggctgtgccaggtgacaacgttggcttcaacgtgaagaacgttgctgtgaaggatatcaagcgtgggtatgtcgcctccaatgccaaggacgaccctgccaaggaggctgccaactttgttgcccaggtcatcatcatgaaccaccctggccagatcggcaacggctatgccccagtgctggactgccacacgtcccacattgctgtcaagttctctgagatccagaccaaggttgacaggcgttctggcaaggagattgaggccttccccaagttcctcaagaacggtgacgctggcttcgtgaagatgattcccaccaagcccatggtggtggagaccttctcccagtaccctccccttggccgctttgctgtgcgtgacatgaggcagactgttgctgttggtgttatcaagagtgtggagaagaaggaacccactggcgcgaaggtgaccaaggctgctgccaagaagaaatgagaagatgatgcccggtggttggctactgctacaccgtagtggttgcgacatatcgtgtagtcgagttagtgaatttgggaacttgtcccgttttgagtttgttatcctgctcgtagtacctttcggttgtgttgtgaaacaatgttctgctatcttcgattaaaagttgctaccctatacctatttttggttcacct

SEQ ID NO: 1205 - DNA, 1505 bp, Primula obconica
aggaaaagattcacatcagcattgtggtcattggccacgtcgactctggcaagtcgacgaccaccggtcatcttatctacaagcttggaggtatcgacaagcgtgttattgagaggtttgagaaggaagctgctgagatgaacaagaggtcattcaagtatgcgtgggttttggacaagctcaaggctgagcgtgaacgtggtattactattgatattgctttgtggaagtttgagactaccaagtactactgcaccgttatcgatgcccctggacatcgtgatttcatcaagaacatgattactggtacttcccaggctgattgtgctgttctcattatcgactctaccactggtggttttgaggctggtatttccaaggatgggcagacccgtgagcatgctctgtttgcttttacccttggtgtcaagcagatgatctgttgttgtaacaagatggatgctaccaccccaaaatattccaagtcgaggtacgaggaaatcgtgaaggaagtctcatcgtacctgaagaaggtcgggtataaccccgaccaaaatcccatttgtgcccatcttccggatttgaaggtgacaacatgattgagaggtccaccaaccttgactggtacaagggcccaacccttcttgacgccctagaccaagtctccgagcccaagaggccctccgacaagcccctccgtctcccacttcaggacgtctacaagattggtggtattggcacggtgcctgtgggacgtgtcgagacaggtgtcatcaagcccggaatggtcgtcaccttcggcccatctggtctcatcactgaggtcaagtccgtcgagatgcaccacgagtctcttcttgaagcccacccaggtgacaacgttgggttcaatgtcaagaatgttgctgtgaaggatctcaagcgtgggtacgtggcctctaactcgaaggacgaccctgcaaagggagctgctagcttcacctcgcaggtcatcatcatgaaccaccctggccagatcggaaacgggtacgccccggtgctcgattgccacacctcccacattgccgtcaagtttaacgagattctgaccaagatcgataggcgatccggaaaggagctcgagaaggagcccaagttcttgaagaacggtgatgctggtatggtgaagatgattccgacaaagcctatggttgttgagactttctctgagtacccaccgttggggcgttttgctgttagggacatgaggcagacggttgctgttggtgtcatcaagagcgttgataagaaggatccaactggtgctaaggttaccaaggctgctgtgaagaagggtgccaagtgaatcgtgcgggtttctggtagattccatgaagtttcttattatgctatgaataatgtcagccgtttgttttctttctgtgttttggggttctgccttgtttgttgcgcagccgttctcagaattgggtgctcgataggcggtggcagattctctaatgttg

(The sequence listing continues in the following parts.)

What is claimed is:

1. A method of increasing nitrogen use efficiency, and/or tolerance to nitrogen deficiency of a plant, comprising:
   (a) over-expressing within the plant a polypeptide comprising the amino acid sequence set forth by SEQ ID NO: 204,
   (b) measuring dry and/or fresh weight of a plant over-expressing said polypeptide under nitrogen deficiency, and
   (c) selecting a plant resultant from step (b) over-expressing said polypeptide and having an increased dry and/or fresh weight under said nitrogen deficiency as compared to a control plant grown under the same growth conditions,
   thereby increasing the nitrogen use efficiency, and/or tolerance to the nitrogen deficiency of the plant.

2. The method of claim 1, wherein a polynucleotide encoding said polypeptide comprises the nucleic acid sequence set forth by SEQ ID NO: 114 or SEQ ID NO:3, or a codon-optimized sequence thereof.

3. The method of claim 1, further comprising growing the plant expressing said exogenous polynucleotide under nitrogen-limiting conditions.

4. The method of claim 1, further comprising:
   (d) isolating a regenerable portion of said plant selected according to step (c) having said increased dry and/or fresh weight under said nitrogen deficiency as compared to a control plant under the same growth conditions so as to obtain isolated regenerable portion of said selected plants; and
   (e) regenerating plants from said isolated regenerable portion of said selected plant to thereby obtain plants characterized by said increased nitrogen use efficiency and/or by said increased tolerance to nitrogen deficiency.

5. A method of increasing nitrogen use efficiency, and/or tolerance to nitrogen deficiency of a plant, comprising:
   (a) over-expressing within the plant a polypeptide exhibiting at least 95% sequence identity to the amino acid sequence set forth by SEQ ID NO:204 and having conservative amino acid substitutions with respect to the amino acid sequence set forth by SEQ ID NO:204, wherein said polypeptide increases nitrogen use efficiency and/or tolerance to nitrogen deficiency of a plant, and
   (b) measuring dry and/or fresh weight of a plant over-expressing said polypeptide under nitrogen deficiency, and
   (c) selecting a plant resultant from step (b) over-expressing said polypeptide and having an increased dry and/or fresh weight under said nitrogen deficiency as compared to a control plant grown under the same growth conditions,
   thereby increasing the nitrogen use efficiency, and/or tolerance to the nitrogen deficiency of the plant.

6. The method of claim 5, further comprising:
(d) isolating a regenerable portion of said plant selected according to step (c) having said increased dry and/or fresh weight under said nitrogen deficiency as compared to a control plant under the same growth conditions so as to obtain isolated regenerable portion of said selected plants; and
(e) regenerating plants from said isolated regenerable portion of said selected plant to thereby obtain plants characterized by said increased nitrogen use efficiency and/or by said increased tolerance to nitrogen deficiency.

7. The method of claim 5, wherein said amino acid sequence is selected from the group consisting of SEQ ID NOs: 204, and 4069-4073.

8. The method of claim 5, wherein said amino acid sequence is set forth by SEQ ID NO: 204.

\* \* \* \* \*